United States Patent 7,482,117 (GENETIC POLYMORPHISMS ASSOCIATED WITH MYOCARDIAL INFARCTION, METHODS OF DETECTION AND USES THEREOF) - sequence listing, part 12

SEQ ID NO: 17995 - DNA, 283351 bp, Homo sapiens
  misc_feature (1)...(283351): n = A,T,C or G, or insertion/deletion polymorphism (see Tables 1-2)
ccacctcccaggttcaagcaattctcctgcctcagcctcccgagtagctgggactacaggtgtgcgtcatcacacctggctaatttttgtatttttagtagagacagggtttcgccatgttggccaagctcatctcaaactcttgacctcagatgatctgcctgccttggcctcccaaagttctggaattgcaggcatgagccactgcgcccagcacacatcttaaatttctattcatgctgtaatccactacaacctggtatctgccttctctgttccacacaaatgaatcttatcaagagcacccacctccatgttgccaaatccagtgacattttgtgtccttatagtacttggctgtgacctcttgttggcactgacttggtccttattccctcgctcctcatacacacttctcttttgttacctttcaaatgtttctctcctgattttccccccacccagtccctctcaactctctttgctggcttttcctttccaactcaacctttaatagggatacttcagggctagatcctagacccctttctcttctttatttacatctttccctagataatcccatctgttttccatgggtttcaatgccctctaacgctagtgattttcaaagcaaagtcatcatacctcctaagaagtctcttcttaatttttgtcttacatcaaattattgacttaatatttctattcaaatatctcaaaagtggctgggcacggtggctcatgcttgtaatcccagcactttgggaggccaaggcaggcggatcacctgaggtcaggagttcaagaccagcctggccaacatggcaaaaccacgtctctattaagaatacaaaaattagctgggtgtggtggcacatgcctgtagtcccagctacttgggaggctgaggcaggagaatcgcttgaacccgggaggcaaaggctgtagtgagccgagatcacgccactgcactccagcctgggcaacagagggagactccatctcaaaaaaacaaaacaaaaaccccacaaatgtttcaaaagtgtcttaagcctaatatgttcaaaatagaactcttgatttcttaaaactgttccatctaactaaatggcggcccgtcttcccaagtcagaaaattagaatttatttatgattccttttttctccctatcccacattcagtcttcaaaaaggtcttaagaattctactctcccattccactccttcctcaatataaatccatgtacttcttttcccagctgctatcacctcagtctaggccatgattttctttttcctggacaactgcaacagcttcctaactagggaccctacttctatcttttgatatcttccaacttttttgtgtgtgcagtagaaaaattttaattaaaaaaattttttttgtagggacggggtttcaccatgttgtccaggttggtcttgaactcctggaatcaagcaatcagcctgcctcagcctcccacagtgctctgggattacaggcgtgagccactgcatccagctgacattcttaaaatacaaatagaactatttcatttcctgactaaagaatcatcaaaggcctcccctgagaataaaacccaaattcttcattctgacttgcaaggcaagtataattcccgcctatctctctgatgttgcctgacttcttgatatagtcttaggccatttcccttgagcttcttaatcctcagcctctttcattttttttttttttttatttgtttttgagacagggtcttgctctgtcacccaggctggagtgcagtggcacgatcatggctcactgtagccttcactgccaggctcatgggatcgtcccacctcagcctcccaagtagctgggactacaggtatgcaccaccatgctcgttcgattaaaattttttttttttttagtagaaatggggtcttggtatgttgcccaggctggtctcgaactcctgagctcacataatcctcctaccttggcctcccagagtgctgagattacaggcatgagccactgcacccagcagcctctcagatttttattctttgcactcaacaagctcttttctgcctttggcttttacacattatttcctttccctgaaaagcttctcccccacattttgtatatccgactcctttttgttcctcatagataataaaatgaatatcacttcttcagagagatctccactgattatctttttttcttctttctacctaaattttatccttgtttttcttttaaaacttttaaaaagcacatataaaatgcttatgtgtgtgatactattctattcacaacaatctcataattagattatattattatctcctttttagatatgacacaactgagaaacacacagctagtaagtggcaaagttggatatgacccaagtagactagcttgtgctttttttttttgctttttttcttttcttttttttgagacggagtctcactctgtcacttgggctagagtgcagtggcggatctctgctcactccaacctccaactcccgaattcaagtgattctcctgcctcagcctcccgagtagctgggattacaggcgcccaccaccacacccagctaatttttgtatttttagtagagatggggtttcaccatgttggttgggctggtctcgaactcctgacctcagatgatccgcccacctcggcctcccaaagtactgggactacaggtgtaagccaccgagcctggcctttttttcttttcttttggtgagtcttgctttgtcaccaggctagagcacagtggcacaatcagtacattgcagccttaatctcttgggttcaagccatcatactgcctcagcctcctaagtattggggaccacaggcatgtattaccatgcccagctagtattttttaattttttgtagccatgaggtctcgctatgttgcccaggctggtcttgaactgctggcctcaagtgacccttctgcctcagcctcccaaagtgctaggattaccagtatgagccaccacacccagcctaggaatgctttaagaaattattttctatatacctgtcattgatatatatgcaatacatatggcatatacgaaaaaagagggaactgtaactatgcagtactggaacagcatggtgtataggaaaataaatttggctgggcatggtggctcacatctgtaatcccagaactttgggaggccagggtgggaggatcacttgatcccaggagtttgagaccagcctgggcaacatagacagaccctgtctctacaaaaatttaaaaaattagctgagtgtggtggtattcatctgtagttccagctactcaggaggctgaggtgggaggatcgcttgagtccaggaggttgaggctgcagggagtcatgatcatgccactccactccagcctaagtgatggagaccctgtctcagaaaaaaagagaaaaaaaacaagaaaataagtttatcttctttacgttaaataccaacatttaaggatcaaagttcaactaagcaacatcttaaagtgtcagagtgtgcaagacatgcctgaaatcagacaaaagtgacaagtgacaaaagtgtatcaatcagaaaaacggggcaggatagagcataggggctggaccacaatggaaatttagcaaaaaggaaagtcacagaggcaaactctgttcttagtttgatccaaaggagagggaggcacaggcaatctagtgcgagtcttatgatccctttggaaggcctatgcttacagtttgtagagtgaggaacagccagaggcttcctgggaaggcaggttagctacctgcaattgcaggttccatctcttttcagcagttcatcatcattcatcaacgtgtcagaggtcagatgccacgggagcacacaggaggggcttcccacctggagtgcgagataaggaaagatgggtcggatgttgtagtcattatcatccgcttctctacaaggctggaatttatggtggctgcacatttggaatgttttctccttttatttatttatttttagatcagacaatcacaagagactattcttttgttttatttttagatcagacaatcacatgagaatattctgttgtgatcgctggcgtttagaaggaaacttgtctggtttgtgaagcaatggaaaacacatccagacagcctgctagtggaaactttggaagggcactgtcatatgctttttctcccacgccatcaacaagtgtcctttttttttttttttttttgagatggagtctctgttgcctaggctggagtatagtggtgccatctgtaccctccacctcctggattcaagcaattctcctgcctcagcctcccaagtagctgggatcacaggcgtgcaccaccatacctggctaatttttgtatttttagtagagatgggatttcaccatgtgggccaggctagtcttgaactccggacctcaaatgatccatccacttctgcctcccaaagtgctgggattataggcgtgagccactgtgcccggtcaacaatcatcttttttttttttttttttttttttttaccaggtacacaatgatgggagagttgagtcctgctttctaacttagaaaacgcatgtgtgttcatcacctggtcactgagaaacagctctggaataggtgccatgcagaagaagagagggaactggaaagacccactgatctgtgggtctcacagcctcccgttacacagaaattgcttcttttctctcatgttgcgttcttcctcttgattctcgacccttctccactctttcatttactccactcttactttgctttcacctccttttgtaaccgttcatcatcactcttcatatggattaatgtgattatcttaaaagcatgtaatatgtagttgctgggtttgtatgagtaatgagtgaacctgaagccaacataatgatcccgtttagtgctcccgagttaagattccagagttgcctgactttggacaaatcacatctccctttgcctttcaccccctgtaaactgaggataatggctcttacctcaaagcattgttaggattggagagaacgcatgttacatacttagaagaatgcttggtatgggtctcaagaactcttagctcttattgtttaaaaaatgcttattacagggcatcgttggtatcttatatagggaatttcaagcagttttcctttattgaagacacagagtaaggtgctttgatggaaactattggggcaagatatacagtacctagctagaggtttcctgggtgcatgtattgtggagatattttttttctgagtggatagcgctcttgtgatacgctgggtgagggcgagcaatatttagcggactgtcctgtgaggatagtaaggttatctggtgagagtgttaggtggcccaggccagacttgggagaggcagggagagagggggacgacggaggagggcgccttggggtgcgtcttgaaagctttgggaaacccagcggtcttttgggggcaggtggcccaaaaagccttctgcgcgcccaggggacgaggaggatgcgcgggccgcgaccgcgatagttttgtttgcttttctcgggagaaagcgttccaggcagtttcctgagcttcggccctcgacgtagcaaaagagcccgggcgcccacgccgctctcggggtcttctactgccaccgggacaaagccctgggaggagctcccgcccccgcgagccggacagggcggaggctcccccgccgcgcgcgccccaccgcttcccagtcccggacccgtcgcctgcgcctcctcctggcgcgcctcacggtgcagcgggcggcggccccgcgcgccctgcgggaggcgcctcgggatgtttccgtctggtccttccctccgccccccgcgctgactccatccgctccccgccccctgctcggagccgccgccacgcgggaagggagggagccggccccgagactgcatcattccgcaccggctgctgcagggccagagggagcaggtggagcgagagagcgagccgcgagccrgagcgcgccagacccagggcgagactgcagtgacgcggcccgggagacatggcggacgggcgtctctgaataagcagaatccggagcccctcsctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcycccaccccgtaaccccctcctgcctccatccaccggggctatggccgcagaagaggtattgcagacggtggaccattataagactgagatagagaggctaaccaaggagctcacggagaccacccacgagaagatccaggctgccgagtacggrctggtggtgctggaggagaagctgaccctcaaacagcagtatgatgaactggaggctgagtacgacagcctcaaacaggagctggagcagctcaaagaggtgagttgcctgtcacctctccctttcctggccctcactccccccacccgcaaggcccactcatcatgatcaagaagtcataaaggagktgattgaaaggactgttttttcttctagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcakcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatayatttataaraccagaatatcamaaatgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgagrcactatgggtagcaartaaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatctaatttttgtgtgtcaggctgtaaatttctggttcctattttacttaccatgtacctgtctggtcttaacaacagctggacttgtttatattttccaacttagattaggctgacatgtttaaatgcagtgatgctaaaccttgtgaartgaggaarcasgatgatgactgtcattctcagagatgttttgatattgtctatacctatcaacactgctttgccaagatagggaagtgcaaaccagaaastggtaagccatcaccttcttgataaaggagatggacttaatttaatgaaatgtrcctcttactgactytgctgcttgatttaaacaatccttctagggatatttctgtcattgcacttaccttgcatagcaaaccttaatgcaattgtgttttgcctttgctacaccatgagctttgcatcccaagtctttaacacaaaagmtagcacacagtgggcatgaaatattttatgaaagaatcagtttgtactagaagaaggcacacttttatcargggttcactagtcaatattgattagtgttagataaatactaagaaaattaggatgtataggaagtgacagatgttaataaaactacctgtattagtttcaccagcagtaatgagaaaaatgtgaaaaaaacgttttgtaggaataatgtaactgtggtttcttaatacagaataatgcaaataccaactaaaattttttmtataaatattttaatatatattttgttmtatatagcaggaggttaataaaaatttaccagcattatttttactaaacgattcttgttcatatatttattttcagttgcatttagcataagtgaaattcgagattcctaaaaaactggtttayacagttatataaaaatgtattttaggtaataaaattattatagttgattatttgatagtgaggcctattatttttattctttaaacatagaatatactttagttggaaatataacttaaatgagttaaattgatttcaagtaacatttcttgtatgaaaagtaaatccaaaataattgtgcaaactgaggtgttccaacacctcagttttgaaaaatattttgtgagtgttttgatttttcaaaagaaagttttgctcatcaggtatgtatagtaaatgatgttgcattatatctataaagccaagcataaaataaatctttgcttatttctaggatttttgaacaaatatgatttatttaaaaataattgaaccagtttatgggaatgtcaacagaaaactactgtattaagtccaaattggacattagtaatttgcartatagcaacatggctcagtctttgcagatcattttgttttccagagtcagtacccaccaatgttgctaccttccttcccaggctaggtactgctgtgacaataatgcaagtcggcagtgttgcctaaagatgtgcaaaatcaagaagatgaaattcattaaatttttttcctagttatttcttccctcaactcaattgttttttgacctggcctgatgttgtttagtgctctgcatggactactgtaattcagctcacagaagaacacacttgaaagaatagtactaaggatttgaaaaaaggatgacttctgacatcatcaaagtgttctccttttcatgattctttgggcagctggacagagcagtatgtccactagaatacttgagtctggttttgtgatttcacaagtaacacttgctcttcagtgacctgagtgagggtcacccatgcccagttatgttcagggcctggctgattatatgtttgggatgtacgtaaatcagcactgtgcgcctgtcacccaggccagaatagtgtttgaagaagagtcatagctccaaaataacctgaaaactaaaaatatacatatataaaaataccttggatctaaacttaagagttttttttacaccgcatgttctcactcatagatgggaattgaacaatgagaacacatggacacaggaaggggaacatcacactctggggactgttgtggggtggggggaggggggatggatagcattaggagatatacctaatgctaaatgacgagttaatgggtgcagcacaccagcatggcacatgtatacatatgtaactaatctgcacrttgtgcacatgtaccctaaaacttaaagtataataataaaaaaaaagagtttttttttaacttaaaaatggttgaaatttaaaatgttgtaaagttgaaaaagagccccttagaaaggaatgattcagcattactgatggcattttaaaaaggaaatgtatctgtgagacagctttagaaaagttttgcagcttggataccgtaaactatgcactaatgagcttcaacccattttcttgcttattttgtcaaccctgacaccaaggatagttaccagctgctgaagaagcactttctggacattgggcagctttttcttttggagccaactctattctttttcagggttatagttaaatcattcaacacaaaaatatgtacttacacagttttagagcttgtcacattggtgacctgatgaatgccacttaaattacctagattcatctttaagcagaattgttttcccttcagatgcttagaaagattgttagtttcttttatatctttaagttstaaatcacaaaatcatatggcaagaaaaaccccagatttcttttccaatctatgaataaacataaagagacagttwatacttaattgatctatctgaactatgatttttaacttctctcattgtttttatttttttattttattttattttattttgagatggagtctcgcactttcacccagcctggagtgcggtggtgtgatctcggctcactgcaagctccacctcccgggttcacgccattctcctgcctcagcctccggagtagctgagactacacgcattcaccaccacaccyggctaatttttcgtatttttagtagagatgggctttcaccttgttagccaggatggtctcgatgtttttaaagaaaaaatatttacatttattatcaaattaatcttaaaatctaaaatacattaagatatgcttttggaaactgtttacaaacaacctcaacaaataaacatcatcgctttcaatcacatttctttttttctggacccagttgctctaacttgcactatcccttttttttttttttttttttttgagatggagtttcactcttgttgcccaggctggagtgcaatggtgtgatctcggctcaccgcaaattctgcctcttgggttcaagtgattcttctgcttcagcctcccgagtagctaggattacaggcatgcgccaccacacctggccagttttgtatttttagtagagatagcgtttcttcatgttggtgaggttggtcttgaactcccgacctcaggtgatccgcctgcctcagcctcccaaagtgctgggaytacaggcgtgagcccccacgcccagccccttctttttatttgaaatcaagatttcgtctctggcgaagttatttctcagatataacttagcaagaatttatcatcttttatcacattccccatgtttatgtgaacatgtatgacagcgatggtttgaagrtttcttcagaactttctgcttgcaaatattttgccctatcatccccttaaatatagttgtactcatggatattgctttccaaatttgaaaatacggtaattaattacttgcatgttgaaatatacataaaggacttgcccacacataagattccacctgtaattayggctttgaggagaggagggcatgaagggctgcatagtcttagtattaaataattcattacgctaaaggagaatgcacgtaaagtcaagtggcaggagatgcaattgtgaaagggccatggccacattttgtcttggggatgtggagccattgaaaataaatgaaacagtcactgtgtttaatctcaccagtcttcaaaacaattcagagggcttactgctcatttttactgataagaagataataaaaataataaagcattgacttaggtacaaggctccatttagaactaggttctttacaagcctcrcctctaattcatgcagcaatccttactcaaggtaggtgtttcttgcattatacagaagaggaaactgggtcttagagaggtttaggtctcttcccagggccacaaaactaaacgatgaaacttggaagaagcccacttttttttcactgcatcatactaccttgaatatgaaatatctctgccaagtctacaagtgcagtatagaaggttatggtgatggtcatagtgggtggattgaggctgtgtggtgggacagacagtggcagtagggatcgtgaggagggggcacgtctaagagctatttgggaggtagggtggaacaggcattggatgttactatatgtggaaagtgaggaagacagtggagctgagaatcttctcaggctggataggaggtggttctrtttacaaaggaaggtattatggggcagagcagttttagagggtgaaattgatgctcaagttacatgagtttctgttgtttttgacacagggtttctctctgtcacccaggctggagtgcagtggtgctgttacagctcaccgcaaccttaactaaccatcctggctcaagtgatcctcccatctcagcctcccaaggagctgggaatacagacccatgccaccatgcctggctaatttttttttgagactgagtctccctctgtttccccagctggagtgcagtggcatgatctcagcccactgcaacctttgcctcctgggttcaagtgattctcctgcctcagcctcccaagtaactgggactacaggagcataccaccatgcttgggtaatttttttttttttttttgagctggaatctcactctatcacccaggctggagtgyagtggtctgatctcagctcactgcaacctccacctcccaggttcaagcgattctcctgcctcagcctcctgaataggtgggactacaggtgcctgccaccatgcctgaataatttttttttttccaagacagaatctcgctctgtcgcctaggctggagtgcagtggcgcaatctcggcttactgcaacctctgcctcccgggttcaagtgattctcstgcgtcagccacctgtagatgggattataggcgcgcgccaccacgcctggctagtttttgtattttttttagtagagacagggtttcaccatgttggccagagtggtcttgatcttctgacctcgtgatccacccaccttggcctccgaaagtgctgggattataggcatgagccaccgcgcccagcctaatttttgtacttttagtagagagaagatttcaaacatgttgcccaggctggtctgaaattcctgagctmgagcgatctgcctgccttgccctcgtaaagtgtggagattacaggcatgagccattgtgcccagccacataagtccttttaattcatgttttctttgctggggaagcgtacattgcatgatggattcagatmctcaactttcttttttttctttttttgagatggggtctcattttgtcacctaggctggagtacagtggtgtgatcgtggcttactgcagccttgacctcctgggctcaagcaatcctcatgcctcagcccccaagtagctgggactacaggtgcacaccgccatgcctgactaatttttgtattttttttgtagacacasggttttgccatgtaagccaggttggtctakaactcttgagctaaggacagtccgcctgtkttggcctcccaaagtgctaggattacasgctaactttcaatttaataaaaaaaattaatttgtgcaattggttgttattttatagaagcctaatttctakaatatgggatataaacaatttaataatgtkttcaccagttagtttgattgctttctaaattaggaaaaatgaaaacaaataaacgatgggcaaaaaagctgactggggacagtaaggtctaagaaggcagcctaagtggaaaattagcccttactcaccatttagggttatgggggctgggagcaacagtcctcactgctcactgactaatctttatcaatcttatttaatctttattgaagatgcattagcatttttaatttaagtgggtttttttcctcttttcttttggtggggggtgtgggcggcgggggagtttcaatatgttgaccaggctggtcttgaactcctggcctcaagcgattctccckcctcagcctcccaaagtgctgggattacaggcatgagccattgcacccagccttttctatttttcatttcaagagtttgctttttaagaattaaaattgtgtaattatgacagtttttattrcagtactccaagctagagaaaagcatatataaattaatagttttcccttcttctcccacagttctgtctctgttgttaacactttgctgagtattcttctgtacttgttttaaatgtctttaaacatataggcagggtttttgtgtgtgtggtgtttttgktttttttttttttgctgtttttcttcctttgtttttataaaaacaggatcttgcagcctggtgttttaaatttagtagtatgtcctttcaaaaggcaggtatttacgagacaaagctgcatttttaaagcactggtgaagtgtgaagaaaatgagaccgattagggaagaaaacccgagaagctcaragtttgggtgaccctggggatgtgggaaggtggtgwaaatggtaccctgagggtagcatggatggtaagtgaaagaggaaaaggtgtaggtttgcataaaaraaactgatggaatttggatgcccmatagcaracccaggggaatgataccaggggaaaagatggacagttttgtgggtaaattagcagkgattttgattccttgtcttgttagctgctgatggagatacrtgtatcagcataatacctggctagtttccatggccggcaagagccagtcctgcagtgtgaccacatcctgtccattctgggtcttggtggcaagccaggatgattcaggcagttgggctttattacgttatcccttctttgccctctgaaagctgagttttgaaatagttaggatcttatacaacatctcagattcagcatgctgtgcasgaggtggggagaaaagggtacaaaagaggaaaatgttcagtgaaggtgttattacaatggaggggawtatgaaagtggaaattgataccttttcctcttgggatttaattaagtctataaaattraggtgttgcaatacataatgtctatgatttttttttaccasctctaaatctctgagatggctgtgttttagagctgcatgtkctgcttatttactgcctgtcctttacatttcaaattcattcaatatttttccaaagtacasaatagttttgcctagttgcagtaattttcacctagacttcagggatcttccatcaactcttttatgtattttttctcctttgtttttccactctggtcactcagttctagccaagatagtccaccttattttagcacttgtactatgtctctgtctctgtctgtctgtctgtctgtctstctctctctctctctctctctctctctatatatatatatatatatgtaattttgagatggagtctcactctgtcgctctgactgaagtacagtggtgcgattacagcccactgcagccttgacctcacaggttcaagtaatcctcccacctcagcctccagagtagctgggaccacaggtgcacaccactatgctggctattttttttttttaacctgattttgtttttactggaggctcaggtggcccaactaatttttagaaattattatttgcagagatgaggttttgttatgttgctcaggctggtcttgaacttctgggctcaagtgattctcccacctcagcctcccaaagtgttgggattgtaggtgtgaactactgtgcctggccttctacattttttttttamccatttcatagttccctttttctttgaacacttggtccaaactcacttttyttctggattcatattttctgatctcacmtattatgttatagaactgatatgttacgtttgttttcattgatgcgtstgtacttggcttcagagagcagaacaaggccctgtgagtcactgggagccagattttggatcaaaataaatcactttctgacaagtgtagttgtctagtaatggaatgaggcagtcttcttaggaagtaatgaattccctgtcaccaaaagggagaagctagtgagccacttgctgagaatactctatggggagttgtccttaggaaggggtatatctagaatgatctctaaggttcattcttattcggatttctttgatttttatcattccaggtgttccaaataatttgataagtttatgttttttatacttttcccaccaccagagcagtgtttccaacatggttaaattgttctgctttaatgtttggcatttcacactatttgatgactgtaaacatttggaatgttttcacagtgtctcaaaactttattttgatttatgttttgctttattttcagaagaaaactaatgggtaatataaagctttaagatgagtgtatctctaaatttggagagctttcagtgaaactgtacattttgaagctacgtggttgcattgagggaggtctacagcctccagaatcttctttttcacacacacgggcacatgtgcatgtgcatgactttatattttgtcatttacgcttagtcatatatatatatatatacacaaatatatayayacacacacacacacacacacmyatatatatatatatatatatttttttttttaagaccatatttygctctcgttgtccaggctggagtgcaatggcatgatctcagctcaccgcaacctccacctcccagtttcaagcaattctcctgcctcaggctcccgagtagctgggattacaggcatgcaccaccatgcccagctaattttgtattttyagtagagacagggtttctccatgttggtcaggctggtcgcgaactcctgacctcaggtgatctgctcgcctcggcctcccaaagtgctgggattacaggcgtgagccatcgcaccggcccgcttagtccaatattttattttattttattttattttatttattttttttgagatggagtctcactctgtcgcccaggctggagtgcagtggcgcgaactcggctcactgcaagctccgcttccctgggttcatgccattctcctgtctcagcctcccaagtagctgggactacaggtgcccgccactacgcctggccaatttttgtatttttagtacagatggggtttcaccgtgttagccaggatggtctcgatctcttgaccttgtgatccgcccgcctcggcctcccaaagtgctgggattacaggtgtgagccaccgagcctggcctagtccaatattttataatctgcatygtcaactagtcaggccccagaatctgtgggttcagcatccttggattctgcatccttggattgaaaatatttggaaaaaaaattgcatcggtactaaacgtatacaggctttttttggtcattgttccctgaataattcagcataacagctatttacatagcatttacatcgtattaggtattataagtaatctagagatgatttaatgtatactggaggatgtgtgtaggttacatgcaaatactacactattttatctcaragacttgagcatctgtggattttggtatctgcagggggtcctggaacccccacaccctcacccagactgagggatgactgtatttacgttatctaccactctgatgttttctttttgctttarattgcccattacctcttcatctgtttcatttattcattcaaaaatttgtattgagtggctactgtgtcgggcatggtgccacttgctggagatacagcgttgaacaagacagacccaatggggctgcctgggtggagcttatgtttcakactgggaagagagtcaacgaacatccacacatatttcagttgtgagaggtgccatgagggaagagacagactggctggggaaagcgtgatcaggcagtcttccccaggaggtgagacttgagcccagacctgaatgatgacaaggagccagtcatgtggagactggggaatgtgatttttaagaagaggacaagtgccaagatctgcgaactctgttgtagttgttaggggaagggatgggttaccatgctctgtaaaaatgaccattcatatttgaaatatgaccattctgtaacacagtgtattgcctactggatttttctaatgaggtattgggtctcaacattggaaatgtttgagcagaccttggatatctccctgaggtcttctctgagaagaggtgggtaggaactagtgactttcaatacagactgtatgttagaatcacctgggtgatttataaaactactgctgcctggaccccactccgggagagttaaatcactcattggaagtggagcctggcttcagcatgtgaatcccacttcccttagagatgcagccagggtaaagaacccctcttctatatttccaacttgaggactaaatgaccccatgggcgtagaagtgtttagtaagaaaatctagttccgggtgcagtggctcatgcctgtaatgccagcacttagggagaccaaggcagatggatcatatgaggccaggagtttgagaccagcctgaccaacgtggcgaaaccccatctctattaaaaatacagaattagctgggcatgctggcatgcgcctgtagtcccagctattcgggagactgaggcatgagaattgcttgaacccaggaggtggaggttgcagtgagctgagatcgtgacacttcactccagcttgggcgacagaacaagactctgtctcaaaacaaaacaaaacaaaacaaaaaactgggaagttatgagctaatacataaaccttcattgcacagtcttttaaaatttgttgtttctactttctgaaaatgaaaatattaaatccttcctgaaaacagaaaatatcaaaaacttaactgcattagacagagatatatgttaactttgagtgcatttaattttgtattcttgagtactgtttaaagtgtcttttaaaagttctctcttattgtgtctatttattttattctgtttgcagtttttatgccaactttacacatttgtaaatagaatatttaaaaagaattttttttgagggattgatctctaacttcttggtgacttatagttgttcttttggttgtacatctttactgttttccaacattttaaggagaaaaagcactactctcaaatgtaatatttaactgctgtgtttctatctttaaatatagaattgaaaatgagaacctgtttatatttatgggagcaatagcaatatgtgtacaataacagtagcaatttccttaagaatgttctgttgcagtttggcgtgggtctgtgatagaaggttcagaatgatgggtctttgtttttctcttgcatactgcagagtaatgtggaatcaaataccactattgaagagctcttagtcatcaatttttgaaactgaaagaggtttatattgtaagaaggatgggccctgttgataagcctcactgattgctacttgctagatggttttaggagatatcttgaagttgaccttgtgtgaggttactggatggaaacagcatgagtttaatyttgtacatgacttcttttgttgagctggagatactattgtyttgcagattatytytttggcacgcatgaccatttttttttgtyttttaaatcacaaactggctttytttctgctaaggttggtgtgcttagattctttaagctccaaatctcaagaaaatataggaaggaaaatcaaccattagagagagagagagagagaraaaaaaaaaaggaaaaaatataatgtgctccaaactgattataaatagcttttgaattgttggctccatagaattttttttttttttttttgagacggagtctcgccctattgcccaggctggagtgcagtggcgtgatctcagctcactgcagccaccgcctcctgggttcaagtgattctcctgcctcagcctcccgagtagctgggattacaggcgtgtgccaccatgcctggctaagtttttgtatctttagtagagacggggtttcacaatgttgtgcaggctcgtctcaaactgttggactcaagacatctacctgcctcagcctccaaaggtgctgggattacaggtgtgtaccactgtacccagcctcagtttgttaatattttacaataatttagaagtagaaccctttcttaaggctgggcgcgctggctcacacctgtaatcccagcactttgggaggccgaggtgggtggatcacgaggtcaggaratcgagaccatcctaacacagatcgagaccatcctaacacagatcgagaccatcctgactaacatggtgaaacccccgtctctatgaaaaatacaaaaaattagccgggcttggtggtgggcgcctgtagtcccagctactcaggaggctgaggcaggagaatggtgtgaacctgggaggcggagcttgcagtgagctgagatcgcgccactgcagtccagcctgggcgacagagcaagactccgtttcaaaaaaaaaaaaacaaataacaaaaaaagaagtagaaccctttcttaagagcattctcaggtcttctatcttaattactgtagttatttccagtcatgttttataatcaggtgctatttttcattgtggcataataagtaatatatttttgtaaatcatgttgaagtgcttgagacaatacaagcaattatttgctaaaatttagaccagggtctcaaaacaacaattacatttttagataatggtcacagtaagtcttttcaraaaaaagcaacgaagaaagctctagaccaatgagattttagtcatcattaatcaatgccaarcgaaaaaatcttaagatgtatttaaatttgtgatgccagtgtgattcagaaatttgaaaaatggatttcaaagtaatgctgtgagcagataggtcattgtataaacataactaatggttcattcattcattcctacaataatgattcagtgtcagatttgggtgttgaaaatacagcagagaacaaacacaacagaaggtccatatttgcggagcctacattttgtgggggaagagagatgataaacaaaatgaatgagttaagtagatagcacgttagatcatccaaaatgctatggggggraaaaaccctgggaatagggagatggcatgtgaagtggaagaaggttatgattttcaatagagtgatcagagaaagcctcattgagaagacacnctaaggaggccatgtggctggaggggactgagttagggggtgaatagtaggtgagaccagagggggccacatgatgtagcagcttctagattatcaggactttggcttttgctctgagtgagatgggaaactttcagagagctttgagcagaaaagtcacaatgttctgcactttttccttcattgagataacctctgcatacattcaagcacgactaagacccccttcagggaaaagaagttttcattaactcagtatcccatgaggtatatggcattctcttccttcccaccatagcaggtgtttaatagrtggttatggtattgcactgatttaggctgggaaaaaawtaaagatgaagttattaagacagccagttgtggtcgggcacagtggcgcacgccggtaatcccagcagtttgggaggctgaggcgggcggatcacctgaggtcaggagttcaagaccagcctggccaacatggtgaaaccccatctctattaaaaatacaaaaaataagccaggcgtggtggcaggtgcctgtaatcccagctacccgggggctgagccaggagaatmgcttgaacctgggagatggaggttgcagtgagccgagattgcgccactgcactccatcctgggcgacagagcaagactccgtctgaaaagaaaaaaaaaaaagacagccagttatttgaaaagaggttggagtagaccacttgttttaaaaataaccacttgtttgcctaggttaaacccatttactcaaaagacactgcgctgacttgcctggttccttgtacctgaatctttacctaagtgtcttgtgctctctgtcctttattctccataatgcgagctatccagtagaccctagccaaaggggacataaagacagtctcaacattgtattactggttctktgctacagttgtcattcaagttcctgagaaaatggaatgaatgtctgttattcatttatttattaaatctttagagagcatyatctatatgccaggtattatgcaggctatacaaaaattaggaagacgtgatctttatttttaagttacttatttgttgttgragrcaacagagataaatgaattgtgatattttactggaaacaatatgrgtttttgagttaagaacagactgtgtttgaaatccctttagcagctatgtgaccttaggccaatatttgaaatgatgtgaacgttggtttcctcctcagtaaaatggagaatgataataactataagtggtaaggaaaaatgcatgtgaaggatttaatacagtayctgacacatgacaagcacttgataaatgatggatgtgatggtgacaataatagtaataataataaaataataatrtgttggctgtgctcgataggagtggagggtagcaaactcagcttgaatcagagtaatctcctgatcaggcaacatttgagggggctttgaagaataagtagggattttccggggagagaagaggggcaaagtcattcaggargatgaaacagcctgtagargagggaaggctggagagagtgctgcttgtcagtgtctgtgttgttgcagtagggaggtagatggaatggggtgagaggggaggtgagcctggagagatggtttggggccagatggggaaagctgtgttayggggcttgtcagtttctgccagccaaggcttcagcatagctgactgtaacaaagttgggaaggccttgcttttgagagccagaccaggagtacctgtgactaacaaggggtctgggaggatctgctgctcccatgccctcctttgtrtrttttaaatctgtttgagccttctgggctcctgtgaattagggagwggcagctcctcagtctaactcctaytgtgaccaggttgcctaattggccctttggtttgggcacccactgtccttctgcgtggttggatagatgctgctcccaatgtccctgatctcttacagacccctctgattcttcactcttggctttgagagcccctgatgccctgcagtcttgactgagcttctaatggttgatcagacccttgaatgttgagctctttccatactagacttgaatattctcctgcccatttgatttgttaattaggattcattggctgtttctstgctctcctcttttctctctgttcctgctggttcaagtttaacctccattttctttctcctctgggaagtttcccttatgcctcttgaacagggtcaagagcacttaggagctcagatttacactgtatatcatgagaaaagcattgaaagtttcaaagcaggagagtgacataattagctttatgttttaaagcggmtttttgactttagattctggcaatacagtggtcctgtggtctaagacatctgactaaccttcctgmtagcaacaattaaaaatgctgagtgcaataaaaaactagcccttaaatggaatgaatgagtygactacttggtaaggatgctcagaggctaaaactgaatcaaagcaggaactcttaraagtaagcagtgtgttggctaggcgcagtggctcagcctgtaatcccaacactttgggaagccaaggcaggtggatcacttgagctcaggagtttgagacctgccggggcaacatggcaagaccccgtctctaaaaaaaaaaaaaatgccaaaattaggcagacatggtggcacacacttgtagtcccagctgctcgggagcctgaggtgggagaatcgcttgagcccaggaggtggagtttgcagttagctgagattgtgtcactgcactccagcctgggcaacagagcaagactccatctcaaaaaaaaaaaaaaaaaataagcagtgcatcaaatctgacttttgccttgaatgcatttgctgaatcagtattggttcaatactgagcattagttttccggccacttagagtagaggaaataggagataaagcctagaatctccccagatttgggctccagaggaccctacaactattgtggggggaactggatgtggtgggaaaaattgtatacctcttctcagacttcataccccaccaatgggctstcaccacggtttgcagactgttcacaccgagtktgtgtagaaaggatgaaatcttaagattagaatgagagtgaacgcaggttggtcatgcctgcagctctctttgaagacactcgctatcatggygggctagaaatagtcaccatagatagtattcttaaaaaaaaaaaagttgctggccgggtatggtggctcacacctgtaatcttagcattttgggaggccgaggygggtggatcacttgataccaggagttcgagatcagcctggccaacatagtgaaaccttgtttctactaaaaatacaaaaattagtttggcatggtgatgcaagcctgtaatcccagctacttgggaggctgaggcaggagaattgcttgaacccgggaggtgaaggttgcagtgagccgagatcagatcacgccactgcactcyagcctgggcgacagagtgagactctgtttaaaaaaaaagaaaaagaccctgcagaaattaaaattgtaaaaatataaatatacaaggaacaggcaccaggcacctttggctccacatcctygtcatcacttcataccttgtggctctagtttgcatttttgtggctgcttatgaggtcgtgcctcttcagtatttacaggcatttatgactatcctgcactgaaatgcatttcatgtctttgctcatttaccattggattgtttacatttttcttcctgatttgtaagagtatacacctatactcatattctgtatactaagcctttttagttatttagatatgttggaaatatcttttcctagtccatgggttgtctttttactctttctgtggtatcctttgaagaagagaagtttataattttaatttagttgatttatcactsttttgtgtttctaggttgtatttttctattcttaagaaatcctttccatgaagtcataaaaacatgcacctatattgtcttctgaatatcttmtggtttgacttttatatttaaatctttaattctccctggaattgakttttgtgtttggtgtgaggtagaaatctaatttaaattttttcccatgattccaccccaccccccaataaaattagccagtgatctcartaccacaggttactgaacagttgatctttcctgcactaatttccaatgtstgttttgtgataaatcaagtttttatatatgcatgggtctatttttggactattctgttacattggtttgttggtctattcttgtgcaaatgccacactgtcttactcttaccattttaatataagttcttggtagctgatggaataattcttcttattttgttcttccccaggagtcactggctttggacaccttccttgctgtcataggctctttgctttggaaagctctcaacatttacaaggaagtgacaagtgtgaacgaaggcagatcacactgtttatttccgtttccccaataagcattaaggaggaggatattgagggtctagttgtggttgtcttagactttgcacatgtttttataagcaaagcagacaagctccagcaagggaactcaattgtctaattagatgttacyagaaatcttattggggctgtgatctaattcttttttttttttttgagacagactcttgctstgtcatccaggctgcagtgcagtggcgcgatctcagttcactgcagcctytgcctccgaggctccagtgattctcctgcctcagcctcctaggtagcggggattacaggtgcatgccaccacacccggctaatttttgtatttttagtagagacrgggtttcaccgtgttggccaggctggtctcaaactcctgacctcaggtgatctgcccgcctccgcctcccaaagtgttgggatcacaggcgtgagccaccgcacccggcctgagctaattcttaagaagtcactttggaaaaaaatattatttaagggcttttcataaagtattcaraaaggtacaagttctaatctaacagttctatttgtgatttttgaggaagcatatgcgtatttccacttaagcatctgaaatattgcctmtagtgctgaacaaattcttcccttggttattttcctcttatctcagtccctggarraataaatgcctgtactaattctctatatacataaatggtctctttaggtataaataacctcataatcacataaaagttaaagttttaatggaaaaggctgagatgaaatattacctaagtaggaattaattgctttttatcactttacattatttcatttttagtattatgaaaaatataattgttccttttcttaaaaaaaaccagygtaatttgtgcttagttttaaaccaaaatttttcctatatgtttatagtttatattttcaagccaaaatacttgagtttttttcctgtcataatatatcaatatgagaaatgtattgttactttagaatcttttaaaacttctttttattcctttttttgttttttaagatagggtattgttttgttgcgcaggctagaatgcaagggcacgatcttggcttactgtagcctcagcctcccaggttcaagcaaccctcccacatcagccatacaagtagccgggactacaggcatgcaccaccatgtccaactaattttttttttctttttttttgagacagaatctcgctctgttgcccaggctggagtgcagtggcacgatcttggctcactgcaacctctgcctcccagattcaagagattctcctgcctcagcctcccgagtagctgggattatgcaccattgtgcctggctaatttttgtatttttatagagatggggtttcaccatgttgtccaggctggtctcgaactcctgacctcaggtgatctgcccgcctcggcctcccaaagtgctgggattacaggtgtgagtcaccacgccaggctgctccgtgacatttaaataaaatcatattttaaagtccagttgtaagcctatacatcccccttatcacttatctctaattcacttctagacctggtttgaactttggatttagtgctttcaaagtgtgatttttttaaaaaaattatttttctgttgccgtatatttcagctcttctcggtcttgaannnnnnnnnnnnnnnnnnnntcgagtagtcatcactcagctccccaaagtgctgggggttagaggccaactaattttttaaaaattttttgtaggccgggcatggtggcttatgcctgtaatcccagcactttgtggagtccaggcagacggatcacctgaggtcaggagttggagaccagcctggccaacatagtgaaatcctgtctctactaaaaataaaaaaaattagccaggtatggtggcacatgcctatagtcccagctacttgtggaggctgtggcaggacaattgcttgaacccaggaggtggaggttgcagtgagctgagatggcgcaactatactccagcctgggcgacagagcgagaytccatctcaaaaaaaaaaaaaaaaaaaaaaattctgtaaacacaaggtgtcactatgtttcccaggctggtctcaaactctgggctcaaccgatcttcccacctcagcctcccacagtcctgggattatagacatgagccaccgcacctggcctaaaactctttcttcaacattaagaaataagacttttccagtctctttcttaaccctgtacccttttctttctcatcttcttttatcccctcccttcattaactttacattgcaataccaaggacttaatggtttgttaaaaaaatgaattctactcagtagaaaattcctgagaatatttattaaatgtcactgggaggaaatttccctaagcaagatacaaaacttagaatcaaaagggaggactgacttatttggttttagaaatgaaaaagaacagtttggaagaaatagtgcgatgtggatgacttacaaacaattattattcctaaaatataggtacratgagtttattgaaaacaacataatgcaataggaaaaaaggacaaagascaactagtcagagaggatttgcaagtaaatcagtaaatgggaagagatgttcaatctgagtagtcagtgaatgtaaattaaggaagtttactttttttcccattaatttacaaaaattttaaatatgataatatacagtgacaaaatttttttttttttttgagatggagtctcgctctgtcgcccaggctggagtgcactgggcaatctcggctcactgcaagctccgcctctcgggttcatgcccttctcctgcctcagcctcccaagtagctgggactacaggcgcctgccaccgcgctcggctaactttttgtgtttttagtagagacggggtttcaccgtggtctcgatctcctgacctcgtgatctgcctgcctcagcctcccaaagtgctgggattacaggcgtgagccaccacgcccggccccaaaatttttaaataatgataatatacagtgtcggaaagtgtgtagaggtagaagtgtgaattgctgtgaactttgagaacgtggattggcagtctgtattaagatctaaaatgcatacagtgcttgggcccagcagtctcacagaagccataggtgattgtatgtcagttcccaaataccactcgttagagagaagcactgtttaacatctagtatctcatttagaccctgtttgagcatagatcatatgtgtgtggaacataaaagtaatcgaagtatgctcattctttttttaacatatctttccaggcttctatatagttaaataaataatgctccttgacatttatgtatttatttatttagatggagtctatttctgtcgcccaggttggagttcagtggtgtgatctcagctcactgcaacctctgcctttcgggttcaagcaattctcctgccttagcctctcaagctgggactataggcatgcaccaccattcccggctaatttttgtatttttagtagagacggggtttcgtcatgttggccaggctggtctcgaactcctgacctcaggtgatctgcccgcctcrgcctcccaaagtgctgggattacaggtgtgagtcaccacgccaggctgctccgtgacatttaaataaaatcatattttaaagtccagttgtaagcctatacatcccccttatcacttatctctaattcacttctagacctggtttgaactttggatttagtgctttcaaagtgtgatttttttaaaaaaattatttttctgttgccgtatatttcagctcttctcggtcttgaaaagatttgtgagcctttttgacaaaaggtggtgctcattttctatttcggtggctccagtaaagggagctgctctctcatcggatgattattgcccccagaagtggtcctaccatagctttactggtcagttagccagaatttacacatttactctgaggcttacaaaaatactgtgttcataaaaagccctccttcacattttgtgaaacagttgcatggtgatttgggatattttaagtttaccatcacctctctgtcctctgcaaaaataaaaattgtggaatgtaaaacaactctgttgcacaaaaaggggaacttggtgtaggaaaaaataactagaaatgataactacgagacactgcactcccaaattgaagatttaaaaaaattcctgatcgtaaataagaaaaattatggagacatttatccactgcatatctgatgactaaacgcttggtataccccagccattgttaggtgccagggtacaaagttcctgccctcagcgggttgacacacttgtgggggagaaaggcaacaaaagcttaagcaagtaaatgcataattttacagggtgatatgtgctaaaaastaaataaagcaaggtggaggaataacaagactggcgggggtgctggctggggtggctatttgagaaatgagggccaggcatggcctttcagaggagatgatgttggagctgaatcccaagtggtcagaaggagcaaggtgggaaaatatttgagcaagatgggaaaatatttcagttcctgggtcaaaagtaacagtaagtgtaaagatcttgagatgggggctgggcactgtggctcacacctgtaatcccagctgtttgggaggccaaggtgggcagatcatgaggtcaggagttcgagaccagcttgaccaatatggtgaaaacctgtctctactaaaaatacaaaaattagctgggtgtggtggcaggcgcttgtaatcccagctactcaggaggctgaggcaggagaattgcttgaacccgggaggcggaggttgcagtgaaccgagatygtgccactgcactgcagcctaggcgacagagcgagactctgtctcaaaaaaaaaaaaaaaaagatcttgaratgagaatgaactgggtttttgtgaaaatggcaaatggcattttgggtactgcaagcctttgcggctcggaactgtgctgtgcactgtgggactgtgtggctcaatgcgggacggttagcatccctagtcactgtcattacaaaaacagtcacacattctagacacccactgcccgccccaacgccaagggggcagtactgccttcaaccaggaccccaaaagactccagtgtggcagttgttggggagggggaatgtgagaggggcagtggagagggagtcagcaagcaggttctctgagccctggtgagaagtctggattttattttaagccgcctgagtgatgtgatttcayacatgtttttaaaagatcactstggttaytccttgcasacagtgraagagtgagccaagttaggaggctattgcagtagttcaggtaagagatgatggtggcttagactgagagagaatctacttgagggtaagaagtgatctgattcagggtatatgttgaaagatttgctaattaattaaatatgggaggcaaaagaaggtggagaaatcaggatggctcctaggtttcttataaggagctaggaagaatgtaaagaaatcatatgataaggagatataaaaaggaataaaataatatttcacacttaaatttaggagacgaaatatttgcttatttgaatttgaaaattcttgtggataccaatattgatactttgtctgaaaaataattttaagatgagtctcctggccaggcggggtggctcatgcctgtaatcccagcactttgggaggctgagtcaggtggatcacctgaggtcaggagtttgagaccagcctgaccaacatggtgaaaccccatctctactaaaaatgcaaaaattagmcgggtatggtggtgcacacctgtaatcctagctactcgggaggttgaggcacaagaatcacttgaacctgggaggtagaggttgcagtgagccaagatcgtgccactgcaagccagcctgggcgacagaacaagactccatctgggaaaaaaaaaaaagatgagtctgccaaaatgtttctcatttggaagggattcatgactttgccagaaaaacaagcagcattctatagttataatgctctatgatgtaatttactggacctaagttggctacctttcatgatgcatattaagtgtggagccatatttcttagtttctgttataaagctaaactgttaagtcatttttattcctataaagtcaaacaaactagccatggatactttttaacattctgtgaaaccaactttatccagtttctgaaatggatgccagttctttttttttttttttgagatggagtcttgctctgtcccccaggctggagtgcagtggtacgatctctgatcactgcaacctccgcctcccgggttcacgccattcttctgcctcagcctcttgagtagctgggactacaggcgcctgccaccacgcctggctaattttttgtatttttagtagagacggggtttcactgtgttggccaggatggtcttgatctcctgacctggtgatccacccacctcggcctcccaaagtgctgggattacaggcctgagccactgtgcctggctggatgccagtactttttaaaccaaagttaaaataattatttataggaagcagttgtgcactgtagattaggaacatggagactggggcataaatatattcttgagctagaattaaagtaaaacatgtgactgatggaaataacagctctccctgtgccctaccatggaacttggtaagcctttgttaactcactggcactgctagatcatgctatggtccccgagggccagggaggcaagtgtgytagtccaagtaaaaagctgatatgatctttgtatgaacagaaacactgtttgtaatgtgatgataacgttggtttcttgctcctgggatattgtgttctaggtaaagtggtccagagaccaatgggtggcagatacagggatacagaggtcaacttaatataaaaaaagaccttctctaatgtctaagagcagagtgaaagtgagcaggccatctgaggagagagagacttccctgttggctcatcatgatgcttaagcagagccaaaaagctacttggtagggatgtcaaggaagtgagtcaggtgttttcagcaccgcgactctgtcattgtgtgcctctctccttaatacctcagaattagaataaagtcttgataacagtagtggcaccagtcctgtggtttgttttgcgatgactgtgtggttgttaaactttctaagtgaaacaccatagtgtcgggagcaatgccgacaagcctggccacctttggtctacagcagatattgcaagctgrtatcccgtggccacagtcaggcttggtgattgataaacattttgatttagggagctgcttttttcaagaaacagaatcacataaacaggatttcaggccagtctcaaaaaactggaagatttcacagagccttgggyccacatttctgtgtggcatcagagggctagaggtgaatgagtcctcctctcctctcctctccccctcctcccctccattcccctcccctccccttcccckctcccctcctttattttttttttttatgagacggagtctcactgtgtcacccaggctggagtgcagtggtgtggtctcagttcattgcaacctccatctcccaggttyaagccattctcctgcctcagcctcctgagtagctgggattacaggtgcatgccaccatgcctggctaattttatatttttagtagagatgggctttcaccatgttggccaggctggtcttgaacttgtgacctcaggtgatccgcctgcctcggcctcccaaagtgccgggattacaggcatgagccaccatgcgtggcttttttttttttttttttttttttttttttgagacagggtctcttgcgctgtcacctaggctggagtgcagtgagacraacacagctcactgcagcctagacctgstgggtttaagkgatccttacatctcagcctcstgagtacctgggactacaggtgkgcatcaccacacctggctaatttttaaatttattgtagagacaacacttcactatattggctggcstggtctcaaattccttgcctcaagcgatcttctgcctttacatcccaaagkgctggaattacaggcatgaaccttcacctttcttttagaaagagcgtgaatctctaattcaccagagtccccaccattccatctcatctgagttatctcactatctctgtkcttccctcatttacatcatctgtcacttacctgttgacatgtgagttttgactyttgattgagatgctgacaccctccttcccttctaggaaaggaaaataaagggggaaggaaggtggagagggacaaaggagaggcgtgtggaggatgatagygcaggacttgcattctcagttctgcctcttaaatcttggaacctatttcttcatctaacagtataggactgatgtttatttttgtattagatcatatatataggagtacctggcatataactttgtccaaagtacacattctttagctggtgctcctctgtgttcccctgtaaagactgaggcaactataatgttccactgttctgtgattattgattttcaggtctgtttcctccaccagattatgtgtgtcttactcaactttgtatcaccaagcacctacgtggcattttttcttttttgaaggtagggaccatggctttctctttctttactggacactgtatagatgtcatgcaggtctgaacgtcacactgttaaataattacttaacaactgaccagaactaaggctstggtctagagctccaaaccagaagcaaaaaggaatggtgctgggctggggcactttcctctaacatcacccaaacccagaaaangaggatcgtaagccccttcatgggccaaatgcagggctggggcccttgggctaaccctttagtgcctctggctgcatcactgtcagagtaaggtaaccagcaaggggctgcagggaacaaccagccaggtccagacatggacaaacataattggaaggaagacaggaaatggacaggtcctgtccagtgtagataaaatgacagcagctaaggcaggttgaggggcagaggagaggctgggggatcggtattgtagcaatgcaggagtcctgtcctgagtggctgctcagggtattgacatgccattttgataaatacatgaattaatgagtgagtttcgagagtagggggagagagaataactgggcatccccttctgtagatcctcagtcttctagtctyatctctctagaaggatattcacccatactcaccttgtccactttgtgccagagttgaacattcttaagaaattaagaaggtgattctttgccarccatattccagttctttatttaggagctatattatcagctttgcttatggctccagaagtggccattaatacctggagctaaaacactgttttggtttagcatgactctagttttcactgaatatttagtatttttaagttargtttttttgttgttgttgtttttgtttttgttttgtttgagacagtgtctcgctctgttgcccagactggattgcagtggtgtgatttcggctcactgcagcctacactgcctgggttcaagaaattcttgtgccccagccacctgagtagctgggattacaggcatgcgccaccacacctggttgatttttgtatttttagtagagacagggttttgccgtgtttgccaggctggtcttgaactcctggcctcaagtgatcagcctgcctcggcctttcaaagtgctgggattacaggcatgagccaccgcacctggcctaaggttaattgtttttataagcaaattattttgcttttgtgacccaaagcagtactctcagatacttagtgtagcaatttattactcagatatataactttttacaaagagaatcatagcagaaaagaacaaggtaacgtgttgtagggcatatgttctgaaggagcacttgaccttatcttctgacatcatgtaaagattttggcatttagtgtcatcatgtgcaaccattgttactttttgctactgtatcataataatacttagtcgtatcagtttgattaaatgcctcctttgtatggttcccagcagcatggctgtagaaagtattctcaaatttatcaggagacccaagttttaattcggattccctttgtaaaaaggcctccattactggaggccaaatataaaaacttttttttttttgagacagagtctccttctgtctcctaggctggagtgcagtggcgcgatctcagttcactgcaacctccgcctcccaggttcaagcgattctcctgcctcagtctcccaagtagctgggattacaggcacgcatcaccatgcctggttaatttttggtgtttttagtagggacagggttttgctatgttggccaagctggtctcggactcctgagcttaggcaatccgcctgccttggcctcccaaagtgctgagattacaggcgtgagccaccgtgcctggccaaatatataaagtttaaaaatagctcgcttgtgttcattgcctaccacatactgggtattgtgctagatatttaatatgccagatagcatatgcctcattagcctatgaagtagaggcttttattattatttccacttacatagatgagaaaattgcagcacagataaattaatttgtctagcgatggaaccaaaatctcagtcaggcagtgtgacttcaaagcttgtattgatagaagttctccaagtgctttaaatatattaactcattcagactcaccaagctgtgcatttttagtttatagagttgatatcagtattaaataggaatatgtatgtgtatgtatttatatatgtatgcagatggtccctgacttaacgatggttcatcttaatgattttttgactttataattattttttgactttataattttttgactttatataaaccatattttgggtgcccacacgtctattctgtttttcactttcagtacaccagtcaacaaattacatgagctattcaacactttactttaaataggctttgtgttaggtgatttttgcccaaatataggctaatgtaagtgttttgagcatgtttaaggtaggtgaggctaagtaagctgtatttgataggttaggcgtattaaatgtatttttgacttatgatatttttcaaactatgatgggtttactaggacataatctcatcatcagttgaggagcatctgtatatgtrtgtgtttagatagatataattagatatctatatataatagattctatgctatgggcattgtaagttctaaattgcttcagtggcattattgtacattcttayataagattgaagaattttgtgattttgattaatttatatccttcaaagtgaccaggaaggtagagtttgcatgcagaaaatttgcatgtatattaattccataaataatgtttgtagttaaattttcattttgtttaaacattttttacaagatagagtttactcagtgctgttatttagcagctgtgtgtatgacttcataatttagggggctgtctgttttgtgttctaagccacgtggctgctgtggtgactgctttaraaactttcagttccctttgctgtgaaacaggtttcagtgcatcgtccctgtgtataaggtcaggtttcttacatggactcactctgtttctgtaaatttgtctgagaattttcaaggcagtgctttcatggcctctcctctaattttgtgtgtgtgtgtttgtgtgtgtctgtgtgtgatgatgaaaaagtcaaaagccctaaaattaaatcagagtttaatccatgtccctaaactagataagctgctttagaccttttccttatcccttacacgtcgctcagtaaatacttgctgattgactttcaaattcagattacttttacgmtagcatacggtgggcacaaagggtttttttgtttatttgtktgtttgagacggagtctcgctctgtygccaggctggagcgcagtggtgcaatctcggctcactgcaacctcctcttcctgggttcgagcgattcctcgtgccttagcctcccaagtagctgggactacagacaagcgccaccacgcccagctgatttttgtatttttagtaaaracggggtttcaccatgttggccaggatgctcaaacccctgacctcgcgatccgcccgcctcggcctcccaaagcgmtgagattacmggcgtgagccaccgckcctggcctgggcacagagttaaaaaaaaaatactggtaacagaaaacttgttggcgtgtttcagttttcagagtcttctataaggtcttataccagccgagaagcagcagaaccatctgtccgtgtaccgaggacggatctcarcagctctctgttcagtggctcctgcctttgtagtggattcccttgctgtgctgtaattaagtcagccggcaggagttcctgttttgagggggcctctcccggctggagaagtaccactgcctttgtgttacctgccatgttattgtggagtggataatttttttttcctgcatgggtcttggtttaacagcaggatcctctgggcttcttccaagaagcaccacatttccctgaaaataaatggcagatgaattatttcttgagattatgaaaatctgttagatgaaagcttgcctttttstcatgttcaaaacaatgctaaatgcttataattatactcccaatgaattacttctttcactggcttcctttgctctggcaaaggtggattttttttccatggcagagaaattttataaaaaatgtaatattttagaaawtgcctaaatgtcaagaatacaacatcttgtttgttgttgttgttgttgttttgtttgttttttgatacggagtctcgctctgtcgcccaggctggagtgcagtggcgcaatctcagctcaatgcaaccccgcctcccgggttcaagcaattcgctgcctcagcctcccgagtagcctccattgaaggaagtgccatagtgtgggaggatctttttattttctacgcgcaccgtatttgattctgtgtttacaggaactgtgtctgtagacaaaaagcaaaatgttgggktttagtttcttcaggtgaataaaatgttacttgcatctcctcattgtcacagtgttcgtattacatacttcgtgtgtgtagttttggcatttaaggaaacagagctaaaaaaaaaacaaaggacaataactgcatcaacaacatgttatacaccagaggaaatgcggcgacttaggttctgtgatgggaaacccggatttttttgttgtacttgaaatcttccgtagaacgtacgtgtttgcatgacccagaaaggaaaacacattggaggactttgtactagttccattctaattctgtaaaattctcacaaattcaggcatctgttaacccttcgagggcatataagttcagagccatgttttctgttttgtgtctttccctttggcggagtggttaccttttctgagcccttggcttgctttctgtgaacataaggcgctccatctgccgctttaaagtgaagatttataattcaaacaagacagcgtttcgatgttgcactcctgtcttattagatatcaacttaaagttaagaaaatggaattattcaaggccttgttatctagtttatagcttattcagaatttatatttctgatttttttttgtcctgatgactgcctgtgactaatttgtgtttttgttattaagctaagattgtatgaaaaatatggcaaaaacaaaattctatatttctaatgccccatgagaaatctgatttagaggcccttcctttggacacactttttgttttgttttgtttttgagcggagtcttgctctgtcgcccaggctggagtgcagtggtgcaatctcggctcactgcaccctccacctcctgggttcaagcgattctcctgcctcagcctcccgagtagctcggagtacaggcgcccgccactacgcccagctaatttttctatttttagtagaggtggggtttcaccatgttggccaggctggtctcaaacccctaacctyaaatgatccatccgcctcagcctcccaaagtgctgggattacaggcgtgagccaccgcgcctggcctggacacccattttgaatagcacttaccacagattcccgaagccagtggttttctagcctttttattcgccgttcgttgtaagcttcttgagtcttggtgattcttgtttcatttgtttttgtttctccccagagcctagcacatagtaggtgacgaacaaatgttcatcgaatgtatgggctcaaccatagtctatttttttcaaaaaggtataaatcttatcaatgttttacattttgctgaacaaaacaggagagagcggattcttttcaaataggaaaaattagggagggaaaagagggattgwctgaaactctattgaagtatgtcaacataaaagtttattgacagcctggcgtgatggctcaggcctgtaatcccagcactttaggaggccaaggtgggcgggtcactagaggtcaggagttcgagaccagcctggccaacatggtgaaaccccgtctctattaaaaatacaaaaattagccrggtgtggtggcaggcgcctgtactctgagctactggggaggctgagacaggagaatcgcttgaacctgggaggcagaggttgcagtgagctgagatcgtgtcaccacacttccagcctgggcaaaagagtgagactctgtctaaaaaaaaaaaaaaaaaaaaaaaaamaacaaaaccacccctatctatcctatctatcctatctatctatctatctatctatctatctatctattggtctatctatctagataaaaatagcagtcaactaatttttcaaattaaaaatgctttattgttatttatagcatgattgtttttctataaaaaaggcatattacaacagccttcgcttcacatmtgactcttgcagcattcttataaagagatctcacaccatatttgagggcttcattagttttctaagccttaaaaawatttcatcattaagattattctctcatgaagcacccaaaatatagacagcttttcttattttcttttcttcaattgttgacagtctaatgctgccagatctttatytgtcagggacttttgatgttgttggagccatctcttgtggactttatgaaaycttgcatgcagcacaatttgaaacttcattgtgcattcaatttgcattgcctttgctgtgttcacagtggcactccatgaggcttaactatggagatcctggtgctacaagccgttaaatagttctctcttcycaacctattcccctatcctgcttttcttttcttcatagcacttattacctyctgattatattttttgtttgccttttgtctatcacctgtcattcttttaccagaccatctagtctyatatgtctatataacctttctgaaaaacatcctgtgggaaatataccatatatacagaaaaagtgcacaaacatgaatatacagtttaacaaataatataaacctgytattcatgtagccaccacccagatgaaggaaatagaatatcataagcaccgcasaatctccatttgtgcccttctccatcgtagctttctctgtcccagacaaccattgtccacaacttgttgtaataatttacttaattttcttttatagttttatcacacataatttagtttttgtctgctttttgaactttacatgaatggaataatattgcatatattatttaatgctttttctttcatttaacatttttktktgtgtgtgtgtgagattctccaggttgttgtacacagtgctagttatttcattttgttatggtatagtatcccattgtatgattgtaccacagtttatccattttttagttgatgggttttgacttgctttcattgtttgggctattatgaatagtgctgctctgyacctgttgtacatatagcctggtgaacatgtttgcgaatttctatgagcgtgatcacrgtggtgtagaattgccaatcttcaacctgcctgtattttccaaagcgatcataccaatttatttaccttccagcagtktatgagaattctstattctcaccatcattggatattgtcagattttaacatttggctcaactgatgggtgtataatggtatcctatggtacttataatttgcattatccctagttactaataagcttgagcaatttttcatatttttatttcgatttcctaatttatgaaatgcctgtttaagtcttcagccatttcaaatgttacctgtcttttcaaaatgatctataggagttctttgtataatatatattctggcccctagtcctttattctttgtatgtgttgcaaatatcttcatctctgcagtttactctttttgtggtgtcctttgataaaattctcaatttggtgaatgtaattgaatttattaatttttctctttgttatgtatttttgtgtctttaagaaatttttccctatgtagggaagaaggacaaaaattgtctttcataattagttctttaacccttcataactttgagtatataaattattgtgaccatctttgaatctacagtagttgaattgcatatatagaggcttgagttcttaaattattctttccagggtgaatattagcatatcacaataggacagtagggacagtggctttttcgctaatgaaatctaagatttttccttttctgctcatgaaaaatgtttctgcttaaattgtaatgagtgtacaagaggcataaatccacagtgggtacaaatgtcaaagattatggtttaaaccagcaaaatatgtcttcttagatatacgaaacattttgtcaaatagcccctggcatcatctgggctaaatgaagaatcaccaggacrtgtgatacagtgaaactattccacttatagtaacagcacttagtaattgctttcattaatccaggcaggttaatattctatctacttgcataacaatgtcaaaaaatctattatctactgaaaccttttatatagcaagttaagctcctatttctttcataaagattgagattcaaatattaatccaaactactcagaatcactttctcttcctcacttttctgatacccccactggagagtgactgatcagtgcattatctgtcacctcagagctcagagtgcccctcttttctattcaaatacaaagccattcatttmctttgatggacaaatagccgtggcattagtatgggtaggggcaagtgctgttgtctcttatctaggaaggagttggttcttttctgatggttgaataatatacttaggtatagaaagagacctgagtgtcttgaaagcaacattctttcatttttgtcaatgttttaatcagcacccctgtgcatatattatctttgcatatttcagcactttgtattagacttctacatgttgtggtctttgcttctgataagggacagaataaataggaagaaagaataaaaaagccataatgttaagtacatccattccatgcccatagccatacatcacagaagtcacagggaaggctctgtgacacragataatkatgtggatgtgacagaacatggtagaggaaaaggccacagacaggtgcagagtaggaagaatgaaagaattcattgtggctgtcaaaatcctatgtttgtgttcccaaatcctatttcttttttcttttgacttgtgatgtattgactgtcaattagttatcaggtactatgttcagcccagttattgcacaagagatcctgaaaatctttaagtagctcctggacttggaagagggaaggaaggaggagacactaaaataattacaatatgttactattatacatgacaatatgcagaatgcatttggaacatagccaataactttacacagagatagcagtttttgagctgaattttagaggaccaagttgatagaatttgatgatcagatgaggggttagggagaggaagtctttcagtttattttaaggctggagtgaatattatttttgtaaatgcaggattttaaggaaaaggacaaaatgccagaagacagcagatttctattttctgtatatttgtacatcatgacaatacatttatagatacactaattcttgtacataaataattcatataatgtttgtctttatcagtctgaattgtcagctttggtcatagggaattggaaccaagtgtttactgagcatctactatatgtgaggcactatattaggtgctgggcatgcagtgatgagcaaaacagggatgggtccagctcttatagaacttagagttgagtgggaaaaacagaattaatcaaatttccatatttataattagaaatgacatatacatatgaacaaaggctctctcagaacccaattattcttccctttcactcttcttcctaatcatactaccagcgttaagttgacagttatttatcaggcatatttagcagccagccttacagttttctcttgcacactgttaacaattactgtcrcatggtcactgttacatgttagccaatagtgcctcacattcactgtggcttccaaagcttgggcttggggaagcaggtggatggygatatcatgagctcagatagagatcatgggagaagagatttgagatgttttaaaaaagtgttttgagcagatgaagttaaagagttaaagggaactatggtcaagtggaggtgctggtaggcaggtggaaatatacttctgaatctcaggatgactaatgaaaagcaagaaaatgaacaacaagggactattaatgtgtgttatgctgtgcttatgcattttgtctggtttcaaatcattgtatttaagtagttcttaaagtcacaggagtgaatgagattaagtagaggaagaaggaaaagaggtacagatggagacctagggagtgccaggcctcagagcagacagaggaagggcacgcagtgacagagcccacgaagtgtggccagagagcagtgatgaggaggattacmgagtggctcatggaaaccagcgtggaagctttcttatttcttcttctccttctgcttctctttctcccttcctcctttcctccctccctccctccctccctcccttccttccttccttctcctcctccttctccttcctcttcttcttcctcctcctcctcttcttcttctttctcttcttcttccttcttcctccttcctcctccttcttcttcctttttcttttttgagacagtcttgctctgtcacccaggctggaatgtagtggtatgatcatagctcactgyagcctcgacctccccaggcttaggtgatcctctcaccttagcctcccgaggagctaagaccataggtgtgagccaccatgcccagctaatgttttaatttttgtagacatgggacctccctatgttgcccaggctaatcttgaactcaagtgatcctcctgcctcagcttcccaaagtgctgggattacatatatgagccactgtgcccggctgtgggaagctttcaagaacaagagagaccaatgttgccagacaggccaagtaatattaggactggaaagcagctagattgagagactcacaggaacaagaacagagaattctgaattctaaaatccacaacgctcatttcactgaaaggtcgttcaggtggcggtggtggatttttttcccttagcygtcattttggatatttgattaattatcgaccattatatttccttcttcttgttagttacgatttactaagaagaatttttatgctattttaaagttaaatgatctgtgattgtaaaatcattcattatttacctcaactgctcacttaattttttaaaaacatcttcaaggctccttcagagtttttatgttgataattttaaaaaatctttttcaagttttctagaaacatgaataagtacacaataatttagttaatgtgggcagtaaatacacagttgtgatagtgaaatgtcttctatgaactagaaaataagaaaatagacacttaaagttcagagtagagaaggaaactcaaagagacakaatggttccagggcagsctaactgtacagtacccttaagaaaagtattcgtatctatatctctactgcagtaggccaagtgctgtggcacaygcctaaaattgtagcactttgggaggctgaagtgggaggactgcttgagcctaggtgtttgaggccagccctagcaatatagggagaccccccatctctacaaaaaataagaaaaattagtcaaatgtggtggtgcacacctgtggtcccagctgcttgggaggctgaggtgggaggatcacttgagtctgggaggttgaggctacagtgagccgtgatgacaccatcacactctagcctgggtgacagagcgagactccgtctccaaaaaaaaaaaaaaaaaaaaaaaagaatctgagaagcagatactggccatattcactgaggtgctaagcaggggtgggcaccctgcctggctctgtagtggtcatttctgacaggcctgtgttgtggagacagacacactaggttttcagagtctgatgcagttacattcgaattaggcaaatctcatactgattctgattccatgttccccgcaacaggcacccggtaaactggctttctggagagtctgcctttgagcagagaatgtgattttcccactgtccttctctgacctctcggcagttatacaattcttattgtaaaataaagctctattctggttttgtgcatcagtctcctgtgggtttaattcacatgcaagagcgtcctcgagcctgaatgagcctggaatggaatacagtttcccagcccatgaatcatgacctgaatcatgtcaaattcaccaagttatgctcccttttaaggtcacttggcagacaggcaggtaggaactttcctggtgaaccctccctgtatgaccatgcagctttccactgggarcttttacaggttgctgctatttttataaaaatgatagactgtaatgttgccgggsacagtggctcatgcctgtwatcccagcagtttaggaggctgaggtgggagaaacacttgaggtcaggagtttcagaccagcctaggcaacatggtgaaaccctgtctctactaaaaatacaaaaattagctggacatggtggtgcacacctgtattcccagctcctcaggaggataaggcacgagaatcacttgaacccgggaggtagaggttacagtgagccgagatcacgtcactgtactccaccctgggtgacgaagtgaggctctgtctccaaaaaaaaaaaaaagagttctgtaattgtaaaaatgtgacataggcattctctaatgtgcaatgaatagtcatttttaagcatttcatacaktgttcstgtactgcactggrtctccttgtgctgaactgcatgggataggccatttccatacaatctcatcctctgaataaggaaccatgatgctcmtaaagacatactaaatatagatcytgggtaatattggagtcagtgctggtcatcaatgattttctctgtgatgatagagggggtccactatgaatgatagcattaattttgctgtatgttcttgcatcattggtacataataattcatagacttcataagttattaatatacaagttacagaatttaataatgtaacccacctttgatatgttttcatayacattatggggaaaccatatttttttgaagtcaagaaatgtatattgcttcatgttgcaaaatktgtatgmtwtgtcaaagaagcattgccagaaaatgatctgaaatgtagmacaataaagttacattatagatgtcttaggtgaaccaagagaaaaattagtgtcagagttaaaaagatgcaagtcaggaattaaggcaaaacattgaccctatctgacttaggagaattctggtcatgtgatcttaagaagagagagtaactgacagttctggagactgggaagtccaaatcaaggcatcagcagattcagtgtctggtgggagcttgctgtctgcttcacagatggtgccttcttatggcatcctcacatggtgaaagggaacaaacagsctccctcaagccttttttgtaagggcactaatcccattcatgaaggcagagcacctacttgtaatactatcgtattcgttcgttctcatgctgctaataaagacatacccacgactgggtaatttatttaatggacttgcagttccaggtggctgcggaggcctcacagtcatggcagaaggtgaaggaagaccaaaggyacrtcttacatggcagcaggcaagagggtgtgtgcaggagaactcccctttataaaaccatcagatctcatgagacttactcactatcatgagaatggcatgggaaagacctgtccccatgattcaattaccttycacygggtccctcctacaacacatgggaattatgggagctacaattcaagatgagatttgggtggggacacagccaaactgtatcaactatcatacctcttaatactatcacattggattttaggttccaacatacaaattttgggrggacatgaacatctggacagtagcaatgctagtccattattytggtctgtctgaaggttttatctaggcagggaaaagcgtatgttttttccttgaccttgaaaatttagcttgggctttctttgtacaaacatgaagatcctaggagaagcccaatcaatttkakagagacaagtggatgaaratagggattaaaagaattgtgcttgactgagcagaragactgatgatctgaaaggacaccaggtaaaatgtttctttttagctttacaaatgcactgcttgttaacatctatgaattcatgtactygcttttccatgctatagacgggtaacttccagggctgytgtgtggcacaagtttggggagtagggatggaaatggtacccttaaagttatgcagtgcagacctgcacaacctgacacaggggccttgggtcagtccatgtcggtgagtgtatgatactctgatatcttaaaaaaaaataacataagaatctgtaggctcttgttcaaagatattgcagagacaagaaccccttccacaggtaaagaaggcacgtgagactcatggcaaattcattgactcttctgtccgagcattttcttgtcattttcattatagcccttccttgtaatcttaacatcaatggtaccctgcttcttagcaattttgataaatctttgtatttcagcaaatacttgaaaaaaatgtaggatccactggcttatatcttctgtgtaggcatcaaaacasatggtggtggggttgttgggaagatggtagcagacagrgttgcttaaaaatrtaagacttccttgatgtccaagaatactgagatttatatgattagaaatttctatacaaagctggaaacagtggagcatgttcccayatagaagcacaggttcccagctcccccagaggccctcatacagagctgcagctgcctgtgatggagcctgcacagattcttccagtagacagtcactttccttctttcttggcagtcttgtgccctgacagcccttctgatggctctggagcctctggctgcctgccttcctactcaccaggtgcaacttgttaattacttgcatgcaatatgatcaytggattatggtacagctttggctaaatcacttacatttttcattcttattaatttggagacatgcacgtgccaacccaagtacrataaatggcacactgtttattgcaagcactaaatagatacatcgaaggttatgttctcaggcatccctagcttataagtgtacattatgttgatttgatattgggtgatgaccaaacacagttggtcaaatcctccctctgggagttggagagacatagaaggaaaggaacagaaatgccagtggtgataayagggacagcagaaggaagaggagcagggactgaaagccactgagtcagagtacactgaggcatatgagcaatacctgagtggaatctgtggttgcagggcatccctacctctgcctgcacatctgcttctttcttccctacccccagtttccctttttctccttccctgtggccatagtggaagatggaggcttcacagttcctgagactagatgtcttcagttcaagcagtcagcagagacttgtttttttgttgttgktgttttttgtttttgttttttgagacagagtctcgctgtgtctcccaggctggagtgtagtggcgcgttctcagctcactgcaacctctgcctcccgggttcacgtgattctcctgcctcagactcctgagtagctgggactacaggcacacgctaccatgcctggccaatttttgtatttttagtagagatggggtttcgccatgttgcccaggctggtcttgaactcctgacctcaggtgatccacctgccttggcctcccaaagtgctgggattacaggcagagactagttttttttaactttttttttttttttaacagtcttgctctgtcacataggctggtgtgccatggcatgatcatagctcactttaaccttgaactcctgggctcaagtgatcctcccgtcttagcctcccaagtacctagggctacaggtgcatgccaccatgctcagctaattttcttgccatgatgctgaggcyagtcttgaactcctggcctcaagtgatcctcctgcctcagcttcccaaagtgttgggattacaggcgtgagccaatgcacctggctgagrctggtattttcaaatttcaattctagctgtcagggagagagaaattgattggcccaccagggaccaggtgtttgcttctggtccattcttctataaccagggagacatttatatatataaacttggctgctgaggcccaaccctcaaaacatagagatttgagcaacattagaataaattcttttatttatggaattatttctataggcatatgtcataaccttttattttctttttaagaaatcaagtctacttaatatgataataatatagtcaaagaagtacacagccacgtatggctggatttgatttcttatccaatasctggatctgagaaaaggttgttcagttacattccagaagcttcagtagcaaaactgctcttttttcccccaacttttactttatattcagagggtacatgtgcaggttttttactgaggtatatcgtgtcatgctgaggttttgggtatgaatggtcccatcacccagacactgagcatagtatacagtagtttttcaacccttgctctcctctctccctctcacctctaggcatccctagtgcctagtattgccatctttatgtccataagtacctgatgtgtagctctcatttgtaagtgagaacatacggtatttgtywttcttttcctgcatttctttgcttagaataatggcctccagctgcatctatgttgctgcaaaggacatgattttgattttttatggctgcatagaattccatggtgtttatataccacattttctttatccaagccactgttgatgggaacctaaattgattctgtgtctttgctattgtgaatagtgctgcgataaacatgtgagtgcccttgtctttttggtattaatagagtggtttgttttcttacggatatatacctgaaactattcttgttaagtgagtcaacaaggcccacctggcagaagaggaaacccaagaacattaaatcagttaagatggaggccaaggcgggtggatcactggagctcacgaattcaagaccagcttgggcaacatggcgaaagttcatctctacaaaaaatacaaaactagccaggcatgatggcgtgcacctgtagtcacagctactcaggaggctgaggtgggaggctggcttgggtctgggaggcagaggttgcagtgagccaagattgtgcctctgcactccagcctgggtgatagagccagactttgtatatatatgtgtgtgtacatatatatatatrtrtgtgtgtgtgtgtatatatgtaatacatatatattacatayctaatatatataatatatatgtaataaacatcatgtatatatgatgtttattagccctccaatgcttgaaatcaggggttggaatcaaggctaaccaactctggtctggtcaccatcactgaatgcttgcggtagccatgtgaacattgtttattgtcgtatactcctgggagagtcccagggatgagcttttataaagttgcagacgggaaagggactctcactttggagagaattaagcatgtcacccagttgcctaacaagttattgctgtgcaggcaaaaaacagacaaaagactcacccaactctaagatttttttgatggacttctctaagttcattatgataaagttaatattatgatttttccagttctcaatattttgggtctaaccctttttttattactttatgtatatgttctgggctccgtagactctctggagtgacaagaaaatcttgaaaaataaaaggcgaggtctattggagagctgttcgtggatgattctgatacgtgctcttggttaagaatcactgctctggttttcttcccagtgcctcttacccaccactgttagatcagttctttaaacaccacttmaactcccacttttgtcagcaacctcctcttgacagtcaagctccttagtctggcatgtagcactcaccattacttggtgtgagtcctgaattctgagcagccagtgtctccttatctgtcacattcgtactcatttttatgactttgcaggtcttgctgaaaattcttccttaacttgccttgagaacyaccttttccaccaagcattcccaatgaatgtagctcgtggtgttctttccttccaaattcctgttctcttatctctactgcttataacccaatacttgactatatattgtcttgtataaatgaagtcttttctatcaaagtagatgttcattttcttaggaggaggaatgtctttggtatcctgtacaaaatctagcatagcctggtactcaaagtcaccttaatcatacactaaatggtatctttattgatgggttgtcgataaacctcctgctttatcctgtatccaattaaaatgatccctcgtcagtttttcctctgattcaaacattttaccccacattgtttctgcaattagacagaaaartaagcatctgtgaagtcaacctttttgctttttttactctgaagtgctgctttttttttcagtaagttgtggttttaaaaaaatccagttatttgaatgacatttattatttttgcagttaataaatgtattttaagtttttaaatccacagtgtagataaggccctagaagcaagtgtagacttcgtccacagctgtactccatcggccactgacagtcttattgcattatttcaacggcacaagcaatcatttacacttgttattacccaggggcatttcaaactgttactgaaatgcatccatccctggagtaaccatctgtgaatggtaatgccataaggtagagagactaaatctaattgatatgcaaaaaggagaatttcagctgtccagctatggagattcaaattsaacctttaataggctgaggatttcagctaaatttttaaaatcatgatatctagttcaggcactcatcttttaggtttctcacagattaaagtacagccgtcttccttgaagtaagaacatctcaaagtcaaaaatacttgtttattgtaaaacaaaatgctacagagaaaggaaagttcttgtaaaatacaaagagatcgcttttgttgctatataatagcaaagcagctgcacctttccttggtttttacacttgtttgtgcctcaaattgcctgaaagaaaaaaagggaaaataagaaaatgctttcagatttcagttgcattaaaacataaaaaaaattgggagcaacatttgttaagatattaagatatagtcatttacattaagtggttttataaaagtgatttataatcttttaaagttatctccccctttcttatgacacgtaaccctaaaagagccatttaaattagctgtcaggcaagatgtaccaggcctttccagtgatcccagcccacctggacatatctagcaattctgcagaccagcacatacttctggaaagatgttgcatggtgatttatagatctgtgtggacacataamacctttacaatggagtgaggtcttgaaatagccctgctgttgctgcccattgagagataagtattctcctgaggtattccccaacagctggaaatgaagtagcagctcttgtcagtctgtgacaggagtggattatcagacatttgtaaagagacaacagcagaatcaggcctttttgcaataaaattgcacacatagatattattgctcctccagcgtttcatatgcagtgtcaaggcacgctacagttcaggcagcaggcaagcagctctgtttgaatggtgggacaaacatacctctgtgtgtgaggtgcctgcacttgccctgctttgtcagggaggacacaatgccactttctctgctcctcagcatagctcaattccagctcccgggatgaattaataaagagatatagccgagggcagtcttagttggggctcaggttaccagctgtcacattactgaaatctcaggatatgcttacagtaattgaaggaaagcacattagggttatattgactcagaatgaggcactctctgggagatcaccgtgaacagcattttgggagcaacctagatcatttcccctaaaattctgacatttgctttttggtcttctgggctccaggtacttattactctttcctgaagagctgttaactggctgtcaagtttacattttgaaatagtgccatgatggcatccctatgcttggtattatttaccccacggaggagatgtgtgtattgcagaacactcatgtttagatcagccaagagaactgcttggaacaatcctagaagcaggcaaagctgcattttatgttcttcatatattatttgaaaattactagtggtcaagaaacattccaactgtttgaattctcctctccaaacaggaaaattctgtaaaattgtttttcatatatatatgtataacacacatacattttataacacatacatacacatataagcatatactaaatgagttagtaaatatacaacactttgaactgttgcctgggatataattactggcataattacatgtgctcgttattatttttctaaatcaaaggtctggttttcataggcttaaaaaataataaaattggatgttaatggtacaagttttgaaaatatttgatattgattcaggagatgaaactgtctagaaattactcttgtctattataattaagtccagagtcttattttcagagataagtacttgatccctacttttgtgtgtcaatttgaatttaattttttaatgcatgtcttttaatactrccctttattatagatgcagacgttaatgaagaatccagtcccatttgtacaaatgccaaggagtttaccctctattgaagggatgaaatgttggtagagcaaatgcaggtgtattattatgattacttttggatactttgtattaacaaattttcagacacattcctaaagattctggggggctggagcaagcaggcaaacagaggtccacatactctatgtgtaaatactaaaagtgatcaatcaagggtgctctccaccctttctgcttcttctggaagctaccaagattcctgggtgcccaaggatacctgttgggtggttgcaggggccacctaaccccaaatttccttgccaccattcccttcatcctctcagcatgacagctggtttcctacttttcctcttcttcccccttttttctgtctttggccaaagcttagtgaattttaccttagagattttacttttaacctattcccatattttaaatgtttccacgtattcactgcagtgtgctgatggttggaggtggtaatacagtttcttggttaaggtgtggtctttggaatttgactgcctgtttaggtcctggctccccactattagctktgagaccctgggcaaattacttaacttttctgtggctcaggttccagatgtaaaatgaaatttttaaaaaagcaacacctttaagttttcttaagaattaaatgaggctgggctcagtggctcacacctgtaatcccagcactttgggaggcttacacaggacgataatttgagcctaggggttttttttttcttttttttttttttttgagatggagtttcactcttgttgcccaggctggagtgcagtggtgcaatctcagctcgctgcaacctccgcctcccgggttcaagcgattctcctgcctcagcctcctgagtagctgggattacaggcgcccacccccatgcccggctgatttttgtactttttaagtagagacagggttttgccatgttggccaggctggtcttgaacttctgacctccagtgatctgcccaccttggcctcccaaagtgctgggattacaggcgtgagccaccgtgcctggcccaagcccaggaattgagatcagcctgggcgacacggtgagaccctgcctgtataaaaaagaaaaatttaaaaatttaaaataaaaaaaaattaagtgagttaatatgtggaaagaatacctctggtatataggaaacactcaacaaatattagctattctttttcttggaactctgaaggtggcagacttgctccctcttcctgtgtggagagaagcccatgtactttatttgtggacagtcatctgtgattctcatgaatggctttgcttccttctcatgtggctttcacacttatgcagagctttgttagaacctctgctgcatcctgcagtgtgaaatttacattcccacctctccatctccattggtttgtgagcccttcaaaggcaaaaattgtgttctttggttttgttttcctagggccttgcacagcacttgccactcttgattaagcatgcttaagaaatgcttgttgagtgagtgcgtgaaaggggggccaataacttgtatggttatttgtacgccatcaaacttttttttttgagatggagtctcgctctgtcgcccaggctggaatgcagtggcacaatctcagcgcactgcaacctccgcttcccgggttcaggcaatactcttgcctcagcctcccgagtagctggaattacagtcgcgcaccaccatgcccagctaatttttgtatttttaatagagacggggtttcatcacgttggctaggctggtctcgaacttctgacctcatgtgatccacccaccttggcctcccaaagtgctgatttacaggcgtgagccaccgcacctggctcatcaaacgtttgatttatcggtttcctagcatataaactagctgcgaagatgtgtatttttttgagaagccatgtggagagagtaggggacacagaatctgctcttcaggcatgctgacagcaaaaagtgactactagtaggccatgagggatggaagagagaaatactataaaaagcatagttgtctggggctatttaaggaagacacaataacacactgcacatcccaggacccctttcaggcatcactataatagcatggtgtaagaactgtgtcctctcagtcctgttcagcttcagccactactatcctttgtctattaatacagcaccaaccacttggtcccaaaggaacgttctggcgagaaatgtgcagagwgaatcagttcgccagcaggtgcgattctggaattgtttggctgccagagacccggtatttggtgtgtccgtcattactgggtgtttgtgtccccaagccagagtcatcatgttgaccatcctcctgaactggggctctggttggattcccacctgtttacctggtgccttaacgttcttctccacttatcttgccatacccttcctggagaggaaagaagacaattaatttctacctgtagtttgggttctccttcaagagaaattacaaaactgcctgccttggacccagagctttccttctttaggatggtttgggcctgacagcctgaggtttgaatctggtctccaccatttcctagttcatattcactctcagcaaatatttaactctctaagcctcaaatttctcacccacaaaatagggataataatatcctgttgttgtgcccttagatgacgcatatggcatctaacacatacttagcatgtggtttagtctggcacatacttagtattcagcaaatggtagctgctacccctcccacggccatgtcccagctactggaatagctcactctggatattgttcacttctggaaccaagcccacctttgccaggcagcctcggctaatcccttagagatgtccccacagcaagggaatctctgctagcatgccttccatggcctgttttgacaagatgtttataattctccaggttgttaagaaaaggttttatctttaaaatgtaaagccatcgttagctaagctagcttaaaaattctattgtatactttagaaatatttccacaaatatggctaaaataaatgtaaccactcttggagaggcaatgttcatttatcttgaaatggaagtgcctcacttttttttttttaatggagcctcaatacagtctgaaaaccaggtggaaagtgtttttcagtatcaagtgtggtaaataagagctaactgattcaaattacttttattccttatcatctgatatgaaaatctgaatcatcttgaaatacagtggtgccccttaaaattgcttttctgtcttatattcattcattcatgcagcaatttagggtttattatatacaaggtagtaaggtgggtagatattcctgtttgtgactgttgaaacattttttattaagtttcaggtatcatacacacatacacagatacacacatgtgttttgttttttcccctcttattaaaacttaacacatgaaggtagataatatttcaattgtacttaagcactatctaaatttgctttatgtgcagcaagactatgatataaccttgtaaatatctaacttcattaaaaacacacatttatacagaataggttaactctgtggctctctgagcaatatcttaacctttagtctggaagccttaatgacacactaatatctaatattgcctataacttcttcagatccggaaagaaaagtgatataaatgtcattatgtcttgagactcacctaaatgcaatctttaacatgacttactgagcccccaacatggtaaaagatcttagcctgaaaacactccttgtcaaatcattgcccatcatagtgctgagtagtaatctctccaggctgaaagatggcatgccgtataacaaatgaaagggagctgacactagaaagaacattagtgaaatcaatatgattcaaccagagacacagactccgttaatggtatgtcaatatgaccaattatttccacagcactgacatcatgattgtatttttttcttcatctttaggagagaacagttttacttaaccgtaattgttgaattatagccattggccgagaaagtcttggatgttttacattgttatcgttaccagtttcaatttgtctttatttgatatctaaactcctgatcataacttaccatagtttgaaggttaagatcaataaagtggaccaaacattcagtgaattgtgaattctagaaatgcctgatggtatccactgcccagggaataagatgtaatggaagcaggcagaacttgaagagcaatcagagattgtaaatataatcagaattgaattcatatagttattttgttaatttctgcttcctcaactagactgtaagcttcttaagtgcagggaagtatatattttacttgtcattgtatttgtcattctatgccatgtctatcacctggcatagaaggcactggatgaatattttttgaataattttctaacttttcatgaatttttgttcaattttctcatattgggaagctgccagttttagagttataccaacactgccataataaaaaaaagctgtcaagatcaggaaactgcagatactttygcaggttccagaaccagcaaaggaatgccccttaccatacccgtcagcacccatgaagtaagggaatggacactgcaacttctggtagcaccatcacagagaagggaagtgccttcgtgagcaggcttgatggcagcaacagccatccctcggtctcacatccccctttgtaatcccacaggcatgtgtctgattggtggattctaaaccaccctcagaaatgtagctgcaaaggagtatgaaatgtgcaggttttaatattccagcctctgctggaaagaaggcttacagaaagaagttggaatggatgttgagtgccaatctactgtatctattctacttccttaaagcttacattccattaacagtctttggaagaatgtaatataggcgaagatttttcagtgccaaaaaataactgacatggataaatgacatgaggcagtgattaagtatgggctccagagtgatgctgtctgaagtcaaatcctcttccacctctatgggaatccatttccatatctataaaatgggtatcatctttcttcaaaatatggctttgaggrataaataagaaaaacagtacgatatgcctagcagagtgcctggctaatggtaattcatcaatagaggttagctattatacttccaatccttattcttcaaatttttgttttcctggcaggaaacggagattctttaattaaaaattaaaatttgaggttgggtatggtggctcatgcctgtaaacccagcattttggcagacsgaggcaggaggatcgcttgaattcaggagtttgagaccagcctgggcaacatagcaagaccttgctctgctaaaaacaaacaaaaraattagccaggcgtagtgatatgtgcctgtggtcccagctactcaggaggctgaggcaggaggattgcttgagtttgggaggtggaggctgcagtgagctatgattgtgccattgcactccagactgggagacaaagtgagactctgtcttaaaaaaataaaaaataaaaaatttgatattttataattttaaattatggttttaacatatttagttgaaaaggactcttccaaagcctcatgaatatctcttacacatgttaaatgataacgcaggggtcttgagttctgaggattgttccagtatttctacttgctttttattagctccacacctaagcaaccccaaattgagaacgattttcattataatagattttcatataacattttattatttaattcttcctgccttcttttcattaatttatgcagcatttgagggtttattatgtactagggtactgaggtggataggtacttctgttttatttgaatgatataaattcttatttctttaataatatttttattataagactaatacatgtttattgtggagaatttgacaataaacaagtgtatagagaataacattaaatcacctataatcccactctacagggctgttggtagcaaagtgatattttcctctagtgtttttcttgcatatccttactttttaggaagacattatgtattcagtttggtatcctgcttgttcactcaagactgtattatgagcatgtttctgtgccattaaatattcttggaaaacattttaatggcttgatagtcttttattatatgaaatataaaaatataaaaattgctgtttcccgttttccagtattgtagtcatgtctttggaacatagattctggtgctcaccaaatattccatgtggccctttctatttcctgccttcctgttttgttgagttagaatcatgagactgatatgagtcagtggcccatgaacagaatccactagtaccactcacaggccaatggtcagaacccaagacccctgcgttatcatttcacatgtgtaagagatgttcatgaagctttggactagtctttttcaactaaatatgctaaagccaaaattaaaaactatcaaatttcaaaattttttttttattttctgttttttaagacagagtctcactttgtcttccaggctggagtgcagcagcacaatcatagctcactgcagcctccatctcccgtgtgtttcctttcttcccttcttctcttagtgaaacgaacttagaagtggcatatggcgaatgtcacagctataagttggaggaggaactaccagtctactttcaactttacctagactgatgttgagtcaaatcattgagacttacagatttgtctattatagcagcttgtgttaattatcctgataatgtatagaatgtatcttgtttaccaatggtattgatttattgttatattttttaaggaatctttgcagttttaatggccatgctattatgccccaattctcattagcgcacttaaaaatcagttctttccaccctgtaaactgaaaataaatcagaatatatggttcaaaagtgaaagactaaagaaagtttactaccacgcaatcctatctttgtctctttctcttttttattggcgtcaaactactcagtattttagactgcaaaatttccactgcrtggaggaaagtaaatggattgggattatttcctgcaggtaaatgaaactttatggtatttgttatggaggcaagtagggtactyakagaaagccaaatataacctgtccctccctatcttttccttagttgtgagggtcaaaggggcacattacagtctggattcagaaacccctttcaacagcacgtakatagttaaagagaaagattgttcttcaagggcctctaaggacaaaagtgaatccaytaacactctaggaagcagtgtgactactggaagaaagacattcaagaggtraaatggattttakaaggtcacasgagccaattgtcagtgtttgtactcttcatcaaaattatttttaatgagctccctgacaactgcgcatcctgacagcacgggtgaagtggctcatctggggtcatgcccgtgcctgacactgccctaattagctgacactgctctgctttgctgaagcacagggaggtctctcgagaaagatccagaagggaccatgataaatcggrcaaaatattccttgagagcctgaggttcacatgagagctcagaggaattacaataaagatggattaggaaaatggaatattaggaggggaaagactagagttactagaagagatatttgaaaagagattccaggatttactggacaggtttgtttaaaagtatttgagttggccgggcgcggtggctcatgcctgtaatcccagcactttgggaggccgaggcgggcggatcacgaggtcaggagattgagaccatcctggctaacacggtgaaacaccgtctctactgaaaatacaaaaaaattagacgggcgtggtggcgggcgcttgtagtcccagctactcgggatgttgaggcaggagaatggcgcgaacccgggaggcggagcttgcrgtgagccgagatcgagccactgcactccagcctgggcgacagagcgagactccgtcacaaaacaaaacaaaacaaaaattagctgggcgtggtggtgcgtgcctatagtcccagctactcgggaggctgaggcaagataattgcttgaaccagggagtcggagattgcagtgagctgagatgcgccactgtactacagtctggtgacagagccagactstgtctcaaaaaaaaaaaaaaaaaagtatttgagttgatgctcygtcaaaactcatttatcaagaggatttggttttaggcaacgaaaccttgcctcaaactcatttccaactcagcgggtttgaagatgtgcaaggattcatctgttcaaaagcaaaacatgataaaacaatgcagaacacctcaaaaccatagagaagtacctgtggaactgttcaggagtcctaaaggggctcattctaagtggaaaattattgttactctttcttgagttgtttctgtgaattacgaaaaaggcctatctcagtgaacagaccatgttgatcatactatgaagcagagattgtagagattttattaaactgccatacttctcagttcagagctgttttactccttctccctgggacatttggcaatgtctggagacatttatttatttatttatttatttatttatttatttattttttatttattttttggagccagcgtttcgttctgtcacccaggctggagtgcagtggcgcaatctcggctcactgcagcctctgtttcctgggttcaagcgattctcctgccttagtctcccaagtagctgggattacaggcgtctgccaccatgcctggctaatttttgtatttttagtaaagacggggtttcaccacgttggtcaggctggtctcaaactcctgacttcaggtgatccacctgcctccgccacccaaagtgctgggattacaggtgtgggccaccgcgccaggctatctggagacatttttgattgtcacaactggggggatgcttctggcatctagtgggtagaagctagaggtgctgctaaccatcctacactgcacaggacagccaacaggaaagaatcatccagtctcaaatgtcggtagtgcccaggctgagaaagcttgagttaaagtaaacctgataacctgtatttaaatgaataaaagggataagactaggggagaataaagctgtccacatttgtaagcctctaccaagcacagtgcctgatgtgggattacagacaggcgcctgtctcagtgagatcatagcatcagtaatccctgtaccgtatgtagtcccagattggaatccttgaccgaaggcaagttctcaacctctctaagactcagttacaaaaamgagggcataatagtgtctcttgccttataggttttggtgaaaattgaataagaaaacatcagtaagkatgtggcatggtgcctgacaatctttagatgcccaataagtggtagctagtatcmacatagaaataaaattgaaaagatacacacacaatgtttgcattggttatccttgggtaatgggttttaactttgtttcctagattttaaatttttccaccataacacgtattgcctttataataacataattcacktgttttaagtcgattcaggaagcttctgattmtatattataaattctaaatgttcccttctattttccagagtcaagtttagattatctagatcatgaaataatcagatattttcagctattacctaactcatgagtgtgtggaatgctgtggctttctgttattagaatgaaataaaaatgaaaaataaattgcttatcaatattctgagatagcaaagcaatgatgcatttatgatagactggatgataggatttgtttttgctgaacttattcatacatatttgtgttttgcttaractttaaaattgtttctttttctatgagcacatagcaataactgggaagtggctgagaatcattcttttttttttaatttttgagacggagtcttgcactgtcgcccaggctggagtgcagtggtgagatctcagctcactgcaacctctgcctcctgggttcaagtgattctcttgcctcagcctcccaagtagttaggactacaggcgcatgccaccatgcctggctaatttttgtatttttggttgaaatggggcttcaccatgttggtcaggctggtctcaaactcctgacctcaggtgatctgcccaccttggcctcccaaagtgctgagattacaggtgtgacctaccgcgcctggcctatcattcttatttgacagggatttccctattgctgggtgctaagtgattgagggaaacccagaaacagctttgtgttgtggttaacagcacagattctggagccaggcttccttgtaccaaatctcagccctaccgctaactagctttttgacttcagtgaagtttyttaacttccttgtgattattttcctcatctttgaaaaaggaataatgtcctcaacaggtaacatgaaggttaaaaggagatggcgtgtgtgtgtrtrtgtgtgtgtgtgtgtgtatacttgtgtatctcatccctaaacaaagcctggctcatagtaggccctatataagtgcttgttactatgattgaaagttggatatatttttaaatttctatttttcaatcttttgcaaagaaggaaaacacaactttgataaaggtaattttggtagacattctctaacatgtaaactgcttgtgtaaactgggaaataccagattgctctaaattaattagttctatatttgttcaattacactggattgtgttctgtgtttttattttgttttgtttcttgttttctactcacatggtgagacttggcttgggtgagtcatttctttgaagaccctcagttcatactaaggggcaaaagcagatgagggtccagggcaaggcatggaagccaactgctcagtggtttcaacccgggcttcatgggaaaaggatgggagggtggggttgggtgtccttgagattgaggtgagaacagttgcctgagaacaggaaccagaaagtcctaacagcggtcgatcactgataacatttgtgctgaaaacatttcaggcccaaactgtctcagccatgctgagcaaggcaggaacttgggatgtgaaccactctcttaatcgggtccactgtgtatccaaagttgacccttgagggccaggcacggtggctcactcctgtaatcccagcactctgggaggccaaggcaggtggatcatctgacgtcaggagtttgagtccatcctggccaacatggtgaaaccctgataatacaaaaattagccaggtgtttgtggcgggtacctgtaatcccagctactcgggaggctgaggcaggagaatcgcttgaacccgggaggcggaggttgcattgagccgagatcgcgcgattgcactccagcttgggcaacaagagcgaaacttcatctcaaacaaacaaacaaacccaaaattgaccattgagaaaaacccttgctttgtgcccatctgttgtgaggagatgggacagccttgcccctgcatggaatctgctcaggagctttagtttctgtagtagaaggtgggctctgtgattaactctgtggagtttaaggatctgggttcagtgagcactcaggctctgatggggaattgtacctggaacggttaattatctcgtaaaaagatcaatggaaaaattattttcaagaaaaataatagataaaatttacctactctgatacttagcacaataaatatttattgaactgttgaatcttttctaggtatttgaagttttattttcaggctagtggcttttgaattctgccacaggagaattcagttctccttctgaggccttctgaggaggggagagagtgaaaggaagggaagaagcagcttggcctggacccattttttccattaattttttttttcttagtagagacgagctctctgctatgttgcccaggctggtctcagactcctgggctcaagcgatcctcccgcctcggcctctcaaagtgttgggattacaggcgtgagccactgtgcccagcctggacccattttatatactagacttttctagaaggttctctttgaagaaaagttttctctgctaaccacactttgaaaaattatttctgtaggaaaatgatatattatccttygataacctaggtcgctggacagcttttgttaaaaagttctacccatgtggctttagcttccaaagatacacttcctttttttgagacagagtctcactgtgttgcccaggctggtcttgaactcctgggctcaagtgatcctcctgacttggcctcagcctcccaaagtgctgggattacaggcatgagccactgcgcstggcccccaagatacactttcaccaaactgtgtttcaaagttatgcttttaaattgtatttaaagttcatataagaacaggcttagctgtgacactgtagaggcgagaatgtggagttgacacgggtccttttcacacttgttccccacacagggcccacatgaaacctgtccctgagtttaatcctaagaaaaaccttgtttcactagcaaataattcccttctctgagaaggcaaattaattattttatttccaactttctcttaggcatcctgaaattytgagctcagtttcatgctctgaaaaagaaaaaataactgctagagtcacagaaatggtattgactttttggattggaatatttgttttctctgttccttacctgtttccccctatttttcttacttcctttccattttattttgtatgcctctttgtaagctgccttaaatgctttttggaatgaggcaggatayacattcaataaataaaatatgtytgagccacttatgaacaaaaccttyttgggccagagcctaaacattacttatataaaaagacctgattcctcaccttctacaacaatattatttagtcatttctctgcattgtactcaactctttaaaggttatagaattgtagttagcgtattagaaggctcatggatmtagattmtatgtcctcagcaggtgaagtcttttttacacaatgccactgtacggattgtagagttcttgggctggcataattttatgtgaccaaaatttggcaaagggtcttatcaktttgaggagagattaktggagcattgaatttcasagtttgaaatgacattagagattatctggtccagtgattctcaaccagggagacatttggttatttccggagatatttttggtcacaactgaggtgggtgctactggcttctakggatggaggtcaggaaagctgccaagaacccgacagtgtacaggacagcccccacaccagcatgtsactactgccgaggacgagaagccctgatctagccaatcctgtcatttttcagactccagggagtttgtgacctgaccttcaaatataagatttaatatttaattgcccaaattcattcttaaaatatagcaaaatgatgagaaatttcccttcaaaactgagaacaagacaaagatgtctattatgatagaccgttcttagaagtttactgctcctcctggggatgcctctcaatagagaaattctacattcccgcctgttgaaagcagacatggttacttgacttgtttgggcctatgaaatgtgaacasaggcgacacacgtcacgatcaggtgggagacttagtaacacatgcctggtgtcccatgcccttttccctctgccagtgttccagggcgtggcaggactgccagcctggtcttggagtcacagctgggccccgaaggcgatgctgtgggacctggaaataaagctttgctgttgttttaaaaatggaatcacattgtaaattaggatcctggggagcgtggcactaggtattcttatgcagagctagatggtgatgctttcctttccttatcacttcaagtctgcagacacagccttcagggcgttcttcttctgtggttcctcagttggggcaccttgtctggagtacacagtaaggctatgccacagtcctgctatgactgagatggcaatatgagtgcttttctttgttggtggtttttatatttatgtttaaaaaattataaactaggctaggcacagtggctcacacctataatctcagcactttgggaggccgaggcggatggatcactctaggtcaggagctggagaccagtctggccaacatggtgaagcccggtctctactaaaaatgtaaaaattagctgggcatggtggcgtgcacctgtagtcccagctacttgggaggctgaggcaggagaattgcttgaacccaggaggcggaggttgccctgagctaagatcatgccactgcactccagcctgggtaacaaagcaagacttggtctcaaaaaatacacacacacacacacacacacacacacacacacacacacacacacacactaaaactgctgacattgagcattatacagtaagacagattttccttccttgtttctttgcatcaattttctctgcctctccctccgttccttttctgtttgcttctactcaggactgggcacgaatgcacacattgctgtctggcttgtatctatgtggtaagtctagaatgatcagttactgaaagaagagggaatcagtgctagtgaaggatataggttgtggttaactggagttcccaagtagctggatcttttgtgacagggattggctagtttggttttataccagatactagttatatagagatgaaaagacaagtttccttcactcaaaggaaccttagcttagagtcttgcagggaaattgatttgcaagcaagctgctttgctcccttactctaaactcacacttgaatctctgatcttaacactttgatggtgaagaaaaagccctccagagaaaaggtagtaagagatccagaatctagagcctttcccaaggcttcaggtagatctggttgaattcaccttgttctctcttgccccctattctcttatcagtcattcccacagctttaagtgttttaaaggagtggaaagctcccaagactcaggcccttatgtcactcctgacatgcacttataggggagtccagagtgtttagtcctccagggtttttatgaatggtcagtgttactctcagaagatgctgacctgggtaggacaggttgttcatccattcatttgtgtgcttaccatgtgccaggcacagttccagaactggggatccactgctaaataagactgataaggtctttgctcttaaggagattccatgctagacattaattatattaatcttgactccagtttatgccctaagccaagctatcctctattctctttcggcatttttcagttgttaaaccagcatcaccaggttgacaacataacccaactaataccaacaacataaagtgcctgagttcaccagcccgctcagctcccagctgactgccccggagtcccgccctgttcaggcagaggcagagtttttttttttgttttttttggagacagcgtctcactctgtcgccaggctggagtgcagtggcacgatcgtggatcactgcaacctccgcctccagggttcaagcaattctcctgcctcagcctcctgagtagctgggactaaggctcaccaccacccctggctaattttttttgtttgtttttagtagagatggggtttcaccatgttgcccaggctggtctcaaactcccgagctcaggcaatccgcccgcctcggcctcccaaagtgccgggattacaggcctgagccaccgtgcccggcccaggcagagttttaattgaccaccatccyttgtccgactcctagaaactttcacctggattccttaaagtgatgccttgctgacctgattggataactcagtattcattgctgagtagctgaggtaagcgtgatgttcacttatttctcagctatctatgagagctgtagcttacattgtgatcattctggtaaatgttctctaagaaagaaaacgaaaaaataatggctagagtcatgttcacctagttttaacatctttagagttttgcttcttctcagttcagtagctcaaagagagaaaaaacacccaaagacagcaattcttcactctaaacccaatattcttcaactttctagaaattattagccacttaatttactttgattttcatctctgaaaaagtattcagacttatatatagttgccagatgtgttcatcaaacacttctctaagaaatttgtatatttttggaattcagtcaacattttttggataaatgaatgtgaacactttaggaattgcttattccacaaatgatytcttaccaagatttccagaaactattttcatattgaaacaaaaacaaaacaacacaccactctgcttcttcccacagagttctgagacagcttttacataatgatcttgaacatattgtaatcttgtttatgacagaaatgaaaagctgtcatcacatttctgttttggagagttcattgttttccctgtgaattcataggagttctttgtctattataaatattatcactttgtcttgaaaatagctttcccttctgtactctttctctgtgggctttatgcatcttttgtcttataaaatgtatgatgtctacagagtcagatgtatctgttttttcctttttagcgtctttattttttgtttaacacaaaaacatctgccagttggtaagttatagaaatattcttaaatttcttctaaagttttaatattgtatttttcagttaaagtgtaatccactgagccaggcgtggtgacatacacctgtagtcccaaccacctgggaggccgaggtgggaggattgcttaagcccaggagtttgaggctgcagtgtacaatgttcacactactgcactccagcctgggccacagagcaagaccctgtctccaaaaaaaaaagagaaaaaattaatccattggattactctttgttttcttctagttaaacatccattgtgtcagcataatcaaactatcttgccctatgaaatgagttgctatctcttgtctatattcacatcttttcccagattttctgttctattcccactgatgtatttacaggccagtatcacaacctgtgaaagcattgtcttcagtggaaattttaaaatagtaattactcctttcattatttttttcataattttcttggttatttccagatctttacttttcaatgaacatatttttaaatcgcttaaatcattcagatctgaaacctcattggcagtctaattggagtgaatcttctgattcacaagcatgaaatgtatgtatttctgtttattcaaaccttcttttagtattttaaatatgcgttttgttgtctttttcatgtaggatctatacctttcctaaatgttttatagtttcttgtaaatagaattttaaaattcccattctatctggttattgtaactataagacaaagctattgatttttttcctctttattttctagcatttattatttgcaagcatttattagttgaccttttggggtctgttttctcttttgaatgtgtaagcacaaggtagatcatgtttatcttgtttactagtttatccccagcattctggcaggacaaatgaatgaatgcatgaatggatatctgaaaaagcgtttgagaggagattcaacaatctacactactttcccttttcttctttttaccttgtgtttctaacacatactaagctttttttctttttcttctgaaatggggttttgctctgtcacccaggctggagtgcagtgtcatgatctaggctcactgcaacctctgcctcctgggttcaaacgattttcctgcctcagcctcccgagtagctgggattacaggtgcacgccaccaagcccagctaatttttgtatttttagtagagacgggatttcgccatgttggccaggctgctgtccaactgctgacctcgggtgatccacccacctcggcctccccaaagtgctgagacgacaggcatgagccaccaatcccagcccattctaagcttttaacatccttagattactgttccaaatacgttgggaaggtcccccaattttttccttaactttttaaaagcaactttattgaaatatattttatatatcataaaaatcacctatttcaagatgattttagtattcaataatttttagtagctttactgagtgatgcaactgtaatgtaacgatagatgttcaggtttagaacgttttcatcctcctaataggatctctcatgtccatttatagttaatccctgttcgcacctttacccctattcacaagcaatcgttaatttacttcttgtttcagtggatttgcctgttctggacatttcatataaatgagatggtaccatatgtgaacttttgtgtctgactgctttcgcttagcataatgttttcaaggttcatctatgttgtcgcctgtgtcagtattctcttcctctgttgctgaataatattcccttgtatgcatgtactacattttgtgtatctgttcattagtttttggacatgtaggttgtttctactttttggttattatgagtaatgctccagtgaacttcacatgtaagtctctgtgtggacatatgttttcatttcttttcrgtaggtacctaggagcggaattggtggttcattttatgttttttgagaaattgtcaaactattttccaaagtggccacaccattttatatttctagcagtaatgtatgagggttcctattcctcttttcttaacatttttctcacagtttattgatgtatgattgaggtatcatttacattgaggtataacttacatatgataaaatgctcagatcttaagtgtacagttcaattatttttggacacatgtatacatgcatgtatacaaccactgcgtcaatcaagatacgaaacatttgcatcattctagaaagtcccttgttccttgccctcagattttgatttctatcattctatcatactgttttgatttctatcattgtagattagtgtttattccagaatttcatacaaatcaaatcatacagtatgtactcctttgtgttgtcttctttcactcatcgtaagggtttcgagtttcatcagtgttattgtgtttatctcagttgtttgttcctttttattgctgagagcactccattgtatgaatgtcccacatttttgtttatccagttacctgttgatggacatttgagtcatttttcatttgtagttattaggaacaaaggtactattaaacatttatataccagtctttttgtggacatgatttcatttttcttgggtgaattcccaagagtgtaattgctgggtcatagggtagttatatgttacttactgttttttatctagtattaagtcactttacaaaattctttaagaattacagttttttggccgggcatggtggctcacgcctgtaatcccagcactttgggaggctgaggcgggcgcatgccttgaggccaagagttcaagaccagcctggccaacatggtgaaaccccatctctactagaaatacaaaaattagccaggcgtggtggtgcgcacctgtaatcygagctacttgggaggctgaggcatragaatctcttgaacccgggaggtggagattgcagtgagctgagatcacaccatggcactccagtctgggcaacacagctagactcagtctcaaaaaaaaaaaagaatgacagtttctaaaatatcgtgtctttgattttctaaattattatacaatttgctgataggtataattttgagttagatctttatctgttgatctggaggagtttcygggactttttttttttttaaagaagcacacaagttgcccagaaatgtatatagtataatccaaattttgtaagacaaacaataacatgtatgtatatgttcgcgattctataggcaaaagaaaagatgtgaaagatgttcactggcatgctaaccatggtttcgtggctggagtggcggaggtggttaaggggaggtgtagagggttgagtttacaaaaaaaggaaacagggataaagaaaacacattattaaagttaaatgatttagtagagtataaatatataaatatatttatatatttataaaaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaagttatttgcagctgttaaaaatagtgatatacgtgtgtttagaatgtatgttaaattcaaattcagattgcaaagcagtatgcattctatggccctgactactttgtgctaatatgattgtgattatgggcatttttgtttactttttaaaatcttatgggggaaaaaagcaggagttatttctagaagtatgaatcactgaaacacagtaatattccttaaattatacttttcttaggatagctgtaattatataagatttagtcaaatctttaattagatggtaggctgattgagggtagggatccctcaagattctatttgtcaccgtcagagctcagaataattctgactcattcataacatgaagagatcaccgttgaacacagtccataggaaagtaagatctcagcattaaagagatgcaggtatgagtgttaaagaagagcaggccctggtcagagtattctccaattgacgtcaatcagttctccacttgattgacctggagagtactttgacagggcctgctcttcatttacataggctcggtgcctaccttttgcagctgaacaggctcggccccagttcttgctgggttctaagctacagtttcagggaaaaggcagaaagccaagatagggcaggaatgggatgaaaggggactggcctgttggctaggtcagcaaatttgtctgtgatttacagcactaagctcaggatttgacttgattagaatttgattgcctttcatttgattcaagttggagccactgctccgggctgttctatctagtggatggaccatagaagcagggatctcatgacttagcaatattaaaacctcaggcaggtggcttgttggtctgagcagcctctaaatttgtacaaaagcctggtggctggctgggttggtaaaaatggcagytgtcctgcatgctgacattgggagttactctgcactgctgcaggctgtcctggcacactgcaggccgggcatcatttcatggtggaggacgtcactcagttttgcatgaggctcttgcatcacatttgtatttaaggaattcacaccttattttagggaaaacatctgttccttggttaaaacagcattgcacttttaacagagcggccacctttttccacatacgataggacaggttttggatatatggagtattaactgaaaagagcactatatatttcatagttctttaaagaccattgatatgtaaatcaatgtgtaagaagatatcgtttaagaggggttatggcacatggtggaaggaatgctgctttgcatttatcygtgtgaagtaatctgcctgtgcatctgaagaaacagcaggccccgccgcaagtgatgaagcagttctgtggagaaacccatttacaccagtttccagatgctattccaccagaaataattccaagaatatacttatattttaaataaatgataaaatcaatttccagatgaagtgtacattacaaagagaaacttggtattattatgtattaatccatattaactaaagttgaacctgacatcaaaatattgatcccttcttaaaatagacaaaaatactttragttaaattgtttttcttcctatttgtgctagccggtgcttaaagtctaatgatgtgataattgaatagtaaaggaatctaaatctctactttcttgattcccagtgtgctaactttactaaaattgtgggaataagcaaaatatttttcatagcagtaataaggatttttaaaaattatgtgacaattgtgtattagactgaagtaattaatacctttgtcacagggaccgggtgcaatggctcatgcctgtwatcttagcactttgggaggccgagacaggcagatcacttgaggtcaggagtttgagaccaacctggccagcatggtgaagcctcatcttactaaaagtacaaaaattagctgggcatggtggtaggcacctgtaatcccagctactcaggaggctgaggcaggagaatttcttgaacccaggaggcaaagattgcagtgagccgacattgcgctactgcactccagcctgggcaacaaagcaagacacgctctcaaaaaaaaaaaaaaaaaaaattggcatgagactaaagaggatttaaggtggaggatttcctcgcagtaggtaaagaagcaaagccctgtttattcagagcctgagctcagacttgaatttcttttttagactttcattttctccctttatgaagtggcaaagtcagttaagtatagatgtggccgtctatgtccctgarcttctgggttcaataatcagctctgcgactcctcttaaagaatccagaggatttcctgcctggaccttgaagtcacctccccgctacatatttcccagctctggttttccacctcctcaggatgaatgtcttcttgaatgtcctctggaagagtgtcagctgcacttaaacttccatcaaaagggggactcagaggccttaaaataggcatcaggtacacattctatttatgattctgggattaggcctattttttggcatttcctgtggtcaaatttttaatttctgaactttatcggatttccaaagataccgtcccttggctgtcttcattgatttcttcaaaggatttcctcggcaaagttaccctagtcttaactggaagagcatggctcccttaaagagtctaaaataagccttttcctttagtgactcccagctctggtcttgtcaggttscatttttctcctaaccttcttctttcctaatcctcactcactaattcaaaaatgttattctgccttccagaacatcacactttgtaaacattttgttaataataaaagctagcattccttgaatactggttttgtaagctagattatctcatttaaccctgtgatgatgttattcattaaggagcatttgctttcttaggtctgcaacatcagtcactcctcgcccatctgtatcccagcttttaacagtttgttactgctctttcctatcatattctcttgtgggcaccaaattttyttttttaattttattgtatctttagaggagttttaggggagagtaaaaataaatatatttttcaatccatctttacccagaaattgaaatattactttttatagtagaaccagaaattaacttaagaatgtttttggcatttggagacatgcatacaaatactaaagaggtgcttataaaaaaattacacttttggccgggcagagtggctcacacctgtaaccccagcagtttgggaggccgaggggggtggatcacttgaggtcaggagttcgagaccagcctgcccaacgtggtgaaaccctgtctctactaaaaatacaaaaattagctgggagtggtggcatgcgcctgtaatcctagccaccggggaggctgaggcaggagaatcgcttggacctgggaggcagaggttgcggtgagcagagatcaccccacggcactccagcctgggcaacagagcgagactctgtctcaaaaaaaaaaaaatttactttttattataaatttgtcatatttaatgccatggtgcattatagttctggctacaaaatgaaacaatttatttttaaacttgattttttttctctaacatttgaaatcattaaaagttactatcaggagcctctcattttatgcatataaatgcaataaaacagctggttatcttatgctctatatgaagggtaatattttaagtgcattttcaaattcagctaagctagtgattctatcagaaaatatcatttttcactcactggcttttgaaacataattagattttctgagcaactgttgcttataattggaatttgcttattatmattttaacagagaaaaacactgacctatgtaattttagtgcaattaaatttttctccttatgcctgtgtgtacctcatcaattcagcaaaagcaaaacctgatctagaagtccctgtgcagcagattgcagggaaagaagcagtcagctgatttgtctgggccataaaaccgtggtgtctggcagaattgtgatagtaattgctctaagatgcattctgtttacaaagactaacattgcagctgcttttaattagctgctagaaatgaaaaactgtcagggtatgcttgttagatctacctgaatttattccattgcaaataaagcagaatttaaagaatatcaatgtaaaacaggaaacttctcattgtaaaccaagttcagaaaggtggtggtaaatatctgaatgtatccttttggttttatgggaagcagaaaaacctgatttcctatgacacagaccattgcattctgtattgtattgttttcttttttctttctttctttctttcttttttttttttttttttttttgagacacagtcttgctctgttgcccaggctggagtacaatggtgcaatctcagctcactgcaacctccacctcccgggtccaggcaattctcctgcctcagcctccctagtagctgggattacaggtgggcgtcaccatgcccaggtaatttttgtatttttagtagagatgggctttcatcatgttggccaggctggtcttgaactcctgacctcaagtgatctgcccaccttggagtcccaaagtactggaaatataggcatgagccaccatgccccgctgttttctacatttcttttatatgtaaatttctgtcctgagcagatgattcacttccagagaaaaggatctttgcattccctgctgtctggcattgtgcataataaatatatactggcaaatacataatggtagtatttttatttataaaagtatgagaaattgctttgagaaaatcaaagggttagaaataaaagaaaattaaaagcattgttacaatttatcatgaaatttagtgagtattacagagctttgtacactgggttagaaaatttgtgtttttttctttttcttttcttttctttctttyttttttttttttttttttaaagagatagtgtcttgctctgttgacaaggctggaatgcagtggtgtgatcacagatcactgcagccttgacctagactcgagcaatccttccacctcagcctccagactagctggaactacaggtgtgcaccagtgcactcagctcattgttttattttttaaatgttttgtagagacggagtcttgctttgttgcccaggctggtctcaaagtcctggcctcaagtgatcctcccttctcggcctcccaaatcctgggattacaggggtgagccaccacacctggtcttaggtttcttaattttatttctctgtgtttctacaggcttttaggccattttactaataattacttttttttttttttttttagtttttttgagacagagtcttgctctgtcaccaggctggagtgcagtggtgcgatcttggctcattgcaaccgctggttcaagcgattctcctgcctcagcctccctagtagctgagattacaggcacgcgcgccatcacgcccagctaatttttgtatttttagtagagacagggtttcaccatgttggccaggctggtcttgaactcctgwccttgtgatctgcccacctcggcctcccaaagtgctggcattataggcgtgagccactgttcccagcctgctaatagcttttaaaaaggaatattgattttcatagttgtgtggcagacacagctgacaccactagctaacttaagcatactctgagaatgaccttgcatggcagatgcacctgacacaaaatttaagcataacctgaggatgaccctgtagcctaagaagaatgtgtattcagagttcccagctaataaatccaggaaggccaactgggagagtcattccttatctgtgagtaacatctgaaccctcagcccatcctgtggaacacaggccatataggggattgaggccctttgttttgggttagatagaggttgctagggggagggtgctaagcaagaatgctgtataaactgcatgctttttacaagcagttgccattgtctagtccagcccgtcaccactggaccaccctgtatgtaaatcctctcagtaaaccttgtctcatttactggctccaggtctctttgaaagcctctcaaacatggcgccatccctattgcagccattagagtccggcgtggcagtggtcaggactgttgaagaaggctgagaatttagggcactgtgaagtgtttaatcatttatcaaggtatcaatttagtgtctctcaaggaaaaaacatatttgttgatttgatttcatgccaacactgatgttttttgctactctatggccttgaatagtcaggcattgactgtaaccaaaaggatgtatggaaaataattgttttcttttttgagatggaatcttgctctgtcgccaggctggagtgcagtggcgcgatcttggctcactgcaacctccacctctcgggttcaagcgattctcctgcctcagcctcccgagtagctgggattacagacgcatgccaccacgcccagctaatttttgtatctttattagagatggagtttcaccatgttggcyaggctgctcttgaactcctgacctcgtgatccacccacctcggcctcccaaagtgctgggattacaggtgtgagccaccgcgcccggccaaaataattgttttctatccttagtgaagagctaaagagaatttccttagaataacagcaaaggaacttaaagtgttcagaaaaacaaagtgaggatggtaggaatcctttcgcctgaaactttggaaaaaggtggaygaattacaactaagtcatcttttagctttgctttcttgatcttccttcaaagtttatgatacctaaattctctcttcaactcataaaatgtgttttatggtttaatagaaaagctataagcacatgacaaaattagttcttattagctatatgcctacagaaccaattttgtggttttcaatatgatatgttcaattccagaaggtgttttataaatcagttggtaggaacctgttttatgtgtaagctgtgtccagatggatgtttctttacccttttatgtacctggaccaatagtaccagaaaccatgggagcataaccaccccacaagaactccacccctgccacagccttcactatttggcaggggaagcagagactctgccatcttcaagccactggtagagcccctttcacatgacctgggaggtaatttcacaagcaaagaagtctaaagraaaggttgtacctaatttaaattattgcttttgtcatattctctaccactcacaggaatgttttattattaatcacaaatcataagcaatttatactcttgattatttcaaaagagccacatccactgctatggttttgaaattattacattatacattattagtcagcttagactaaattatgctgtggtaacaaaccccaaaatttcaagggcttacaacaataaaggtttgtctttcatgctgtacattcattgcaggtaactaagacactattccatgtcactgtcattctgagatatgggctgaaggaacatcctctccctgaggctttgctagtgtttcagtagacagaaaaagaacgcaatgggaacacacacaatggttcttaaagcttcagcttcaaagcagcacatgtcatggcactcacactttacaaagcaagtcagacggctgctctggggacctgcagtcgtgcaggagaggggctcccaaatcagacagccactcctggcatcaatgacgcagggatctatagtccttttatgctgaggggtggtgaatccaccacagttaacaaaatcttgagacttgccataaacaaattctcatctgtttgtgtgatgaggtccagatgatggcccacttcagtagcaaagacagtgcactgtgctcaccacgccatttcatcttttccctgggttgataggaagatggccttctcaacccctttgcatctgtgtggggccaggagactaaacaccgccagttgattatgaggaggaatgacgtgtggcacttccagacctagctcacaaacgtggcaaaatccactctcccccaactccttgagcctgtctctccaaattgctgcatagaggcaatgtttccaggagaacctcacctggccagaaacatctgccttgaacatggttagaacaaatgaaacttttttgtattaaaacacwtgagattctgtggctcttcgttactgtgttaccctatcctgaccttgctttgtggtttatttaatgatgcacatttactagagtggtgtacattcaatagtgaggtggccacatacaacatacccctaaaacattgctgaaagtacacagccatttctactataaaaatataagtatatgagtgaagaactgatttttgaattttgctttaattaatttaaatttaagtggtcacatgtgggtagtggccaccgtattggaycacagaaccttaagcagtaggaagctttttgctacgtgatgtattataaatctttccactgtctcagcaatctaaacataaaaccaacatgtctaaatttcacactttctagatgatgaagagtcataaaatgaacagaaagtctttatatggtgtttcagggggacagttgtgacattggagtgctggtcaaagttctttattattttttatttgtttccaaatatggagtgcagaaaaccaaatggtggaatggacatttttgccaaagtataattgtggtctttaatgatgtaaaataaaataccatattcatttctgaatttttttcatcgtgaagtgtgtgagatgtgacttgacaactttgcaaatgtcgtgcctctgcttaaatctctgcattatatttatggaaatgtttgagatcctggaaaccatttagaggtgttataaaatactttatttcttgaggtccaaaagacttcaaaataggggctgagtgatataatggaaagaacactggattaggagccagaatatctgggttaygttgcctgctctctcactaactggctcagtgaatttgggcaggttatttgaactctctggatctcggtttcttctatggtgagtttatgggcttagattaatcacccacctctaaaattccaggtcttttcttttttctgactttaggtcaggtcttttcttgtgaagtattaaaactgagcccacccatgtcaatataacttaactctttgttccacgaaattcgtgcccaggaagataagacagtaaattaataaataaattcactgtttgctttaggaaagtcttgcaaatcaatttatcaggacaaacagtttgctcatctgggcaaacagttgtcttattaaaacaatatattgctcacctgggcaaacagcttgacaagtttgtgaaagaatgtcactatgcattgtggttttgaaaatgaatctatgggctgggcgcggtggctcacgtctgtaatctcagcactttgggaggccgaggcgggcagatcacaaggtcaggagttggagaccagcctgaccaacatggtgaaaccccgtctgtactaaaaatacaaaaattattcgggcgtggtggcgcgctcctataatcccagctactcaggaggctgaggcatgaaaatcgcttgaacctgggaggcggaggttgcagtgagccaagattgtgcccccgcactccagcctgggcaacagagcgagactccatatcaaaaaaaaggaaaaagaaaaaagaaaatgattctatggaaacagyagacactggggactccaaaagaaggacaaagatgtaagaactacctattgggtactatgtttattatttgggtaaggaattcagcaggaacccaaacctcccacatcacacaatatatccatctaacaaacctgcacatgtacccctgaatctaaattttgttgttgttgttgttttttgagacggagtctcgctctgtcacgcaggctggaatctactataaatgcatttttttttttttagacggagtctcgctctgttgcccaggctagagtgcaatggcacgatctcggctcactgcaacctccgcctcccgggttcatgcaattctcccacctcagcctcctgaatagctgggattacagaaacctgccatcatgcctggctaatttttgtatttttgtagagacggggtttcaccatgtgggctgggctggtcttgaactcctgacctcaggtgatccacccacctcggcctcccaaagtactgggattacagtcatgagccactgcgcctggccaactataaatgcaattttatttactatttaactgggagtagaatatcttagtatgtaagtctaggtatttttccaactagcacaacacttcagatagtttatatattggtgagattaattacaagattagtgagcacatcatagacattgagttaattatgacaaggtgaatgaacaaaaccaattttctgtgtcaaacgtagtttacaactttatgtaaacatttatcatatacattgtaagaaattcagttttctgtaaaaaaatacgtagtcttaagtttacaattcaaaacccatagaggttccctgacattacttgccaacatttaagagctacttattagtttgaagagagacagagtatgtgcacatttaaacttaaggcagaaatttgtgtctgttggcctaagtgttctttgttcactgggctctgaagaccatcaaataaaagtaattcttaacttagtgtttttggcactgaatcttgaattcctttttttttttttgagacagagtctcactctattgcccaggatggagtgcagtggtgcaatcttggctcactgcaacctccgcctctggggctcaagtgattttcctgcctcagcctcccgagtagctgggactacaggcgcccactaccatgcctggctaatttttgtatgtttttagtagagacggggtttcaccatgttggccaggctggtgcatcctgaattcttaaataaccagtaccaaagttatttttcttgaaccttctcactaagtatctttatcgcacatgagttctctctttaattttaactaaggcctaattaaaatattttcaaatttataatttttattttctcatgaagcctgataggaaaagctttgcccttaggctcatagttttacctgaggaaattcaacaatggatctgaaagcagcttattgaggacatgcagttagaacttaagaagaatgtgcctttaaggaggaataaccctgagaaatagttccatgacatttaaattctattgctctgacagagccattctgacaggttttaagtttcaaagttatcagacaatgtgcagacaacctcaccatctcctgagcttcacctcactgttaaccagcctatggtaatgtctttctctttttctcctcctcttcctcctactccctatccttgccctgtcaatattggatataatggcaggtcagaaatggggtgaggcatgaggtgaaaaccaaagagaactgtgcagaaggttaagggttaaataacatcaggcaaaccagccaagtataactagacattagaagttcagctctagtataaaagttaaaagacaaaagtattaaaaatcactatacctgcataatttgttgatgaatacacagtataaaaaggtgtaaagtgtgacatcaacaccatagaatggtgggtgggggataagtaaaagtgtagtaattttttttttttttttttgagacagggtcttgctctgttgcccaggctggagtgcagtggtgcaatctcggctcactgcaacctctgcctcccgggttcaagagattctcctgcctcagcctcccgagtagctgggactacaggcacgcaccaccatgccaggctaatttttgtatttgtagtagagatggggtttcaccatgttggccaggttggtctccaactcctgacctcgagttatctgctcacctccgcctcccaaagtgctgggattacaggcgtgagccaccgcacctggcaagtgtagaatttttgtatgcaattgaagttgagttgttaccagtttaaacagaatgttttgttttatgtaaggtccatggtaaccccaaagaacctacctttagtagaaacacagaagataaagaaatgaatcaaagcataccactacaaaaaaaaatttaaagtcacaaagcaagactgtaagagaggaagaaaggaacaaatgaactgcaaaacaaaacaaaatagttaagtccttaactctcaataattagtttaaatgtaaatggattgaattccccaaccaaagataaacagtggccaaatggattaaaagaaaacccaagatctaacaatattcgtgtgtacaagaaattcactttagacttaaggacatacataggctgaaagtaaagggatggaagaaaatattccacgcaaatagtaatcaaaagagagcaggagtggctttatttatatcagactaaatagactttcagtcaaaatctgtcacagaagacaaagaagatcactatataataataaagaggtcagttcatcaagaggatataacaattataaatatatgtgcaccccacattgaagcatctaaatacataaagcacatattaacagagctgaagggaaaaacagacatcaatacaacaatagcaggatgcctcagtacccctttcaacagtgggtagattatccagacagaaaatcaatgaggaaacagtggcctgaataacattatagaccaagtggacctaacagrcatacacagaccatctcatccaatagcagcagaatacacgtttttctcaaggacgcttggaacattcacaagggctagattatatgttgggccacaaaacaagacttaacaaatttaagaagattggaatcatctccagtaccttttctgatcataataacattagaaattaataacaggaattatgaaaaatggacatatgtagacattaagcacacactcctgaacaactacttggttgaagaagaaatcaaaagagagattaggaagtatcttgaggcaaatgcaaatggatacacaacataccaaaagttacaggatgcagcaaaagcaattctaagagggaagtttagagggataaaggcctacattcggaagaaagatcttaaacaacctaatttcacaccccaaggaactagaaaaagaagaacaaactaagcccaaagtcagcagaaggagacaaagattggagcaaaaagaagctaaggagacagtagaaaagatcaacaaaactgagatttgttttttgaagagaaacaaaattgacaaatcctttatctagctttaccaagaaaaaaagagagaactcaaataaatgaaattataaatgaaagaagagatacaggcataccttggtttattgcactttattgtactttgcagatattgcattttttacaaattgaaggtttgtggcaaccctgcatggagcaagtctgttggcaacgtttttcccgcatgtgctcactctgtgtctctgtgtcccattttggtaattcacacaatatatcaaagtttttcattattgkattatatatataatattatgtatatataatatgtaatatatataatacgtatataatatataatatatgttatatattatatgttatatgcaatatatgttatatataatatatattatatataatacatatatattatgatattattatatcacaatgctgattgtgatcagtgatctttgatgttacaatagtaattgctttggggtatcacagactgtccccatgtaagaaggtgaatttaatcaatagatatcatgtggtctctgactactacagtgtgggctctgctactgttctgactggcctttccctctcattgagcctccctattccctgagacacaacagtattgagattaaaccaattaataaccctataatggcctctaattgttcaagtgaaaggaagagttacacatctctcactttaaatcgaaatgtagaaatgattaagcttagtgaagaaggcatattgaaagcccagataggcctattgtgtcaaacagtcaagttgtgaaggccaagaaacgttcttgaaggaaattaaaagtgctattccagtgaacacacaaaagataaagcaggccaggtgcggtggctcacgcctgtaatcccagcactttgggaggccaaggtgggcagatcacaaggtcaagagatcgagaccatcctggctaacatggtgaaaccccatctctactaaaaatacaaaaaaaaagtagccaggcatggtggcacgtgcctgtagtcccagctacttgggaggctgaggtgggagaattgcttgaacccaggaggcggaggttgcagtgagctaagatcgtgccattgcactccagcctgggtggcagagcgagactctgttaaataaataaataaataaataaatagatagatagatagatagatagacaaataaagcaaaaaaacctattactgatatacagaaagtttgagtcttctggatagaagatcaaaccaaccacaacattccgttaagccaaagcttaatccagagcaaggtctttcttcagttctatgaagactgagagaggcagtgctatggaaggagagtttggtactagcagagactggttcatgagatttaaggaaagaagccatttccattacataaaagtgcaaataagcagcaaatgctgatgtaggggccgcagcaagtcatccagaagatctagctaagattattagtaaaggtggatgattttgaggggttcaagacttcagtggaggaaggaactgcagatgtggtggaaacagcaagagagctagaattagaagtgaagcctgaagatgtgactgaattgctgcaatctgaggataaaatgtgaatgaatgagtacttgtttcttatggatgaacatccttcttaaagatggaatctactcctggtgaagatgctgtggatattgttgaagtgacaacaaaagatgtagaatatttcacaaacttagttgataaccagtggcagaatttgagaggattgactccaattttgaaaaaagttctactgtgggtaaaatgctgccagacagtattgcctattacagagaaatctttcacgaaaggaacagttgatcaatgcattaaacttgtcttattttaagaaattgccacagccaccccaaccttcaacaaccaccaacctgatcagtcagcaggcctcagtaatgagacaagaccttctaccagcaaaaaagattgtgactcactgaagacttagatgatcattatcattttttagcaataaagtatttttaaggtatgtacattgttgttttagacataatggtattattgcacattactagactacagtatagtgtcaacataactttcatatgcactgggaaaccaaaaaatggatgtgacttgttttattgtggtatttgctctgttgtggtggtttggaactggacctgcaatgtatcagaggtatacctgtattatagctaataccaaataaatagaatcataagagactactgtgaataattgtatgcctacaaattggataacctggaagaaatggatcaattcctagaaacatacaacctacaaagattgaatcataaaaaaactagaaaatataaacgaccaaataagtaaggagattaaatgagtcatcaaaaacctccagcaaagaaaaaccccaaactagatggcttctttggtgagttctactatgcgtttaaataagaattaacaccaatccttctcaaactcttccaagaaattcgagaggagggaacacttccaaattcattttatgaggccagcaacaccctcataccaaagccagataaggacactacaagaaaattccagatcagtatcactgatgaacatagatgcaaaagttctcaacaaaataccagcgaacctaattcaacagcacactaaaaacatcatacaccataatcaatgaaatgtatctctgagatgcaaggatggttcaaatatatgcaaattagtaaatgtgatataccacattaacaggatgagggataaaaatcacatgatcatctcaatagttgcagaaaaagtatttgacaatattcaacatcctttcatgattaaaaactattaacaaatcagatacagaaggaatatacctcaacataataaaggccatatatgacaagctcacaactaacatcctactcaatggtgaaaagctaaaagcttttcctctaaaaccaagaacaagagaaggatgcccacactcaccacttctgttatacatagtactagaagtcctagctagagcaattaggcaagaaaaagaaacaaaagacatccaaattagggaaagctaaatagtctctktttgcagatgtcatgatcttatatattaaccctaaagattccacagttagaactaataaatgaattcagtaaagttgcaggatacaaaattaacatacaaatattagttgcatttctgtatactgacaactaaccagaaattaagaaaacaatcctatttacaatagcatcagaaagaataaaataggccaggcgtggtggctcatgcctgtaatcccaacattttgggaggccgaggggggtggatcacatgaggttgggattttgagaccagcctgaccaacagggagaaaccccatctctactaaaaatacaaaaaattagccgggcgtggtggcgcatgcctgtaatcccagctactcaggaggctgaggtaggagaatcgcttgaaccgggaggtggacgttgcggtgagccgagatcatgccattgcactcccgcctgggcaacaagagcaaaactccatcccaaaaaataaaataaaacaaaataaaatgaaataaaataaaatacctaggaataccaagaaggtgaaagatctgtacattgaaaactgtaaaatattaatgaaagaaattgaaggctggggcrgaaggattgcgtgattccaggagtttgaggctgcagtaagtcatgattgtgccactgcactgcagcctgtgtgacagagtgagaccaaaaaaaaaaaaaaaaaaaattgaagacagaaataaatggaaaggtatcctctgttcaaagagtggaatagttaatattgttaaaatgtccatactactgaaagcaacatacagattcaatgcgatgcctatcaaaattttaatggcatttttcacagatatcagaaaaacaatcctaatatttgtatggaatygcaaaagacyccaagtaaccaaagcaatcttgagaaagaaggacaaagctggaggaaccacttcctggtttcaaactacttcctggtttcaaactacattacaaagctctagtaattaaaacagtatggaactggcctaaaaacggccactagggtcactgggacagaatagaaagactagaaataaacccaaacatatatggtcatctaatctttgacaagggtgccaagaatacacaatggggaaaagatmatctcttcaataaatagtgttggaaaaactggatatctatatgcaaaagattgaaattggacccttgatttacaacatatacaacaattcaagtgaattgaagacttaactgaatgtgagatttgaaatcgtaaaagtcttggaagaaaacatcagcaaaaagctcaaccttggtcttggcaatgatttttttggaaatgacaacaaaagcacaggcaacaaatgcaaaaataatgaaatgggactatgttaaactaaaaaaacttctgcacaacaaaggaaacaatcaacaaaattaaaagacagcctaaagaatgggacaaaatatttgcaagccatatgtttgataaggagttaatatccaaaatatataaggaattcacataaaggatttcacrtaactcattagcaagaaaacataaagcccaatttaaaaacggacaaaggacttgaatggacrtttttccaaagaagacatacaaatggctgacagacatgtgaaaagttgcccaagattactaatcatgagagaaatgcaagtcaaaaccaccatgagctatcaccttgcacctgttataatgactttatcaaaatgacaagagatagtaagtgttggcgaggatgtggagaaaagagaatttttgtatattgttggtggaaatatcaatttgtacaggaattatcaaaaaacagtatggacgttcttccaaaatttaaaaaaagagctaccatatgatccagccatcccacttctgggatgaaataaaatctgtgtcttgaagagacatctgcaccccatgttcatagcagcactattcacaatagccaagatatggaaacaacctamgtatctgtcagccaatgaatgaataaagaaaatgtggtgtgtatacacaatggaatattatttagccatgaagaaggaaatcctgccatttgcaaaaacagaaacgaacctggaggacatgatggtaagtaaaataagccaaacacagcaagacaaatattgttttgtcttacttatatgtagaatctaaaaagttgaactcttagtaacagagtagaatggtggttgccagggtctgggggtgagggattaggggagatattagtcagagtgtacaaacttttagttttaagatgaataagttcagtggatctaatgttcaacatggtgaatatagttgacgatactgtgtttacttgaaattagataagaagatagattttaagtgtcagcactgcaaccacacacagatgataactgggtggtgatggatatgttagttaatttgattgtggtagtcagtacacactgtgtatgtatatcaaatcatcatgttgtacgccttgaatatgtacaacttttctttgttaaataagtactttaaaattttacaaaagacatttacaagccacacttactcatcttgggaaaagctatcagtcatttaaagcaaagcatcctttccttttcaagattttactttttttttttttttgagacagagtctcaggctagagtgcagtggcacgatctcagctcactacaacctctgcctcccaggttcaagagattcttatgcctcagcctccggagtagctgggattacaggcatacttcaycatgcccaactgatttttgtatttttggtagaggcggggtttcaccatgttggccaggctggtcttgaactcctgacctcaggtgatctgcccaccttggcctcccaaagtgctgggattacaggcttaaaccactgcacctggcctcaagattttacttatattttaaatgtctacatcttgaatttcaattcttattctacctagaagctaaaagcattggcagggttatgagttggggtggaaatatttgggcctgtggaagataaattcatattgtttgaagaaaataatctgcttataattatcagtttattataatcaggcccaaagaaggaaaccaaaagtcttaatattttcttagtgataaagtggaggaagtaactgacaaagtaattttggctctttaccagggatgcttcatataaaggagggagaacaatttccttgacaaccaattaatatgtatagcttaaggctatgactgtattctgcaagaaatagattacatttctgaggtctgcacatctgaagatattataaactagctaggagatttttatgatgatatgatacagatcagcaatacgtaagacagaaagggggyttcacccagcaagagttaggatttatagtcccagtrtgcccgagttttacatattgtgaactttgctaaccttcacctttatcaacaagctgtgagtgactctccagcacaaagctttgagtatcaagcatgcatatagtaaaaaaaaaaaattgccaggcaccgtggctcatgcctgtaatcccagcattttgggaggccaaggcgggtggatcacctgaagtggggagttcgagaccagcctgaccaatatggagaaacctcgtctctactaaaaatgcaaaattagccgggcgtggtggctcatgcctgtaatcccagctactcgggtggctgaggcaagagaatcgcttgaacctgggaggcagaggttgcggtgagctgagatcgtgccattgtactccagcctgggcatcaagagcaaaacttcgtctgaaaaaagaaaaaaaaattatactgatgatttgggggagagcaccaaatacccttaaagtttttacggcacagactttttagtaaatcttatgaggggatgattatgggaataatatgcatatatmtatatatatatatatatatatatatatatatatatattccaaaaatattggcaaaaataatgaagaacctgaaagtcctccatggtcagagttaaggtcagggtcagggatgaatgttgcattagttggcaataaaaagcagccattgtacagtttgacaggcctgtgtgaatatcctgctttgtagctgagtgttcttgcttgttaatctgcttcccctatccccactcttttttttttwtwttaatctggtggttgagaggtgcttccaagcctacctattttatttaccacttcctcgttagttttttgggcttcttaaaatggtcctccactcttatgacttctggctgtttgtacacaagaactgtccacctctctcctcctgccgtcaagggtgttgctaaacctatcatcctcaacctgaagctccttccacatccttcttgccagctcactatcagtcatttcctgagactgacatcacaaaagagtcattagatttaagccctggtttcagcaattactggacctgttgtgattctagacagggttcttaacttttaattttccatgacattttttcccttgacatcccagtccaagctgttgacttttgcatttactgctcatttctacctttaatattccattttcctctgttaatattatatgctgtgaaacccaggagaagtcagcattactatggtcttgggtagaactgagagagataaagacatgaatttgaggctgttgggggatgagttgcagagaggcataaatacgaggcagaaaataagttatgagtgagaatacaacttattaatagcttttgtaaacttctggcaaaaaaagatattgaagataattagagttgaaaaattatatargacatcacttasgattgggattcaatcacattttatagaaaattcaaataagagttgcttaagcatgaaagaagttcagaggtaagtagctcagggcttgtatggcaactccatggtcacagggggcccaggttccttctcacattgttttctcccatccttggtgctggcttacatgccaaatgtctcctcatgaccacaagatgctcctggtgttcccagaccaaactgagggttgggctgctatttctcgtggcccaataacgagaagcagatgaactggggaggaagagtttttatttctgcaactggttatggggggaaggcctggaaattatcaccagaccaactcaaaattacagttttccagagcttatataccttctaagctatatgtctacgtgtaagtgtgcattcatctaaagacataagtgattaacttcttctaatctatagctaaggtctgagtcytgaagaccttcctctggagcctcagtaaatttacttaatctaaatgggtccagctgctggggtgattacccttattatgtctcctgcttaaatcacggaggtttggggagttccttcagacctccaataaacttgtttgtggaggtctggggagtttcttcagacccacaataaaactcgtttaatcctaaatgggtcctgttaagaattcctttgttattttgttatgctttaaggcccaggaaaagcctaggcaaaactcttggtgggctttygttacattccagcctttgtataagggcactggcttttttaacttttaatatttaacttaaccactcagtcagtactgaaacagttgttatggaggcctgcgttagtgagagctggcctgccacactggtgctccagctattatgtccacgttccaagatggaagaaagtataatggcaaaagtacctatctctcagctgaatcagtttgctttaaagggcttccttggcttccatccacttctgcttacacttccttgaacacctccagaaaccaaggaggttgggaaagctttaggctgaggacattatcactccaaataacatatttttaagtcaggaagtgggaagagtggatattgtgtaggcaactcacagtcccttccaccatagccgaccaggacagagatagctggatgatggtttgctctagttgagcctaaacaagctcatggctccctctccttaaactacttttatattttctttctctaagttcagagcaaagctttcatattattttatgaatgtttcttaacaagctcatcgtttctggtgttttgctgcaattctgcagtagatagtatggtatatttggtggacagattcagggccaccaggctttgaatagcagtggtgctacttagaagctgagaggttatgaaccttatatgcaaccatagggaatagtgttgttactataaataatgattgtactgaaccttatatgcaryagtgaataatgttattataaataatgattgtactgaaccttatatgcaacatagggaataatgttattataaataatgattttcagactgaggcagttttctaaaaattcaagtgaaagatcacattactttacatgaggaccacaaggcacattcaaaagatacggttgattcactttgttaaacaataagaatataagtgtccaaatacagaacaaaggaaataatatgtccaagaaacatttttctttgcttaatactaaaagcctcttgatctgtttcctatatcctagtcacaactgaattttaagaaagtcgaggtcatgttggtaactccatgtcaatactgctttktgtactaactgcaagatcaggaatcgtccctcattacttccatcttggctttcaaaagagcctactgtaattttttcttctgaaatagtatgaaataacttttttcctgaaagaaaatctcctttctatggttctttcttctgaaacaaggctttccttctctgagcttccagctagaataatttcctctgacatactctgatctaggaggattgtagtgtggtcacaatgcctcagctgatttcagttaattttcttgagctgaatcaaatgaatgtcttaacaagttgtcctttaaaaggatagacgtgcttttatacaaaacttgcatttaaatgaaaccactagacttcttcatacaatgtaatgaagtcttggtattccagcgatttggcayctaaatgcataggcactcagtaaatattggagggaaggaggatggtggaaagaaagaaagggggagcagggaaaattaggggggaaattattttttcttcctggggataggtttcatttttaattgggaaatgtaatgtgaaatgtattactttcaaacttgaggacccagaatataacttatgatgatttaagttttcttccttttatttacattttaatgataaagacactcattggccaagacccagaaaaaaagtttaaataaaaatttacattttaatgataaagacactcattggccaagacccagaaaaaatagtttacctatattttatacgtgtttgtttaaaaaaaaaaaacacaatctttgaaaaatctggagaatttatttcgggttataatagtcagaaaatgtgtgcctttaagttttgcttctgaatagacatattctgctaagcaagcaatctcctcttagactgcttgctgagcacatatactttcygtatgctgatttttaaagtgtctgtatttggttggtggctttagtaataagagactagcttttaacacagccagaagaagctgatgtgaaccascagaaataacactgatcatatataatacktatggaacagtggttgcccaccatttttgaacccaagatttcctgacatttatcactgtgccaacaaaaagaaaaactaggaacctggggaggacttagagagaggaagcatggacagctgccagcctgggcagatggcgtctgtttggttgagacagattcaccaggaaacaagatcagatcctagtttgagacccaaaacctggtgagtaagaacaagtgttcaggacttcaaggggcccagtaggcaattgtgggaaaaaatctggaggtcctgaacttgcccaaattacaggggtaggtgagaaaaggtaatccaaggggtaatatttttttctgctttttggtgttatctatattttctttaacaattatatatattacttaaaggaaaaaactctaggtcttatatattcctgactaagcttcatcaatatgtatttgcttcttttatacaaagtaacattgttttcatttacagattgccattaggataccttagtaatgatgtccagttatgatgcagatatttcaaagtttattgtttatttatttattattattttggaggcagggtcttactgtgttgcccaggcttgggtacagtggtgtgatcttggctcactgcagcctcgaccttccaggctcaagcagtcctcccatctcagcctcccaagtagctggaactacaggtgtgcaccaccatgcctgtctaatttttatattttttgtagagatggggtctcgccatgttgcccaggctggtcttgaacacctgggctcaagagatctgcccgcctcagcctccccaaatgctgggattataggcgtgagccaccgcaccaggcccaaagttaaaataacttamtgaataaggtttggatgatgtcaggtaccccttttttctcaggggaactggctcctacttagatatcttatgaccattagtgggacattataggatagcctagaaacagaaacactcacgtcagtgtgatttatggctaagctggcactcgacatcagtgggataggagggggtaatacattaaatggtgcatgggaaattgattattcgttcagaaaataattgaaatggatctgtacttcatttcatacacaaaaatcaatttcagggagattaagggacttaagttataaaaggcaaaactttgaaacttttggaaatagtataggagaatagctttatgaccttggaggagggaaggatttacaaatagtgttagctataaggcaaaggtttggtcattgagccatcttaaaatcaaggaaattacttcatcaaaagacatcgctaaaagagtgggagagaaaaaccacacactgggagaaaatatgtgccatacatatgtgtggcaggcacacctgacagcaacaaccgaagcataccctgagaatgaccctatggtctaagaagaatgtgtgtttggagttctcagctgaggaacctggtagtggccaacccggagactgattccttgtctatgaggaacatctgaacccccggcccatttcggattaaaggagggttgccaggtgaaggttgcaggaggggagctaagtaaaaatgctatataaactgcatactttttagaaacggtagtggttcgtccatccagcctgctaccactggaccgctgcatatgtaagtcccctcgagaagccctatatctcatttgccagctctcggtctcttctttggcctctcttctttggcctctcgaacctgtgctatccctatccaactcaataggggtctggcacaatarcatgtaactaacaattaggaaacagaaacctgtcttttagaatgtgggacttctcttcatcaaaagcactgtaaaatgagttaagaaacaacccataaatacttgaggaagatacttgccatacatgtaactgacaaattaataaaggaaaaaggtactctggagaaaaatgaacaaaagccytgaatagaaactacacagaagtggaaatgtgaggttgggcgtggtggctcacacctgtaatcccaacattttgggaggcctagacaggtggattgcttgagcccaggagtttgaggccagcctgggcaacatggtgaaaccccatctctacaaaaaatgcataaattaactgggtgtggtggcagacatctgtggtcccagctacttgggaggctgaggtgggaagattgcctgagcctgggaggtggaggttgcaatgagctgtgatcatgccattgcactctaacctgggcaacagaggagaccctgtcaaaaaaaaaaaaaaatgaaaatgtgaatggtcaataaaaatgtgaaactacttaacttcattagtaatcagggaaatgcaaatgagaagcaccaggtgatactgtttcacactctccggggcggccaaaatttttaagtcttaamaaacaaccctaacaatgtagagtcacaaacaggaatccttagacactgctggtggcagttgaattagtacagccactttggagaactctgcagccttgtcaggaagagttgaagctgtgtgtaatccacaacactgcccacactccacagcaatgcttctcaagcctggcataatatattagcatcccaaaatgagcatgttggaaatacttacacctggcccttaccccagacctgtgattctcaaatggtatgccaagatgccctggggaaccacagcaaactcacagaagacgatgggatatcttaaatgttcaakgggaatgcagtgatacttggcatctgttgaacgcagtgtgaattactagctcaagacacttcagttcagtctcaatgttaccccacgcatcatccctttctattatgcgaagctggattttcagtggttgctgtaacaaaaagcagatatcatgaaaatcagtatggaagaggaaataagggtgatagagtccaatatgattccaaagtttaagaagttgtatagtgcccaacgagtgcacacattccattaataagtaattgaggttatttaagaatgaaataaaacttttttctttggtattttcatacagatttttcaaacagctactgcattgttaggacaaaaaagacttgttaacttttttggacctaactacttaaatggaattgttaggaatttgttctaggggtgcctagaaccctgaaaaaattgagccacttagtagtgtcccttcaactgagaatatttgggaatctctttcccaaattarttaactcagaatggagatggaatctctatgtctttgtttttaaaaagctccccaagtgattctaatgggttcgtaaggttgagaaccactgcttgagagactcttgcacatgtgacttaggataatgctactcaaattgtacctgggggccagcgctggtttgcaaattatttcctacagatctgcagcaagtttatatgaatcatactttcagtgaataatggtacagtttttgtaatcttttgtcttctgattaaatttactgaaatataattttatgtcaaattttataatggaaaaattgaggcttgtactttgtgcttttttctcatatttttctaatatttatgattttacagctttgttgatgtataagtgatcaatttgcactctttaaatatgtgcaatatattatatgtcaattttgacatatgtatatacttgcgaaatcatcaacacaaccaagataatgaacatatccatgactctctaaagtattttctcatccctgtgtaatctctcccatttggccctccacatcccttcataatcctccactcctgtccccgccccagtgcaaccactcatctgcctgttgtcactatagattagtttgcattctctagcatttcatgtaaatggaatgttactgaatgtactcttgcttttgtctggcttcttttacttagcataatgttttgcaattcagccatgttgttggataygtcagtagtttactcctttttattgccgattagtattccattgtatggatatgccacaacttggttttttattcaccaattgwtggatatttgaaatgtttgcattttggctgctatgaacatttgtgtgtaaatctttatgtgatcacgtgctttcatttgtcttggataaataaatacctaggagtggaatggttggattgcatggtaggaatatgcatatagtaatttatttttattgcatttcacaaataaaaagcattagcccacaaggattagaaataaaactctcccaggccgggagcaggggctcatgcctgtaatcccagcactttgggaggctaaggtgggctgatcacctgatgwcaggagttcaaggccagcctggccaacaaggtgaaacctcatatccactaaaaatacaaaaattagctgggygtggtggtgcatgcctgtaatcccagctactcaggaggctgaggtaggagaatcacttgaacctgggagatggaggttgcagtgagccgagatcacgccactgcactccagcctgggagacagagcaagactccttctcaaaaaaaagaaagaaggaaagaaaactcttccttcagcaaatgtattttgaaaagtactagcctaagttaaatgcccaasagtgttcacagctacattgtttataatagcaaaagactggaaacaatccaatcatccattgtcaagagaatggattattaatatgaagtatatatccagtagactactttataacaatgaaaactacattgatgtagctgcagtttatctactacattaatgtagctgcagctacattaatcagaatgaataaacggaatttaaagttgagttccaaaagcaaattgcaaaagagtgcatatggaaggatttcatcatatgaaktttacaaacagtattttactacaatattaaatagcattttatttacagaaacatacatatatggtaaactataaagaaaatggtgatacaaaatgcaggatagtgtttacttggggagtggccraaggtacaatgagagagataggaccaaggaggacagacagaggcctttgaggctagtgggtcttggtcccgttcttaaactataggaattcattttaatgttacattttgtgtttatattttgtcataaattttttgtgcatattcaatatgtaaccacaaaatacaaaaaaactctctaaacagttgacaagggagtttattaagcaaatagaggtaccaattacaaaccatcagggttagaaaaaaaatccaggctttaagtaaatataaatctaagtaataggctattgactattatcttagaaaaacttggggtattacaccaggttatcacagaatatttagttragaagtatggaaaatatgatatgctatttatttgaatgatactcggtaggcatgtaatgtgatgattaaatcagttaagaatatgtgatagattttttttaaaaaaacatctcatttaaaatgcatgtcttttgtttttatgattattgaaaaatggttttcagaatacaaaatgagaatcaaaaattggtaattagatattctgtgtttctcaaatggayggactttataattgggtggagttatgttaaaagctagaaaaactgaagaagttaagaaagaattgaaaattcccattaagagaaaaaagaaaaagctgcaacctttgctaatataaaccgtaagagcctatgcctcttgaaatttctctgtgtttgtctttgtacatttttaatgacttaatgagaaaaaagattcatcaggactcctttcctagcaggaggtttartgtttcacaaatgagtagggagctgctctcataatgaggtaaacggccacctgattcttggataagtccaaggaaaacctttacaccagaggaagcaacagcttgccagtgttcaatctgagactttccaaggtcagaagagaggaggattggtattgatatttaataagcatttactgtgtccaaggcattttggtacgaattktatatctcttatctgatatccttgccttttaggactaggctgtttttacctttaaggtagatgttattattctcattttacacatgaggtaactgaaacatagaacttaaaaaccttgccaaacatttcagaggaggcagatttaaacccagatgcatttgcattaaaccccaatggatttgattccaaagcacgtcgtctttctgctaataatagccaacagtyattgagtacttactatatttataccaaggtctgttccaagtgatacatagattttctcttttaagcctcgtggcagtatgagaaagaagctattattatccccattttacagatgaaaaaatggagtcacagaatgttatgtaatttgcccaatgtcacacagtaagtggcagagttggtccacctcaggagcccacactcttaacctcttttggccttttatgagtacatctgccctttcaaggatcaggcttgagtctgtcagggaggcctcatgtctcctattaacttttgagccatacgcatcatggaaactggtttctcctggctgggtacttctgagttgcctggcctcctgtgagctcttcttttctaattgaatctactctctaagactctttgctgctggaatatgcagcagtagtttgagagacacttctcagtcagttctaacaygtttagctaggttcttcctattttttgtgcttcatcagatcatttgggctcagtgttttctttctttttatttttttctttttttttgagacagtatctcacgttgttgcccaggctgcagtgcagtggtgcaatctcagctcactgcaaccctgcctcctgggttcaagcgattctcctgcgattctcctgcctcagccttcagagtagctgggattacaagcacctgccatcacagccggctaatttttgtatttttaatagagatggggtttcactatgttggtcaggtggaccttaggtgatccacctgcctcagcctcccaaactgctgggattacagacgtgagccaccgcgcccagtctgggctcagtgtttttcagtggaataaggatgaatcattagaagagctttcatacctcttaaactctcaaattccatgccttaataaggatttttattaatacttcatttaaaacaaacagtaattaagcatcattttaaccatttgatgtgattataactcatatgctttctactccaaaaatatttgaagtagaagaaaccaatacaatgggataaacacaaaaaaatgcagaacaatgtagagaaaacagagataattatacaaaaccttaaggtattttcgttattgctgttgagcatttaatgctgaatttcctggcagctgaggcaacagaaaggtaattggtcagataatttttgttatatgttcaaataaagtaaactagttcattggggaggatagggtaccatgtcaggccactagccaacccttttcttcctacaagttaaattatatctgaatatcctctggagcactcagatcttaaaatactttagaagagactgtaaagaactgccagtgattgtctttaaagaggcgtcatggcagtgctgtaattcttgcttagcaacacttatatctaagctttcttctctgagggaaaggccaggttctaggtcactccctcactttgttccagtctctgcccaaaggtcacctcttccctgactgccctttctatatgaggttcccaccgaacgcatctgggttgccctctatccctgtccaacatagtagtcactagccatatatgacaattaaaattaattaaatgacaaaataaaaaattcagtactttggtcataccagccacatttcaaaagctcartagccatgtgtggcaactgggcatattggcaacacagatacgtcatcgcagaaagttccaytgggcactgctagcctatgctcttgccttaactttttcaacactatgccatgccatgcacctattgatttgtttatgttccactagaatacatgctctggatcacagagttttttttttttkttttcccagaacatagctgaatcctcagtgcctaaagcagtgcctgacatagtacagtgctttgtaaatacttgccgagtgaatgaacaacaaatgaatgaatgaattttagtattattttgcagtttcaaatcaaaastattttgtctaatgtccctgggtgacctagtacacgttctgccacagtttttgagatgaaagaacgaaaattctgtgatcaaagagaacattttaaagataaaatgatattaaatatactagtcaaaattttatttcttttatcttttatattatgaagaataatgggtacgaaatttctgtttatcaattaacgtatcatcctgaatatgaacacagaaaatatcaattttctttgcattaagaagtcatgtaagtagaaggagaaaacaaagtacttattacatagctaactggacttacagtcacatctaatttaaagcaaatttgctccatgcaatggaatatactaaaagtaatattgtgcaattatagctacagacatgataggaaatcataatacattctaaaagtatatagaaaaatgtcagtttacttcaacttattttaaacaaaaattacccatgaaatgattgcagtacctaaaaagaatttgcaatctgaacaaaatataactagaagcacgactaccctatatctcctataaatacagattgaagctagttttgtgatttcagccaaagatgcagcttcagtaaccttgaaaaacattgtttcctttctattgggcctggctttgtcaggagatactcaggaggtgatggtgaaaggaggtacctggtggagccagacgagtckggtaaatcagctttaacaagcagccagatgatagatgtcagttgggtgtcatgcccaattctagttgctgacaattaggaattagattaaaataggagtgttttctccttcaccctccctttcttaaaagcagccattttctgagtagtgttagttcttagttctcagtggatttgcaaatgcagatcatgaggcacctctagcttgggcaggattggtgttattttgctatttcaagtaaaaaacatgatggttagtgtccttggataacctcatatactttcattgtttttcaaatcaggtccagtgaagggccaagttcttcataaatatcatggctaattttggaaacccatatgttcagttaaggtttctgaaactggaataaatatgaatggaggatttatcaacatttggatatttgcaatttcaattcttgattcttttttgaaaatctattctgggtctayatctgaaatgtttatctcctttggtgctagatccagagtacaatttttgaaaactttaaatcaagggtggaacaataaattcacttgctcttaagactttaggggttgttttagctgccaagagagcattgcctgtgtgctgcgaaaaatacgagagccacagaatggccaaattattgcttttactcaggcagagtgaagaaaatggccctgtgacagacatttccagtttcctgtacatagaaatggggaaacagttgtgaaaaaaaaaaaaaagccagctggggttcttgacacacagttcatgctaattttaaattgtactaatacttgactatatagtgagggatcctttgcaggatgatgatctgttgaagactcagcaggccactgtggggagagggagagaggctgtcagaaccttcccctccagaggccttttaatggatactgaattcagaattgacctcacagaatctgatcattactgatgcaagagcaaagtcaacatcatctgcaaagataatttctcatctattcatgagtacctgtgcttatcaccacatctggaaatctgactactcaaataagaatttctgtcgagagactgaacaagccaggcaccaggaatattttactctgtatgtacagatggacatcgatactggaatatttctgtctcactgatgcttagggaccatcttttgattttgatccgtgtcaagattctaaggcagtttaactaagacatgggttttcagtgtttttttgtttttgtttttgttttaatttctgtttctgtgagtgtaatttagggaggagtaccagcttgttttttataagttgtttcttacaatgattaacacataatcttttctgccttaaggtttataacaaatgtgaaactaagtttcacaggttaattccagcctaatcttttcatagatgatagcgtagcccagaagcaatatgctgtgacattttattttattttatttttgagacagagtcttgctttgttgcccaggctggagtgcagtggcatgatctcggctcactgcaacctccatctcccagattcaagtgattctcctgcctcagccacccaagtagctgggattacaggcatgcacaagcacgcccagctaatctttgtattttaacagagacggggttttgccacgttggccagactggtttcgaacgcctgacctcaagtgatccaccacctcagcctcccaaagtgctgggattacaggcgtgagccaccgtgtccagcctaccgtgacattttaaatttcaaaatgtaataaaatcacaagttatgccagaaagccaccgtacttctcattgaatatagtatctccttggtgttcatgtccttatgttcttatataactctgtgtgccagtgtttcaccaaatctatcaactcttttaaggcagagactacatttatttattttttaactttttgtttgaaataacaaaactttctgataacttcagacttagaaaaaagttgccccaaaatactacactgattttcatgtacccttgatacagcttccccagatgttaccatcttacataatcatagtacagtgaaggaaacagaaattgacgttgatacaatagcatcactaactaacctaaataacttatttcagtttgccgattgtcctactagtgtcctttttaaagtccaggatccaatctagaatcccatacaacacttacttgtcacgtcttgttagtctcatctagtccggaggagtctttctataattttcacgacttaatacttttgaagagtcccgaccagtgattttgtacaatgtccccagtttgggtttgtctgatgttttcttaggataagaattagcttatgcatttttgacaacaataccactgaagtgatgttgtgcccttcccaatgttttttgttgttgttgtttttgtttttgttttggagaaggggtctccatctgttgccctgcctggagtgcagtggcacaatctcagctcactgcaacctccgtctctcgggttcaagtgattctcckgcctcagcctcccgtgtagctgggaccacaggcacacaccaccacgcctggctaatttttgtatttttagtacagacagggttttgccatgttggccaggctggtcttgaactcctgacctcagatgatctgtctcccacctctgtctcccaaaaagctgggattacagatgtgagccaccgcacccggcccccagtgtattatatgagagggtacatgatgtcagtatgtctcattgctgttgatctaagttttggtcacttagataatgtggtgtctaccaggtttctccactgcaaagttactgttcttcccattagaattaataagtactttgtggggagatgctttaagactctgcaaacatcctgtttctcatcatacttttgcccattaattttagatactattgatgattcttacctgtaacagttattagtgtttgctaaatgctgatatattttatttccatcattccttctatattattgtaattctactgtaaggaagagctgttctttcttctgctatttattgatttattatgttaatgtggatatataattagttactataatttttttctcaaaatatctcagatttggccattggaagccccttcagacaggctcctgtctccttttgacatrtcctcatyatcttttaaatgcatgttgtaactctggcatcacaagatgtgtctggcttattttgctccagccctagaatcagtaacttctccaaagaccctagttctttttactgtagactggtatttagaaacaaaatctgggtgctggatatgctcattgctactggtatatcattgcttctaggccctctcagcttacagtgctaggaaataatgtgtctgtatatccagacacatgtttctctctccctctctctccatatctatatgcctatgactatctacctattaaaaacaataagtttatctacttattaatacttccacttacaattcaataccactagtttccttttagatatctctttccttactcgtggctttttctccaacagttagaaacctggcattcattatctacaatatatttacttatttgctcaaccctagtatatatgtaaagaagtttcagaactgtgatttccataatctctatgagaaacaagtttaccaacaagactatatagcatccaggtgcagtcctttttgtctttagtcttaaggtatataataaaagtactggtttccaaaattaggttagatattttctttcttacctctttcatggtggctgttgttttttacttgtaatacagctaggttcttttgttactgttcgtgttccattttgggttcccccaacaccgagaggttggttttaattattctttattagggggatgtgaaacatgattattgttctcagagtcagaactctgtgaaaaggggccggtcgtggtggctcatgcctgtaatcccagcactctgggaggccaaggtggttgaatcacttgaggtcaggagtttgagaccagcctggccaacaaggtgaaaccccttctctactaaaaggacaaaaattagctgggcatggtgatgggcgtctgtaatcccagctacatgggaggctgaagtaggagaattgcttgaacccaggaggcagaggttgcagtgagccgagatcataccactgcattctatcctgggtggcaagctagactccatctcaaaargaaaaaagaaccatgtgaaaaggcatttcagaaaagtgtcattccacctcatcccttctgtcacgtttcagtctcccattcttcccatctaccccgtaagtgaccagtttagtttctacttttttcttctgtatttctttttgcacaaataaacaggcacatatatgttttcttatacagagatgatattcagtgtctttttttgtgtggtactgggcaatttaaatgctgtttggtaattttaactcttaaggatactgtttataattgatctgtccttaatgccaatgtattagaaagcacactaaatgattgttttcttttttgtaaaatatttgtgagattttttaaaaaatgaaggtgacatgaattttgatgggcttattaacactgaactatttcttgataagagttgtctaaaaaaatgagaacatatgccaggcgcggtggctyatgcctgtaatcccagaactttgggaggctgagacgggcggatcacaaggtcaggggatcgaaaccatcctggctaacaaggtgaaaccccgtctctactaaaaatacaaaaaaaaaattagccgggcgtgttggtgggcacctgtagtcccagctactcgggaggctgaggcaggagaatggcgtgaacccrggaggcggagcttgcagtgatccgagattgcaccactgccctccagcctgggcgacagagcgagactccgtctcaaaaaaaaaaaaaaaaaaaaaaaaaggagmacataaagcaagtaacaatgtttttcaagttttctttaaygcatyacatctttttttcacaagatattttaaaattttatttttccttattaagcgaattgaattatttcaagcatcagtgagagctgctagactgttatatttcgggggtcttgcrgrgtagcttttcttacacatataagcagaagaamacattttcccaagtcttaaaagwgggttatgatgcatttcaktgtgtactctttttcttcccatatactctgcaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggaggtaaataaacaaattccctatgagagatttgtgagagggagaaataagaaagttctctccatagcagagaggaataacacttttgttttaatcagaggagctgtattaagcacgaaactactaatactgagctagcaacttttcttttttagtgaaatgatagctagcttgttctgagatgagcttttctctcttttattgtttcttgaaaattaagttttgtatgtattgcggacttcggaattggccttactatttctgcaaaggtattttaaaaatacagtgaccttagcacttcctccctgcattagctggtttaatacaatgtggagaagaacggttggctgtaatgctctgtatctgcctgatttccagctgacagtggtgttggctcaggacactgctcatagggaatgacagcctaggcgagtgtcctgagaagtctttgagtctggtgatgcagatccccaaaggatttttctggttatagagaaggcagcaaattatggctggtatgaattaggtcagggagtctctcttgctctgtgagtgttgagcatccaccaaactcagtattccttgttagcttttccaaggcagcatcacctgccatatcattttcaaactggcagagtcatcctttagtggaggggtgatgttggaaacagagatagccaaaagtagcttcatccatcaaacccctgtaagaacatttttggaagctayattcaatcattcactccgtattttgatatgaaagctatagaagagacgcagacgtcctctaactcctacaccaatgcagtgatcattgacaggtccacaaccaagtgggctcactagttgagcattttagtgatagaaatatgtaggatgaaaatattcttcaatattgtaaagtataagacaagcaatccacatttgaaataagtgacatattacaaatagggcttcactattataagatataagttgtccagaatttattggaattttctagataatttacgtttacacatgtccatattacaatgaactaaatgaatactgacagcaaggtcacttatgagataaggtttacttatctcgttatctttggatatgcccaaatatagcaatatgacttgtgaagacagagaaaggatctaatgaagtggaagttagtgttgagtactaagaagaagaygagacagttttcaggataccaggacctcctcatttccctccaacgtgaacaactgttaaaaacagagctactctctggttccttctttctgagacagggtgtcactctattgcccaatctggagtgcagtggcacaatccagcatccattgcagaagtggacagagggtcatgtggagccaaagcccaccattctggattaaggaagtcaccaaacatttgcagggagcaacctcagcagccgtgagcagcagggtcatgtgcaagttggcagagaggatgtggcatgggcaacgtgaggaccgtgtgcacacgcatgcaggtggtttatggagaagaatgtgaccaatgagtcgagtattcttgatggccagttggatggatcctytgaaagctgcaatccccattgtgtgtagcagctgcagctgagccaagaacagccaaggttgaggatggggcagggaatccacagatgcttttctgtgtgagtcaacgtggtgatgattaatggagcatcctcacttacacagccacgcttgaaggcagttccaatgagtagatttatgatgcatggcagaagttaattaattaagcatgaagttacaagttaggaatgaatggaggcagcaaaagaaaaaaaatttgaggggcctttcattcagatcagttctcaaacttgaaggagcatctgaatcacctggagaactcatcagaccatgaacacggggccccctcgcagagattctgattcagtagatcgaggtaggacccaataatttgcatttctaacaagttcccaggtgatgtgggggctgctgctctggaaaccacatattaagaaccactaatttagattttttggcctgcccaaagctgaggaaggctcacaattgggacattgctataagcaccatgatctcctgaataaatcaattggttgtgattcttcaatttttatgcattttacatagtagatttgcagtaagagaataacttgttatatccacatttaggtatttttgatctaaaacagcttgaggcactttagcctatgaatgtgtttattcagatttgtcaggtaactaaaagaaaaaaaagatcttgtgtttctttgtcttctatgtgtgccaataatgtatttgttaatgttctttctgatgagtgagagctggtgatattactataaccctgagtttttgtttttgtttttaatccagcagatacattttattttgctgtacctaagagaattattattaacatttagagctaacataaaaggagaayaggaataaattctattttttggtgtattgatacacacttttaatggttggtattaagttgaaatctcagatttgatttccttttaggctcagttttattttttgtactataagcattaactgatgtacagtgattggaagagagatcatgtaacttagaacagttatgacatgatggaccatgagaaatatacaaggataaccaacccaaaatatagtaaatgatcagtttgacagatgctgtgtctctaagaacttaattaatgggataatttttctttactgaaaggactcatttcctgttttagtaggattgttggtcctggcaaaggtgtgtgtgcgtgcatatatgttgggtgcatcgtgaaagatttacccatgtgtgtgtgattacaatgtcaaattctcttccataaatagtagttacaggatagtatggtggaaaatggaaaaattgctgaattaggtattagaaaatcaatattctagtcagctctgctgaaagttttagtattaaattcatgatatttgtaaaatttatgttaagattatattgatatagagtacatacataaacataagcaattatcattaataatgttctgcatactccaaaaatatcattgacgatatgactcattatgtagatctatattcttagggtaaagaaacatgagataaatatctctgaatttatcacctcaaaaattctttctcttgtgatatgaatcaggcagtagaattacacatttttatttctgccttgactgttaagaagctctgcggctatgcttaagtataaaaaaactaacctagatttttttcatctaattctcacttttaaacgttttgattagccttattgtatatatgtttttaatggtaaactgctttaaataattttatatactatactacaaggctacagtaaccaaaacagcatggtactggtaccaaaacagagatatagatcaatggaacagaacagagcccttagaaataatgccacatatctacaactatctgatctttgacaaacctgagaaaaacaagcaatgggtaaaggattccctatttaataaatggtgctgggaaaactggctagccatatgtagaaagctgaaactggatcccttccttacaccttatacaaaaactaattcaagatggattaaagacttaaacgttagacctaaaaccataaaaaccctagaagaaaacctagccattaccattcaggacataggcatgggcaaggacttcatgtataaaacaccaaaagcaatggcaacaaaagacaamattgacaaatgggatctaattaaactaaagagcttctgcacagcaaaagaaactaccatcagagtgaacaggcaatctacaaaatgggagaaaattttygcaacctactcatctgacaaagggctgatatccagaatctgcaatgaactcaaacaaatttacaagaaaaaaaccaacaaccccgtcaaaaagtgggcgaaggacatgaacagacacttctcagaagaagacatttatgcagccaaaaaacacatgaaaaaatgctcaccatcactggccatcagagaaatgcaaatcaaaaccacaatgagataccatctcacaccaattagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggattataaatcatgctgctataaagacacatgcacacgtatgtttattgcggcattactcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctccgtaaactattgcaagaacaaaaaaccaaacaccgcatattctcactcataggtgggaattgaacaatgagaacacatggacacaggaaggggaacatcacactctggggactgttgtggggtggggggagggggagggatatctttaggagatacacctaatgctaaatgacgagttaatgggtgcagcacaccagcatggcacatgtatacatatgtaactaacctgcacattgtgcacatgtgccctaaaactttaagtataataataataaaattaaaaattaaaaaatttaaaaaaaaatgtaaaatgcttccaacagtgcctgacatgtggcaaaacaaattaataaacgttatctgtatcacaaaaaataaaaaaataaataaataaataaataaaaataaataaaaataattttataggccgggcatggtggctcatgcctgtaatcccagccctttgggaggccgaggcggctggatcacaaggtcgtgagttcaagatcagcctggccaagatggtgaaatcccgtctctactaaaaatacaaaaaatttagctgggtgtggtggtgggtgcctgtccctagmtgcttgggagtttgaggcagagaattgcttgaacccgggaggcagaggttgcagtgagccaagattgcgccactgtactccagcctggygacagagcgagactctgtctcaaaaaataataatgataataataataattttataaaatacagggagtataaasaaaaactgatcacccaaattggagaaccaaattaatagttaatcttaacctaattaggagttaatcctacagggccaataataggcagagtgaagaaatctctgagttctcttgacccagcattatttttggtaagagcataaagaaagcagattgctataggatttaaatagatatttagtaaacaagtttgaatttcattttttctatcttcaacctgtaggtatamtatactagaagatagcctaaaatttgggtaatatttacttttatacttatttatactaaactaaactaaaatccacattaatgaaatcataaaataggataatgaaacttaatactacttaattctcccaattactagctaatgtctcaaatataagatatgttagaattaactgcaatatttacaaagtatacaaagcaattatgcagcattcctaaccagaattggtatatatgggataaaaagatgtcacataagataggccccttcaggtggaatgcagaagattggagttatcaaatgaattatcgaccttagtagagattaagcctataatttaaagtgaaaataacaacatttattgagtgccagacactgttctaaataccttacgtgccttaactgctgaatctttctaacaaccctactgaggcagttcctattatattatacccctattttactgatggggcacgtggatcaaagagaggtcagatcatttgtccagagcacatgggtaccaagtgacaggccatgatctgaactcaggaacactggctctgatgtgccattctttgccatgtcaccgtagctgccaagagcataggtttccctcttccgaaccctgcctcaagcaatgaaatttctagaaaagtatatgaagttttaatacgatagctgctatggtctgaatgtgccccttttaaattcatgcactgaaacttaatcatcaatgtgataatattaagaagtcgggcccttaggaggtgaatgagattagygagtttatatgagggctggagggagctagctaggccttttgrcccttttgtcctttccagcgtatgaggacaaggcattcatcctctccggaggacacagcaacaaggtgccatcttggacgcagagagcagctctcaccagacactgaacctgccagcaccttaatcttagatcttcagcctccagaactgtgatcaataaatttgtgtgtttttawaaattctaatgcaaggtttcttctataaggttattttgtctatgttgaaaatctatgttttagtttagtttacctttatcaatgatcttagctagatctgctggatcacttgctgcattcagttaaagacatcagcacttgctacttcaccttgcactttatgttatggagatggcttctttccttcgacctcataaactaacctctgctggtttcaaacttttcttttgcagcattctcacctctctcagccttcatagaattgaagagaggcatccgggtgtggtagctcacgcctgtaattccagcactttgggaggccaaggcaagtggaccatctgaggtcaagagttcgagaccaggctggccaacatggtgaaaccccgtctctactaaaaatacaaaaattagctgggcatggtggcgaatgcccgtagtcccagctactcgggaggctgaggcggagaatcgcttgaacgtgagaggcaggtgttgcagtgagccaagatcgcgccactgcactggagcctgagtaacagaaagagactttgtctcaawaaaaaaaaaaaaaaaaagaatcaaagagagcccttgctctggattaggctttggctggtttgatcttctatccagacctttcttcatgtcagaaatgagactgtttcgctttcttatcattcatgtgtcaatggagtagcacttttaattttcttcaagaacttttcctttgcattcacaatttggctaacttagctaacttaacttggctaatttggcatatgcttaatcatttcttcctttccttgaaagtacgattctttcacttggacactttgaggccactgtggggttactaattggcctaatttcaatattgtcttatgtcagggaataggaaggcccaaggagaaagagatggggaatggctggtcagtggagtagtcagaacacacatgtttatgggttaagtttgctgtcttatatggatgtggttcatgtcaatataacagataaaataataatgaaaaagcttgaaatattgcaagaattaccaaaatgtgacacagacacacaaagtgagcacatttaatgtatccagtaaaaaccaaagtgtttcttacagtctctgatgtttccttctgagtaattggtcattgggagctgtggttacacatagctgagtgaagcggacacttctgtgaaggcatggcttggctctwgctgggaagttttctgtttcctggcctgttcctgtctctcttctcctctccatacttgttgggaatggacctcatacctctctggaatgatgcagtgcaccaaacagtgaagaactgttgttgtttttaactgatttacataactgataataatatcatagctaacatttattgagctcaccatatgccaggtatgaagcttagcactttactacgttcattattgcatttaattctctcaacaaacttgcagcgcatatgcgattccacaggagagagctctatttcttttggttgaaaagttctttctaatacttgctgagctacagtaaacaaatatgtctattaatgccattgggaatttggaagcaaagtcttaacaaaatatagacaattcatttttgaataattgtgatttgattatgcttttggggaatatcagattaacaaagtgggtttgtttgtaaggattagtttgcaattcaggctcatagaatttttgtgtgtgtgtatacagttgtatcgattttattttattgagatggagtcttgctctgtcacccaggctggagtgcagtgttgcaatctcggctcactgcaacatccacctcccagattcaagcgattctcctgcctcagcctcctgagtagctaggattacaggtgtgcaccactacacttggctaaattttgtatttttaatagagacggggtttcactatgttggccaggctgatctcgaactcctgacctcaagtgatccactcactaaagtgttggggttacaagtgtgagtcactgcgcctggccagttccatgaattttaacttgtaaatagattcatatagccacagccactatcaggaggtagaccagtttcaccacttcagaaatctcccttggtcagtgctactctttgtagtcagagccactcccacctcagcctctgataaccaatgatctattctctattactatagttttgttttatttttttcttttcaggaatgtcatataagtggaataaaacagtatgtaaccttttgagattgggtccttcagcatgatgccttggagattcatataagttgttacatgtgtcaatagtttgttcctttttattgctgagtattattccactgtatagatacattgtggttgcattaatcagttcacctactgaagaacatgagttattttcagattttggtgattataactagagcttctataagcattcatgtacacttacgttttcgtgaagttttcatttttctagagtaaatacttaagagagtgggratactaggtcatatggtaagtgtatggttaagttttccagagcagctgtaccattttgctttcccactagcaatgtgtaaaagttcctgttgcccctattctttccagcccttggtatttgacagttctttttttctgtttttttttttttttttttwaracggagttttgctcttgtccaggctggagttcaatggcatgatctcagctcactgcaacctccaccttccgggttcaagkgattttcctgccttagcctcccgagtagctgggattacaggcacctacaaccacacccggctaattttttgtatttttagtagagacgaggtttcgccatgttgaccaggctggtctcaaactcctggcctcaggtgatccacccacctcggcctcccaaaatgctgagatttcaggcgtgagccaccacgcctggccttgacagtatttttaaaattttagcaactctaataggtgtgtagtgatatctcattatggttttaatttgcatttcactattgactaagaatattgaacatcttttcatgtgcttgtttgccttccatatattctctttggcatagtgtcttttcaagacttttgcccatttttaattgggtgtttcttttcctaggtaagtttttttgttttgttttgtttgtttgctttgagacggagtctcgctctgtcacccatgctggaatgtagtggcatgatctcggctcactgcagcctccacctcctgggttcaagcgattctcctgcctcagcctcctgagtagctgggactacaggcacatgccaccatgcctggctaatttttgtatttttagtagagacagggtttcaccatgttggtcagctggtctcaaactcctgacctcaggtgatccacctgtctcrgcctcccaaagtgcttggattacaggcgttagccatcacacctgacctatttttaaattttatattaatatattaactggatttttgtcaaatagagaattmtctttaaataaccatctcctcacttcacacttagtctgggaaaaaatgagagcaaatttctgtgcatccagggagcatatcaccaaccaggcatgaagcttaaagggagagtgcaggctgagtggccagcaggccatgggcatcccacagggccaggccaggacccaggcttcagcgacccttctcccagcccacctagtggccctcaaatccatgatgggacagacatgcattctcctgtcccagttgagaagccccttctagatggaagggagaggagaaaagccataggaaagaaatcccagaaacactagcaggtaagtacaggggcttcctccccagctgcggtgaccttgctcctgataacacccaacccctggagctcttcgccagtgtgcctggggctggagcctggcggggaagggaatgtgggctcacagtttctggatgttggcctcccacagcttggcacagaccaggggaaggcatgtgaggagggcctggggaggtcctcggggaagataacacagctcaggaggttgagtgtaaagtggctgccagaccaagggagctggatggactgtgaaggaggaggtggctggagagcctcctccatgtaaagctactagagcaaaaatagaacaaggggggacacccgtgccccagaggacagccctaaagatggtaacggggagcacggctgagcagcgccctggattctgagctagtgtggaaagctgggggccaggggcctctctcttccttcatcaccagttgctggtaactttacagtcagatttggaggaggaacaaggccctccatcgcctcccctagcctctgatgctgccccaaggggaggggtaagaatgggcaaagagggtgggaaacagggaggtgggagggagtctactgggtcttcttattttcagaggagggggctgtaatagtgtagtggcagaggctggttcctaggtatgtaggtgttgtgtgggttgcctggcactgacaactgcttctgtggctctggctttggctgccagagcagaggggccaatggggccactgaccagaggttccatgagcccagatagggcagtggcagggattgcaggcatcccatagctccatccatcatgggaggtcctggatagaactcagatggggactgtggattggggtagccaggagggcaaaggtacattccattggcaactggcagaggaaagacataggctctgttgggtatgtaagagtacccgtagcctccattgggggcctcgcccctggaggcttgaaatgccacctggagcattcattgtccaaactgctgtaaggttaacttgtatgaaccccagccctcccagccatctcccgcttcacccttcactgttcttttgaagtagttggcagcaaacaggctagttgatctcacagtccttcatcaggtgaaaaggcatcacgaaggcttcatggagttcttcttcttggacagaaagatgatcggtaaggggtaaggtagacgatgcctttcttggtccctttgaaggactctggcacattcttcttgtcattgaatgtaagttccacatggacgtaggacattaggatgttcttggtgttcttgatcactctgccaccctttgagtgattcttgttgagcacgatagtctcttggaaaggggtcctaagactctcgatgcagggccttgagttcgtttttgcataaaggagttggtttagattgaggttcctttttttggcatataaatgtccaattgtccatttgttgaaaagactactctttctccattgacttgcctttgcacttttgtcaaaatttattggccatgtttgtgtaggtctatttctggaatctgtattctgctctattgatctgtgtgtctatcctttcaccaatacacactgtcatgaagtcagagaggtaacaggaagccagatcatgtagggccttgtagaccattgaaaggatttaggcttttatcttgagtgaaatgaggagctacaggaaggtgctgggcaaaggaggaacctgactttattgaggcaaggataggaatgtgaggttactgcagtcatccagatatgcaaaaatggtggattggaccaggatgatgggtagaagtggtgaaaagtagtcatattctgaataatttttgagagtagccccaatgggattttctaatgggttgaatgtagagaatgagagataggcatgagaaaagaactctagtctgagggtttagcttgaccaacgtgaaaaatggagttatcaattgagatgggaaaaccttcaaatgaagcacattttaggaaggaaggtcagaagttcagtttcgaacatgttaagttttaaatttctattagaggtccacctgtggatgttgagtgaatagtgggtgataagggctaagagcttgggagagaggtctgggaatggaggtatacattttggatcctggcggggcacctgggatcacgcctgtaatcccagcactttgggaggctgaggcgagcggattacttgaggccaggagtttgagacgagcctggctaacatgacaaaaccccatctgtactaaaaatacaaaaaattagccgggcgtggtggtgcatgcctataatcccagccactcaggaggctgaagcaagagaattgcttgaacccgggaggtggaggttgcagtgagccgagattgtgccactgcactccagtcttggcgacagagcaagactctgtctcaaaacaaaaacaaaaacaaaaaatttttggatccatcagtagatagatgctatgtaaggccatggcattggtgaaatcaccaagggcagatatgtagagagaaaagggcaagcactgagccctgggtcactgcagcattgagaggtgggggacaaaaaaagaaactggtaaaggagactaaaaaatagtagtgaggtagaaagaaggtagacaatgctttctgagagccaaataagaaaatgatatccaggaagtaaatgatcaacagtgcggatgctgctaataagtcaaacaagacgaggacatatattgaccattgggtttacgaacaaggggtcattggtcacctcagtgagagaagtttccatagagtgttgggagaaaaaggctgaggatagtaagtttaagagagaataaaaggagaggaattgcaggcagagaatagaagcgtttttcatggagtctgtttgcaaataggaccaaagaaatgaggaggtagctaggggacgagatgggctcacgtgcaagttgttgggttttattcctttttaagatggaagaaataacatttgtgaatgctaatggccatgaccccataaagtgggaaattttaatgatgtaagaaggaaagagaagaaagcctagagcaattgatttccttgagtaaaggagaaarggatggaatctagtacaaaaatggagggattgcccttagaaggagctagaaaatttaatatatggtaacacttggaaaagcagaatatgtggatgtggatgccagcatatgggtagatagatgtgagtgaagcaagtcctcttcagtctgcttccatctcctcactgcggtggaagcaaggtcagcagctgagagggaaggtaggggaggggctgagatttgaagggacaaaagtgggcgataatcacctgggagagtgaaccgtaggagtcatgggagtgagtgcctgccataggagagaagatccctcaaaaagaggaattcagggctggatgcagtggctcctgcctgtaatcctagcaccttaggrggctgagatggaaggattgcttgagcccaggaggtcaggactgcagtgagccaaggtcacaccactgcactccagtctaggcaacagaatgagaccctgtctcaaataaataaataaataaataaataaataaataaataaataagyaarcaaataaataaataggaattcaagaattgagatcatctgtgtgggtattgagaatgccaggaattaagaccagaaattctagagatgatggcaatggcaatgagaaatgaaggggaatgagttggtgtttgctacrtaacagtaacagtgctggatagcggatgatagaatctgatgacatgaggtttaaagcacagaatttttagagaggagagaaggagaatgctctgaaagcagccacgtggagcaaaagcggcgtctgtctcacctcacyttccagccatgtggagcaaaaggggcatctgtctcaggcccagtggcatgggagtgaaatagcacttcagagagttgcaggggaaacagtgtccccaagggagagtcaggtttctgttaaaggaaggtgcattatgcacatctgtgaaattatcatgactgctgtcatcccatctgctcatagaaccagtgaatattgattggtcataaaatgcaagcattattttaaggagcatggacatttaatttctcttttaaggactggaaataattttttccatgatttggaaagtgatattatatttgtcaatgagaaataatgtaatagctttttaatagttcacaaaatgatgtcasttgctctytattcaaaaatatctttagcctttttgaggttattttggggagatgataaggacaggcatctccataatcccaaatatttgggagaaaacttcaaaaattaaagcgtatttaggctgagcatggtgactcatgcctgtaatcccagcactttgggaggtcaaggtgagtggatcacttaaacccaagagtttgagaccatcctgggcaacatggcgaaactctgtctctacaaaaaatacaaaaattagcagggcatggtggcrtgtgcctgtagtcccagatactcgggaggttgaggctgcagtgagctgtgatcataccactgcactccagcctgggtgacagaacaagaccctgccccctaccccctcctccaaaaaaagcatatttaaatattcccrgaatccaaatgttgaacatcatttggacacagcttcaaaatggtaccaattcttttaatttgtgactgctttatttatttatttatttatttatttatttatttwtttattattatactttaagttttagggtacatgtgcacattgtgcagattagttacatacgtatacatgtgccatgctggtgcgctgcacccactaactcatcatctagcattaggtatatcccccaatgctatccttcccccctccccccaccccacaacagtccccagagtggggttccccttcctgtgtccatgtgatctcattgttcaattcccacctatgagtgagaatatgcagtgtttgtttttttgttcttgtgatagtttactgagaatgatggtttccaatttcatccatgtccctacaaaggacatgaactcatcattttttatggctgcatagtattccatggtgtatgtgtgccacattttcttaatccagtctatcattgttggacatttgggttggttccaagtctttgctattgtgaataatgccgcaataaacatacgtgtgcatgtgtctttatagcagcctgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgaytgccattctaactggtgtgagatggtatctcactgtggttttgatttgcatttctctgatggccagtgatggtgagcattttttcatgtgttttttggctgcataaatgtcttcttctgagaagtgtctgttcatgtccttcacctactttttgatggggttgtttgtttttttcttgtaaatttgtttgagttcattgyagattctggatatcagccctttgtcagatgagtaggttgcraaaattttctcccattytgtaggttgcctgttcactctgatggtagtttcttttgctgtgcagaagctctttagtttaattagatcccatttgtcaatkttgtcttttgttgccattgcttttggtgttttatacatgaagtccttgcccatgcctatgtcctgaatggtaatggctaggttttcttctagggtttttatggttttaggtcaaacgtttaagtctttaatccatcttgaattgatttttgtataaggtgtaaggaagggatccagtttcagctttctacatatggctagccagttttcccagcaccatttattaaatagggaatcctttccccatgactgctttatttctgcattagacaataagaaggggccgaaacttctggcctgatatgacagtgacatcaacctcttgtgtagtagcctgtcattaagccagcgccaaatggaaaattaaatggaaaatggcagagagcattgcccaggacataatgtagaaatggcaactctggcactgacataggtttaaaaaaattatgttttaaaagtaatcttgctgggaggccaaggcgggcatatcacttgaggtcaagaattcgagaccagcctggccaatatggtgaaaccccatcgctactaaaaatacaaaagttatgttggcatggtggcgggcacatgtaaccccrgctactctggaggctgagacaagagaatcgcttgaacccaggaggaggaggttgcagtaagctgagattgtgccattgcactccagcctggatgacagagcaagagtctgtctttaaaaaaaaaaaaaaaaaaagtargcttacacatattccctttactgtttttcaaggtcattacatttttatctgttattgttcaccatttaaaaataagcagtggaaagcagcctactttttaaaatgcggaactcgtatggtgtacttagcatatatataaggatttctgtcctctctcttgcctccctccctcccgttcttcccccttcctcctccttccttccttccttccctccctccctcccctttcctatcttctgagtagggtcaaacaccagttctctacttctyggaccataagaataaagatctgtgcacaatccattttgtacatattgattcttggactaaaaatagctcaatttggtttcaaactttttctcccaccctaagttcaggttttgttccttgtgcagcctggtaggcgggcaagtaatgcatagtcagcattccatctgggatgcttactggacaattttaatcttttttttacgtcttgacctctatttccaaagagcatcccagttggcaggtctagcctgattaagattctgttcaggcatttaattctcctaagggaatttacagattaatctaaaaatcaaggataccagaatctactcaggacttaacttcttgaaggttataggaaacatatacttgagcaacctaatgaatgagcttagtgatatcgtaatgaatttttatatatacctcaaattacactttttaatgcatatccaacaaaaatatttttaaaaacaaatactgtagacctaactggattagctgtattagtagatccaaatttaactttcaatttgaattaagttagaacactatggatctcataaggcaggctatatattgattacctagttagccagcttccatatcaccacttgttcaggaacattaaaagtacttttttagaaatagttttctgatatatttttggtttcactaagacagctttttaaaaagcaaaattaggcagggcgtggtggctcacgcctgtaatcccagcactttgggaggccgaggcgggcagatcaccggaggtcgggggttcaagaccagcctgatcaacatggagaaaccccatctctactaaaaatacaaaattagccaggtgtggtggctcatgcctgtaatcccagctacttgggaagctgaggcaggaaatcacttgaacctgggaggcggaggttgtggggagccaagatcgcaccactgcgctttagcctgggcaacaagagcaaaactccgtctcaaaaaaaaaaaaagaaagaaagaaagaaagaaagaaaagcagaattataactaaacaccactttttttttctttctttttttttttttttttctggagttagagtctctcactctgttgcccaggctggagtgcagtggcacaattttggcttgctgcaacctccacctcctgagtggaggttactcaggcaatcctccwgcctcagcttcctgagtagctgggactacagccatgtgccatcacacctgaataatttttatattttttgtagagacaggatcaccccatgttgcccaggctggtctcaaactcttgggctcaagcagtctgcctgcctcagcctcccaaagtgctgggattacaggtgtgagccactgttgccagcctaaacatctcgtctgaggctatcacaatatatactattctccagcctacagtagattatagacatctagaatataaaaatttgtttcctgataggcttggcacacaatattcctacagtcctttgaaaacacacatattaacagagtgacaatatttacaggcagaattactcatgtgtcttattgtagcttacaggagagtgtgtctgtctaagaatggggtagaggttggtttgtaaaaacaggtgtcccacaagctttcttggatagttaactcagtagttagaatgaaggatgtaaaataacctgtcaggataacacctgctctcttgccctcaacaattaatgataatgaaactaggcctgaagaggaataaaaatcttgtatcatctttgaattagtcttttgttggtcgtgcgttccaatgaaatgatgtttcacaaccttttcttcattatcatctctgaaaagatcctttatggctatttttttttcctagttgccacaaaattaaacacaggcatactgtgtcttactgtgctttgctttcttgctcttggaagatattgtgggktttttttttacaaattgaaggtttgtggcacccctacattgagcaagtctactgggaccattttcttttcaacagcatatgctccttttatgactgtgtcacattttggtaattcttacagtatttcaaactttttcttttctttttttttttttttttagacagagtctcgatcagccacccaggctggagtgcagtggtgcgatcttggctcactgcaacctccgcctcccaggttcaagtgattctcctgcctcagcctcccaagtagctgggactataggtgcatgccaccacacccagctaatttttttgtatttttagtagagacagggtttcaccatgttggccagactggtctcgatctcttgacctcgtgatctgccctcggcctcccaaagtgctgggattacaggcgtgagccactgcgcctggcccaaactttttcattattgttatatctgttatggtgatctgtgatcactgtctttggtgttactattgtaattgtttggggatggcctgaactgcatccatataacacttaattgaggccaggtgtggtagttcacgcctgtaatcccagcactttgggaggctgaggtgggcagatcgtgaggtcaggaattcgagatcagcctggccaacatagtgaaaccccatctctactaaaaatacaaaaaaattagctgggtgtggtgacgcacacctgtagtcccagctacttgggaggctgaggcaggagaatcgcttgaactggggaggcggaggttgcagtgagccaagatcatgccactgcactctagcctcagtgatagagcaagactccatctcaaataataataataataaagacttaattgatacttaatccataaatgttgtatgtgttctgagtgctccacccaccagctatttcccatctttctcctcctcctcagacctccctattccatgagacacaacaatattgaaattaggccaactaatagccctacaatggcttctacatgttcaagagaaaggaggagttgcacatctctcactttaaatcaaaacatagaaatgattatgcttagtgaggaaggcatgttgaaagcctagataggtcaaaagctaggcctattgtgccaaacagccaaactgtgaatgcaaaggaaaagttcttgaaggaaatgaggagtgctattctgttgaacacacaaatgataagaaagtgaaacagcctcattgccgatatgcagaaaatttgagtggttctagatagaagatcaaaccagccataacattcctttaagccaaagtctaattcttttttttttttttttttttttttcagagtcttgctctgtygcccaggctggagtgcattggcacaatctcggctcactgcaagctctgcctcctgggttcacgccattctcctgcctcagcctcccatgtagctgggactactggtgcccgccaccacacccggctaatttttttgtatttttaatagagacagggtttcaccatgttagccaggatggtctcgatctgatctcctgaccttgtgatctgcccgcctcggcctcccaaagtgctgggattacaggtgtgagccactgtgcttggccaccaaaccctaattcagagcaaggccctaactcccttcaattcactgaaggctgagaaaggtgaggaacttgcagaaggaaagcttgaagccaatgggttggttcatgaggtttaaggaaagacaccatcttcataacataaaagggcaagtaaacagcaagtgctgatagagaagctgcagtaagttatccagaagatctagctgagatcattggtaaagctggcttcaccaaataacaaatcttcaaatgtagatgaaacgactttgtattggaagaagatgccttcaggctaggactttcatagctggagaggagaagtcaatgcttcaaagtttcaagggacaggcttttgtcccttgggctcttgttaggggctaatacagcttgtgactttgagttgaaggcaatgctcattgaacattctaaaaatcctagggcccttaagaatgatactaaatgtactctacttgtactctattaatgaaacaacaaagtctgaatgacagcacgtctgtttatagagtggtttatcaaacgtttaaagcctgctgttgagayctaccactcagaaaaaaaggttcctttcaaaatattactgctcattgacagtgtacctggtcacccaagagctctgaaagtataaggagatgactgttgttttcatacctgctaacacaacatccactgggcagccaatggatccaggagtcattttgactttcaagtcttattatataagaaatacattttataaagatatagctgctgtagatagtgattcctctgatggatctgggcaaagtctattgaaaaccttctggaaaggattcacmattctagatactgttgggaggaggtcaaattatcaacatgaacaggagtttcgaagaagttgattccaaacctcatggtgactttgagggctttaagacttcagtagagcaggctgggcatggtggcctataattccagccctttggaaggctgaagmgggtggatcacaagcatagagttcaagaccagcctgggcaacacagtgagacccccatctcctaaaaaggatttttttttaagacttcagtagaggaagtactcgtaaatatggtggaaatagcaagagaactagcattaagaatgaagcttaaagatgtgactgaattgctgtaatctcatgataaaacttgaatggatgaggagttgcttcttatggatgagcaaaggaaatgatttcttgggagggaatctattcctggagaagacactgtgaaagttgtcgaaatgacaccataggatttagaatatcccataaacttagctgataaagcaggggcaggctttgagaggatcgactgcaattttgaaagaagttgtaccrtgagtaaaatgygatcaaacagcattgcatgcttcagagaaatctttcttcacaaaaggaacaattggtgcagcaaaattaattttcttattttaagaaattgtcagccgggtgtggtggctcacgcctgtaatcccagcactttgggaggccaaggtgggcagatcacctaaggtcaggagtttaagaccagcctggctaacatgctgaaaccccatttctactaaaaatacaaaaaattagccgggcatggtggcacgcctgtaatcccagctacttgggaggctgaggcaggagaatcgattgaacccgggaggtggaggttgcagtgagccgagatcgcgccattgcactccagcttgggcaacaagagcaaaactctgtctcaaaaaaaaaaaaaaaaaaaaggctgggcgcagtggctcacgcctgtaatcccagcactttgggaggccgaggcaggtggatcatgaggtcaggagatcaagaccgtgctggctaacatggcgaaaccccgtctctactaaaaatacaaaaaaattagctgggcgtggtggcaggtgcctgtagtcccagctacttgggaggctgaggcaggagaatggcgtgaacctggcaggcggaggttgcagtgagtcaagattgcaccactgcactgtagcctgggtgacagagtcagactccgtctcaaaaaaaaaaaaaaaaaaagaaaagaaaggaaattgttggccgggcgctgtggcttacgcctgtaatcccagcactttgggaggccgaggcaggcggatcatctgaggtcaggagtttgagaccagcctgatcaacatggagaaaccctgtctctactaaaaatacaaaatgagccgggcgtggtggcgcatgtttgtaatcccagctactcgagaggctgaggcaggagaatcacttgaacccaggaggcagaggttgcagtgagccgagagcgcaccattgcactccagtgcagtggagtgcagtggtgcgatctcggctcacgatcgttagcgttttttaacactcaagtgtttttggttttgttttttgagttggagttttgctcttgttgcccagcctggagtgcaacaagagctggcatgatctcagctcactgcaacctctacctcctgggttcaagtgattctcctgcctcagcctcccaagcagctgggattacaggcatgcaccaccacacccggctaattttgtatttttagtagagatggggtttcaccatgttggtcaggctggtctcaaactcccaacctcaagtgatctgcccgcctcatcctcccaaagtgctgggattacaggcatgagccaccatgcctggcccactcaagcattttttaattaaggtatgtattttttagatatggtattgaacacttaagagactacagtatagtgtaaacataacttttgtatgcactagaaaataaaaatttcatgtgactcacttttttgagatatttgctttattgcagtggtctgaaaccaaacctgtaatatctccaagatatgcctgtactgaagagtaagattttgtcagttagagtttaatcttggaaagactacaaaccactgtaataacctaagcattatttgattccccaaggaccaattttcacccctttgggggccatattaattttttatggctgctataccaaagtactatgaattttatggctgaaaacagcacgaacttattcccttgtagttctagaggccggaaatgcagttcactgggggtaatgtcaaggtgtagggccatacccccaggaaggctctggggaagcgtacatttcctcttccagcttccatctttttctggcttccagacttgcattctgtgtgttcactgactcatgtctgcttcctccatctttcaaagccagcagccgtgtagcatcttgtttcaatgtcacgttgcctttttcttctgtcaagtctccctctgcctgcctctcatgaggacagtgtgattacacttagggtctaccttgctaattccggataatctctgcatctcaaaatccttaatttaatcgtatctgcaaagcttgtgttaccatataaggtaagagtcacaggttcccaggattaggaactggatatctttggggaccaatactcagccacagaggtgataccactccccaccccttaaaaatgcatgttctacaccagtaaggaagaaagaaaataagaaagaagagtaaaagataataaatatgtaactttggctacaaatgaattctttattatatctcattctatttggggcacttgctattagaacaaagagagaagatatatttaaaattaataggattcagaagagtagagttgatgatgttcacctcattgcgatgtactcacccattcatttattttgcattacccttcctgcctggggccagtcagcagaggagggcagtgagtcactccaaggtcagacagtattattaccctcttattgtgatgggcaaatccaccattaagcttcagattgagagaaacaccattgagttggcaaatgctttcgatgtgtacgtgcagaaagtcatatgtatctacaattttccagacagyggcaaagagaaatggaaactctgtgctgtattttaattggctgcaaaatgtttccttcagaaattaccattccattaagcacctactctgtgcaaacgctttgcaaacactgctgggaatagctgcatgtataagggcatgcctacctttattagactgttcaggggaataaaatgaagttacaatttattctaatactagaatgcagttctctccccatggactgcacctttcaggatagtggcctgaatcagagcagaaaacacctgctggatatcctccaagtacacagtctgattagtgccctctgggaaacatggaggcagatactacttggctctccagcctaagggaagtattattaattaaaaacttaaagccaggttcttctctgtgtatggttatgcatgtcctagatggccttgaaattgatctgttctccattagcaatctgtgaattgtactcctgtctgaaattgagtagaggtcagagctatgaaggttgaattcaacaagaatttttatgaagtataactagagttagtgctctgctctaactgcttttggagacagactttccccagtgtatcccatcaaatcacagactaaaaacagtctatttccccttattcttggccagataggacctaggcacctgaatttttttttaaactagatttccaggaaattttattgaaggctaacagcatagcatttcatgttggataaagaagatgcacaagacgggacatggtaagacacacctgtaatcctaccactttggaaggatgaggcaggtggatcacttgagctcaggagttcaagaccagcctgggcaacatggtaagaccctgtctctccaaaacaaacaaacaaacaaacaaaaaaacaaaaattagctgggcatgatggtgtgcacctttagtctcagctactcgggaggctgaagtgggatgatcacctgagcccagggaggtcaaggctgcaatgagccatgattccaycactgcgctccagcctaggatacagagtgagaccctgtctcaaaaaaaaaaaaaaaaaaaaaaaaggccatatgcagtggctcatgtctgtaatcccagcactttgggaggccaaggcaggtggatcgcttgaggtcaggagttcgagaccagcctggtcaacattgtgaaaccagtctctactaaaatacaaaacaaattagctgggcatggtggcaggcacctgtagtcccagctactagggaggccaaggcaggagaattgcctgaccccaggaggcggacgttgcagtgagctgagatcgtgccactgcactttagcctggccgacagagcgagactctgtcttaaaagaaaaaaaaaaaattcacaaaagaaaaattgtattaagtacaatttaatataatttcttacaagtttattacctaaaactttgcaaataattgaagttagaagctttggattttgtttttagagcttaatccttttctgtaagtggaaatcctttccactggtttattttccttttgattttattttactttgacaccctaaaggtttagtgttcctgtttttaaatctactgatcgtttcttatgagattccttagagtgccctttaagtatgcacagattttgcaaatgcattcattttcttatttgccagggtttaacactggctatgcacatgttagctgaataaccttaggcaagtaaattatcctctctgggcctcgatcttgttagctattaagtgggaataatgacaattcctaactcaagggtstgttgtgaggattaaatgagtccttacatgtgacatacttgaaatagtacctggtgcagagttagggctgggtgagtgttagctattrtattattatttcattgctgtttgcatatatttttaaaatgtatttaggattttctttttttttttgagacagggtctcactctttgcccaggccggagtgcagtggtacgatcttggctcactgcaacctccacctcccaggctcaagagatcctcccatctcagcctcccaagtagctaggattacaggcacgccccaccatgcctggctaatttttttttttttttttttttgtatttttggtagagacagggttttgccatgttgcccaggcttgtcccaaactcctgagctcaagcggtctgcctgctttggcctcccaaagtgctaggattacaggcatgagcaactgcgtctggccagggttatttcttagggatagcattccagaaatataattaaaatttattgatccagaaatataattaaaaataattgatcaaatggtagaagactttttaaatttatatttcatcaattttacacatttgttaggttttaatgtttctactacttgtgtgtgccaaaaaattattgattttcttaatcgttttctatgagtagaaatcctttccactggtttgttattttccttttgattttattttacttttgacaccctgaaggtttagtgttcctgtttttaaatstactgattgtttcttaggagattccttagagtgccctttaagcagagaatatctttccctctccttcctcttcccttcactcttctcaaaactataaaaatataatactcatttctacctgttttygtggcttttatactttcratgtgttcatctacatgagatttagtttgatgtgtggaacagcaagagagtttaaattaaaaatcttcccctaaatggctaaatgtcccagtgccatttacagtgtggtacccctcctgtaataagaatattacattcttatccgtattaattatttcttattcaaacttaccagtggcatttaagaaatcattagttcagttgtttataggtaagaagactcattctttatctgctatttcaaaattaaaatcattgtctttcatagatattttctgaaatgaaatatggaaaacaattatttttacaatgagacttggaaaaaaatcaatactaagtttcttttgtatacaagatagccaataatacctaggcctaaaacgttccaatctagttttttgtctgctaataggtgctcagtatgacggagcttttcttgaggaccatttgaccctgtgtctctctttgcctttccccttatgaaaataagctgacccctacatccaatcaaatcatcatagcaaggttttcatcattttttatggaatgtcagccttgccacctgcttgcctggtacccaatacatataatctctcttcaggctgcaacacacagcacttgaggcaggctgtcattaattggagttacctccaattgcctacttcttattctattcctatcaaaaacccagctgacaggtacacaaggggcatagcccaaattacatgtaatccrtaaatctctccattttttcttaagtcttagttttctcttgatataggattttttttttttttttttgagatggagtctcactctgtcgccaggctggagtgcagtggcacgatctcggctcactgcaacctccacctcctgggttcaagcgattctcctgcctcagcctcctgagtagctgggactacaggcacgtgccaccatgcccagctaatttttgtatttttagtagaaatggggtttcaccatgttggccagtatgatctcaatttcttaatctcgtgatctgcctgccttggcctcccaaagtgctgggattacaggtgtgagccaccatgcccggccgacataggctattttttaaaatgcaagctcttctgaaccatataatatgatgttttaaaatatagactctgaagacaaagacctgggctcagaatcaggccccaccacttattttcaatggaatcttgtctgaatcttgtaatctttccaagcctcagttttttcatctgtataatagggataaaaataatagtaaacaaataaatgtatttcttttgaatatctagtagtattttaaaaatcagataactagaattatataactctatgtgctttattttttacttgtttgctgggaatcaaagagcttagttttgttttttgttttttttttttttgagacggagtctcgctctgtcccccaggctggagtgcagtggygcgatctcagctcactgcaagctccccctcccaggttcacgccattctcaaagagcttagtttaagctcaattcargtgactatttgaggcctggtcaggatatctgctgttatttggaacacaagctgtttgcccaggactaagatcaagtgattttcctaaagcaaacagtgtattgaatgtaatccaaatcatcagcaggaacaaaggaggccatatagcttagcaattaaggcatgggatctgaagtcagagagacttggatttgaatcatggccctgacaagttacgtgcctctctctgcctgagtttcttcatctgttagatgagcataatattgcaatatagtgttactttgagaattaaatgaggtaatgcaaagctcttagagtagttactaggataagtgtccaattaaccatagtttaagaaaaaggataagctgggcacggtggctcatgcctgtaatcccacactttgggaggctgaggtgggcggattgtctgaggtcaggagttcgagaccagtctggccaacatagtgaaaccccttctctactaaaaatacaaaaattagccrggtgtggtggcgcacacctgtagtcccagctacttgggaggctgagatgggagaatcgcttgaacccaggaggcagaggttgcagtgagccgagatcgtgtcactgcactacagcctgggtgatagaatgatactctgtctcaaaaaaaaaaaaaaaaaaaaaaaaaaggaaaaaggatgaaatcacaacttggagcaaaaaaacccaaaggcatatttaaagatttgygtattgggttaaaacaagttttaacatctggaaagaaaaagcatccatcaacttttcttatcaagaaatatgaattatagccaggtccagtggtgtgtgcctgaagtcccasctgcttgggaggctgaggcgggaggatcacttgtgactgggagtttgaraacagcctggggaacatagtgagaacccatcaggaaaaaaaaaaaaaaaaaaargttgattaaaaaaagaaaaacaaaagaggccaggcacggtggctcacacttgtaatcccagcattttgggtggccaaggtgggaggatcgcttgaggccagtgattaaagaccagcctggacaacatagtaggactccatctctataaaaattttaaaaattagccagacatggtgccgtgtgcctatagtctcaactactttggaggctaaggcaggaggaatgcttgagcctggggggttgaggctgcagtgagctgtgatggtgtcratgaactctatcctgcagtacagagtgagaccttgtctcaaaaaaaatcatctttacagttatttkattatttgcagattttcagtgtttattgtttttactttccttgccccactattctgcattcatcaaatattcattgaacactgtctttttgccagagactgctgtaggcacaagagatacagcaaaaaacaagacaaaacccttgctctcatgaaacttacagtcaagtgtgtgagatggacataaacatagtactgtgctgtcatgttgtaaaatgggacctctcattgagaagctgggttggtttgggggtggggagtatgacatcaakagttctgttttgatcatgtttagttcaagatgcctgttatggtcaggcaccgtggctcacacctgtaatctagaactttgggagactgaggtgggtggatcccttgagttcaggagtttgagaccagcctgggcaacacagcaaaaccttgtttctacmaaaaatacaaaaattagcccggtatggtggtgtgtgcctgtagtcccagctactagggaggctgaggtgggaggatcacttgagtcatggtaacagactcgctctgggtttcgctctggatgacagagcgagaccctgtatcaaaaaaaaaaaaaaaatgcctattagaccttcaagtggtgaagacaagtaggtaattggatacacaagtctgggctcagggtagaggctgggctagagaaagaaatttgggagtcatcagtgaatagrtgacattttaagccatgggcttggaggagataacctaaggaatgacgagaatacatctgaagatccagcctcagacactctggtgtacagaagcaggtagagaaaaggagaaaccattaaagacctctgttgggccgggcatggtggctcacacctgtaatcccagcactttgggaggccgaggtgggcagatcactcgaggtcaggagttcaagaccagcctggacaatatggagaaaccctgtctctgctaaaaatacaaaaattagctgggtgtggtggtgcacactcacttcactctagccagtagtcccagctactcaggaggctgaggcaggaaaattggttgaactgtgaggcagaggttgcagtgagccgagattgcaccactgcacaccagcctgggcaacagagcaagactgtctcaaaaaaaaagaagactgagtgtgatggctcacgcctgtaatcccagcactttgggaggccaaggcaggcggatcacctgaggtcaggagttcaagaccagcctgaccaacatagtgaaaccccgtctctactaaaaatacaaaaattagccacgtggtggtgcgcacctgtaatcccaactattcgggaggctgaggcaggagaattgcttgaacctgggaggtggaggttgcagtgagccgagatcgcaccactgcactccagcctgagtgacagagcgagactccatcaaacaaacaaacaaamaaaaaaaacaaaaacccaagaagacctctgtctcctagagcagtcacctagaatcctagagaaaaatgtctttccaaaaggaagaaatgcagaactgtgtgagtaaaatgaagctaagaattaattactggrtttggcaagatggaggttgctgatgacttggcaggagagtttccctgaggtgataggaaccaaggtctgatgagagtaggctgaagagcaaatgtggagaaacagagatggcaagaatcaacagttcatrtcaggattttgctgtgaaaggcagcagagggatggggtaccattattttcattttgttttgttgttggtttctgctgcagtggtagtttatgttgagatgtatattttaaactgatgatccttaaagaaggagaaattgatgaaggagagaggtgggagggataattgcaaaaatgaagtccttgagcagtgagatctgcttccttattatgcatatagatgaaacattaaaatgtaaaacagactcttgtgctgattttaagaactctaagttagaagagggtggggagaactgggaagctggggagcccaagatgcaggattttggctctttagctcagctaggttcaggttcttgtctcacaaccaggaggaattaggcacgtggacaccagagggtgagtagagtagaatttattaagcaaaaggaaagctctcagcaaagaggggggtctggaaaagcaggttgttggctgcccccttcacagttgaatactgtgcttaaggcacaaattcctggcggctccaccccatccttccagtgcgcatgtgggcccttagggtgagccactccatattgatttacttcccttactgcacatgtgttaaggaatggaattttccactgcgggcatgtttaggcaagccccctgtgcaagttcccacatctgcacaaaatatctggtgtaagcatttgtggggcgggttggaggttctccagggacccttcccttactgtctgcctaaagcaagctggctaacttcttacacctgtgtattatacagcaccagtctttagggaaaggaacttcaggtgggtagggtagastatagcaatagctggcaagaaaaaaaagatttgaagaaacaaactctgtggtgccctagggagcagatgtgggatggaaaagtgaggctgggccttaaatcacaagaagcccaaggtgtacagggatctctttacaacagaacgtgttcttatatatgagttatttgaaatagcttaattataccactatactgtcattaataatggataaatgtacttcaaagtaatttattagtttgtctgtgaatatgtctttccttgtctcttttccccctyacctagaatgtaaacaagagagaagagaactccagatctgattttcatggaggaaggtgatacagatcattatggctgtaaggggaggattcttgtgtttcccaggtgtcctgaaaccattcacatggagcctaagttaaaatgctctgggttcgggagtgtcttcctggagatcactaagggcttcaggactccttgagatggagttttcttttctctctctctcttttttttttttagtattttaaaatgtatttcgttaattagcagcagtatgccaaagttgttccattattatattttgttcattcttttgtacaagtgtcttccaatgtgatttgataatgccaacaatttgcaagtgattttattgcagcatgactttggttcccaggaatgctgaagcacaggtcctagaacagaggcttgaaaaggaaataaaagggatttgatcataaatgcttctggggttggcataccagatcattttgagctcaaataggagacaaaagaaaggatgttgggaaagctgtatggtggagaggctgaactgttggaatgaaaagacaagaagcatattattatgttaattccagcaccctagatctgcaatgctgaaaggactgccaaaactaaagcttgtcctacaccacgttcatcacaaagaaattctgtttagacgttgagttaaactttctcaactgtattcagtacaggattaagtggttgagatgggccattctgcagttacactgtttccgttccartctgggtctcctcatgtattagctgtgtggaccttgggcaggtaactcctttgtgcctcaaagaaatggagatgacgataatacctacctcagtggggttattgtgaggataaaatgcgattaatagaaaataattagaatggtgcctgggatacatactgctcattaaacattgtatatttttattattagtgcactgtgctataataggatggctatctagaaaacatcatgcaatttgtaatgcacatttatcatccagttaattgaaagaggtagtgatgggacagtggtggcagacattgaatgctcagggatgaaaaatgagacaggttttatcttgttttgttttatttttgcctctcattaggtatccacctacttttcaaaattgtgttattttaatctttattrcatacagacatattctcagtaaattgaggccaccatatggaagtgtaaggatgaagccaggcgcagtggctcatgcctgtaatcctagcactttgggaggctgaggtgggcggatcatttgagcctacgagttcaagaccagcctagacaacatggataaatcctgtctctacaaaaaaaatacaaaaattagccagatgtggtggcatgtgcctatagtcccagctacttgggaggctaaggtgggaggattgcctgagcccaaggaggtcgaggctgcggtgagctgtgatcataccactcacttcactctagccagggtgacacagtgagaccctgtatcaaaaaaaagaagaagtataaggatgaaatcataagcttaggtcctagttcttttgagtgagttagaacctatataaaattttctccttttggaattttatttttctaatgtttacctcattattttctgactataatagaaaattatccttaaagtttgccattacaaagggaattgtacttctttaaaatgccaattaaaaatatcttcttgttgttcttatatatatttttaagttatatatgcatatgttaaaatatttaagtgaaataggaatgacataaaaataaaatcttcctcctcactacctcaacctccagtcccatgctatagaagtaaatacttaaattagtttgctgtaacaaattaccacaaactttgtggcttaaagcaacacgaatccatctcatagttgtgtagctcagcattctgaaatgcgtctcactgggtgaaaaattaaggcatcagcaggactggtttcttcctggaggctctagggaagaatccttttccttgcccttctcacgttctagaccccactattaacactcatatattgtttcagaaatgtttaatgctccttgatttttatcacctaattgtatattttctagaactctccattcttttatatacagctacatactgttctactatatggatgcaccagatgttatgtgtccagctccctgtgttaatggagtcttggtttattttcaagtttttattttcataaattgcatcataaataatatctttatactttcatatttatgcattttgacaaacagatccatgggataagttgttcttggtgtagtttccaggtaaagcaggatgtacatttacacttttgatacttctttttaaattgccttctcaaaagacatctattatctttccctccagtgatgagtaagagttcatatttccacacggttttggggcgctcgggagtttgttttttttacaaaacttttaaaactttaccactatatatataatatatttataataytatttataatatatatatttaaatatcatatatttataatatatatttataataaatattatatattatatatttataatawatatttataaatattatatttataataaatattmtatattatatatttataataaatattatatattmtatattayatattatatatttataataaatattatataatatatactatatattwtatatatattatatatcttgtatatattatatatataacttctctttttacttcgtttcacttgagttataaatttgccatgtttggaggttttcgatggtcctagcraaccagtttccctagaagcaacttcccttcagtccgattcacatcaaagatgtgacttcaataccatctgatgttcaagctatttattttagcagtggtcttacaagtcggatagtgggagcaggtgggtggcatgggccagattcaatcagaggtcagatgactgcctgtccaggagggtctccatctggagactattctcagagtttgggagattcttcccatttcttctacctgcatttagttcagtcaattatcaggcgtttctttcataagaggaggttaagctagtcttataagggtaagctttgttaaaggtttacgagatttgcatccgtgatgaggtggccttatgtcctggaaatccctgggccagcttggaaatccccaggccaggtggcctcacgctgctaagtggcacatagtgtcagtcctgtgagagcttgttaatgccttatagctatcattaatcttgtagtcatgatatgtctcctataggatgctacacagttggttttagcattttactatcgttttgttgttgattacttttgttttctttcgttttttgtttctgtttttgagacagggtcttactctgtcatcccggctggagtgcagtggcatgatcatggctcattgcaacctctgcctcccgggttcatatggaaggcagaggattctcccacctcagcctcctgagtagctgggactacaggtgcacaccaccgcacccaggtaatttttgcattttttgtagagacygggttttgccatgttgcccaggctggtcttgaactcctgggctcaagcagtcggcccgccttggcctcccaaagtgttgggattacaggtgtgagtcatcgtgcccagccagcatcttactatgtttattagccatttggattcctttttctttgaattgctgcttgttaatatattggcccttttttctgttacattattaataatgccaggaattatgctagttgctaygcaagatgcagacttgaggaaaacctggtcccagctttcaaaatgcttactttccaaatctgactcatcgtttgactttaatgccccactggacttctctaacagcattttccattttccctttcaaaaggactcaaaatatacaaatttaatttgatgataagagctcaagaaaggccgtggattctttttttttttatttttatagtaaaagtgatcagactgtttcctcttttaagaagaaaaagaaagcagaggtcaatattaagcttccaattaatgcttattcatcacaaatagtaagtaaataatgacagaaataattccttagtcactctctagcacacttctkttttatttttaacatttttcactatgtgagatttcctagatttgttttattttctgtttccctctaactgcaatacaagctcttgtggactggaaccacacctgtcatattcatgctgtatctcacctgtcatattcactgccaaatcccacctgccataatcactgccgtatcycacctgtcatawtcactgccgtatcccacctgccataatcactgccgtatcccacctgycataatcactgccgtatcccacctgtcataatcactgctgtatcccacctgtcataatcactgccgtatcccacctgtcataatcactgccgtatcccacctgccataatcactgctgtatcccacctgtcatatttactgctgtatcccacctgtcataatcactgccgtatcccacctgccacattcattgcggtatcccacctgccataatcactgcccatatcccacctgccgtattcactgccgaatcccacctgccataatcactgccatattccacgtcatattcactgccatatcccacctgccatattcactgccgtatcccacctgccataatcactgcccatatcccacctgccgtattcactgccgaatcccacctgccataatcactgccatattccacatgtcatattcactgccatatcccacytgccatattcactgccgtatcccacctgccataatcactgcccatattcccacctgccatattcactggcagatcccacctgccataatcactgccgtatcccacctgtcatattcactgccataccccacctaccatattcactgctgtatcccaagcttccagagtaggctctagcatttgtaggtgctcagtgaatatttgctgaattagcaaaatagaaaatttaaatctcttaacaggtaccacgttttgacataatcacttgtaacatctatttagaaatccataggcagcacaagcacataaataaaaacctgaccttccccaagatctttcctcctctgttcagcatgctgtgtcaagagcagcacattgtgtggtcactgtctcattcaattgggacagtcgcatcatctgccccttgctgaatcgagcctttgaattagatgaaggaaatttgggccaagtcttctggaatttagtgactactattatctagtttccctctggtgcaattagaaatgagcaatgaaccaatatataaccttgcttaaaaagcaatttcctttactattctccttgtttaattagtctgttttgttctccctgagctcgagaggcattttttctcccaaagcagaagcattaagtaagatgcattcagtgttttcatgagattcattcattcttcttggacaagatcttggccactgtattagtctgcttgggctgccataacaaaatatcacagaccaggtggcccaaacaacagaaattgatttctcacagtyctggagtctgagaggtctaagatcraggtstctgctgatttggttcctgctgagggccctcttcctgcttgtgacagccaccttcttgctgcatcctcacgtgacttttcctctgtgcttgcatggagagaaagagacaacaagacagattcgctgatgtctcttcatataaaggcactgattccatcaggccactgatcccatcatcccccagcctcatagcctcatccaatcccatttamttcccaaaggccctatctccaattaccatcacattgggaactggggcttcaacataggagtttgggggaactcaaacattcagttcataacagccaccatgtgccagtcatctggacagaggttgaaaaagccctatccatgccaaaatcttacctcttaaggtagtagaggcatactgctaatgtgaacctttaaaaatgctcatttattctacagatattccttgtttatgccatattactcactggcttaaaaatcttctaatgatgaggcatggaacttggagaaaccacccaaagtttctaccatgttctgcaaggctgtgatcaggcacctgcttacctctcacactgctccagccacactggcctgcgtgctgctgctttctcccttagggcctttgctctggctgttcattctccttgtggtgctttgccccagatagctggctcattctcatcattcaggtctcacttaagtgtcatctttcataggacatccctgatacccaatcagaattactcccttggccagctggcctgtgccagatgctttgctggatatgaagacacaaagatcagtagtgcggccaggcgtattaaaatattacccttaatcaatgttgactcgacattaataatagagcatattaatgataatattattaattaattattattaatttatcaatagagcagatattgaacacttactatttgcaaggcattatgctaagtctttgccattattataattattgttattttattttttattcttttagaggtagggtctcactctgtggcccaggctggagtgcagtggtacaatcatagctcactgcaaccttgaccccctgggctcaagcaatcctcctgtctcagcctcctgagtaggcaggactacagccatgcactaccatgcccagctaattttttaattttttgagacgggtttttgctatgttgcccaggctgatctcgaacttctggcttcaagcagtcctcctgctttgaccttcaaaaatgctgggattacaggtgtgagccactacgccctgccctttgccattatttatctaatttaaccctcacagccatcctctgatatacatatgattatcatccccactttgggtcagatcataaaaccgaaccttaaggaggtcaactcacctgccaaaggccacacacaggaaagtgatagagctgagatttacccagttttgttgagcttcaggttttaaagccagaaagatttctcttttagaaaatgataaagaaaagtttttttattttgaaaaattgaacaaataatagataagaaggaaaattgtaaaaagagacagtgatgactaatgaagataaagttgttttgtaatcagacagaccctggtttgtattctgacccagccaccaattggctgtgtcactgtggattcaacacttctcttatctttgttttttatctgtaaaaaggaagttatgagcattacacgaaataaacactgacatgaacagattctcattcaatgttagtttgattttattgaataatattaacaaattacagtatctaattatgcagttcatcatcagacacaaataagcacttaatttctttttaatgatataaaatcttttctggctgggtgtagtggctcacgcctgtaataccagcactttgagaggccaasgcgggcggatcacaagttcaagagatcaagaccatcctggctaacatggtgaaaccccgtctctgctaaaaatacaaaaattagctgggcatggtggcaggtgcctgtagtcccagttacttgggaggctgaggcagaagaattgcctgaaccggggaggcggaggttgcagtgagcagagatggcaccactgcactccagcctggtgacagagggagactcygtctcaaaaaaaaaaaaaaaaaaaaaaaatctttttaaagcatcactaggatcagaaatgcaaatttttcagaaatttcaaaaatgtggagaaaaggttggacattttgttagggaagtaaaagcatatacatataaaattatatttgttctggaatataaaatatgttatttgtattgctcactatagatctagkgattgtaagaacttatgtagcattttatcaagcctccatatctctttggagacttcaaagactttagaaaggtatagataatatcaaatgttggtcaagatggtagtcaacaggaactctcaaacattgagagtaggcatgtaatttggtacaaccatcttgaaaaactgtttggccttatctagtaaagctaaagatgtatagatcctaagatctagcaattccagttggaggtatgaaccctagaaagscttgcacttttgagtcagaagatgtagacaacaaaactcacagcagcactgtttgtaacagagaaaactaaaaacaacggaaattactatccacagtaaatagaatgaattacagtaaatatggttatacaatggaaccttatgtttgtgcagtttattcaagtggttgcatgtggccacagttcattttgttctcaatatatataatatatagatgatacatgtatgtgtgtatacatatatttcattgtgtgactatactacatttaatttttccattctgttgtcatttgacgtttcagtttcagatagttagctattatgaaagagctactatgaacatccttgttcatgtattttggagcatgtatatgagcatttctgtttattatacgcctagaggtagaattgcagcagagtatgcttgttcagctttagtagagactgccaaacaattttccatagtggttgtaccagtagacaggcccaatatgtgagggtttgcttactccacagcttcaccaacatttggtattttttcatttcaatacttactttcattttcattttatatttcatttcaaaactttcatttcagtattttagttcattttgatgcattttcattgtagtcactctagtgagtgtatagtgatattgtactatggtttcaacttgtattttccttatgactaatgaaatcgaagaccttttaatatgtgtgttggtcatttgatatgctattattttaaagtaataaatatagggtccagacctatggggcttagcgggtgttctctccgtgtgtggaracgagagatctaagaaataaagacacaagacaaagagataaagagaagacagctgggcccgggggaccactaccaccaagacgcagagaccagtaatggccccgaatggttgggcgtgctgatatttatcgtatacaagacaacggggcagggtaaggagggtgagtcatccaagtgattgataaggtcaagcaagtcacgtgatcataggacagggggcccttcccttataggtagctgaagcagagagggaagacagcatacatcagcattttcttctatgcacttatcagaaagatcaaagactttaagactttcactatttcttctaccactatcttctaacaacttcaaagaggaaccaggagtacgggaggaacatgaaagtggacaaggagcgtgaccactgaagcacagcaccacagggaggggtttaagcctccggatgactgcgggcaggaatggataatatccaacctcccacaagaagctggtggagcagagtgttccctgagtcctccaaggaaaggaagactccctttcacagtctgctaagtaacaggtgctttcccaggcactggcattaccgcttgaccagggagccctcaagtggcccttatgtgggcgtaagagagggctcacctcttgccttcttggtcacttctcacaatgtcccttcrgcacctgaccctatacccgccgttattccttggttatattagtaacacaacaaagagtaatattaaaagttaatgattaataatgtccacgatcatctctatatctaatttgtattataactattctaactgttttctttattacactgaaacagtttgtgccttcagtttcttgccttggcacctgggtaatcctccacccacaaataaataaaggattattggaaaaattacttaataagattgattacgatctatgtaaagcaatgtatcagtggactgaggcttggttatcctaacagtgacacatgacttgagaatctcagtagcttaaggcaaggtttaactcttgttcttgctgcatgtctatttccaacagtcagtgggtctgctccacatcagcatcattctggcagcttctgtgaagggacagcctcaatatggggcattgctggtctccaggcagagagaaaggagagatggcaacacaatgggccacacacaagttcttagaactttggctcagaagtggcacacacttcacttacactcacatttcattggccaaaggagatcagatgtccaagactgatgttagtgagtggattatataatctaaaggcaagggcttgtaggaagaggcagtcaatatttgtgaacaagagaatgatcagtaacatctttctgcagagtaggcttataagagtattactgtaggatagagaaaacaagctgtgtgtctgtgggctgttgtcaacacatatatatacactacacactttttttttttttttttgagatggagttttgctcttattgcccaggctggaatgcagtggcttgatcttggctcaccacaacctctgcctcccgggttcaagtgattctcctgcctcagcctcccaagtagctgggattacaggcatgcaccaccacgcccagctaatttttgtatttttagtagagacaggatttcttcatgttgatcaggctggtctcgaactccccacctcagatgatccacccgcctccgcctcccaaagtgttgggattgcaggcatgagccaccacgcccagcctcactttttttcttttgttttgttgaactggttgccaacgtttaaaaattatgacatttaacaaagatgcagatttctggcttcttttggaaatcctaagctatagcaagaatcatttggaactgagttgtagctgcccttctggtgggatgtgcactctctggttttccatgactgtatctgcctgtcttctctgcagcagtgcctttcaaacattttttacgtagctcacaataaacaatacattttacattgctaccaaggactcgcatgcatgtgtgtgtgtctgcattcatatataggtatagatatgcatatacatatacattccaaagtaaaatacatcaaggaaacagtgcttaccattactcattgaaattgtctgttctattctatcctattgtattctagtacttttttttttttttaatgctggaatcaactccctaaattgatttcacaaaccacttctgggtcatagcccataggttgaaaacatggttgtctatcatgttacttgtctgtttctcctctaaatgctattggttagttttctagcctggattcctgtctaagccctttagggtttcaggacaattcactgtgtgggtgagcagcatctgcttcccttcacttaaacctgggcaattactggttttgcccaagggtcttaaaacttaaactgcttgaatatctggcagtttccccgctgacttttcccttgtctgatttcctatttcaataaaaatagccttgtaggcgaatatgccactgattcggagaatctcagtttcctgactgggctaggcaatcaagggcaaatgaaagtgagtcctgttgtacaggaaggagagttctcagatgatgaggatggtcatggggactttgttaccgaaggaggcccaagctcatgatttcacaggattgattcctccatctcactgatcatttaacaaatacttatggatgacccatgtgccagaccctgtgctagggaactcatccaaaacttacaaaaatttctcctagatgcacagacgatgaatagtaattacctcttcctgtgttttacccttcctatttcttcttttcttcccttgacccagaaattcatcaattgccctagggctgttccggcttagtgcttgttggtcagttggatgtgcccttctgctcaggtctttgtgggctctcactggtgttcgtatgcatatagaatggatgtctgcatcacattgtagggacagtgtatggggatgtgaagacaataagtgaaagtctgccgcccactaagacacaagcagcattgctataaactccagtggaaaaaggtgatattatagggaaggaaaaccgtattgtcatattttcatggaattcagtgaattgcattttgaggaccagtgccattttgatgctggaggattccaccacctttgtggtgttgtttcctggaagagattctactactgaagtggtgttggcagcaggtgtacccagcaaaatcaggtagcaaggcctggtggaacttggcagaaaggagctcactggggccatcagagacagtagtgaggcccccttgtgccagttagggggcagcagagacccaaaagtggattttaccagaaagggttgaagcaggagaggaaggaaatggcgaatgccttgacaggccatgtttgtgagtccaggaagacaactcatgggagctctcagaaataattgtggggtgaggtgagtgcatacttggatagagatgttacagtacctgacaggggcaagacccagtaatatatgggttgttactattaaacgtgaccccattttaagtcgtgggtttatataacaaggttatttatgcttgttatatgctttatgtgcattacctataaatgtccttaaacttttatcacagtgcaaatgcagctcattaccagaatccgtgagcactgtcttcaaaccctccccattgccttgacattggctttttcttaattctgtctctttttttggccactctgctcttgatcttgtgtctacatctgagcctgaaattggagagtccttggctactctataatctgagtcttctacttcctgctttccctattcagtctcccatttccttctccagccccatccctggtactagcaagtccctccctgatgtcttcaccatcygttcctttcagacacctgccacccttcacattagcaaaatgacaaaaaataagaataaataaggtgagtatagtagattgcatagtggcccccaaaagatacaccacagagctccacacatactaacccttggtccctcagaatgtgacttatttggaataagggtctttgccaatgtaattaagataaggatctagagatgagtccatctcctgggttacagtgagccttaaagccaatgacaagtatccttataagagacagcaaaggagaaggtggccatgtgaagacagagacagagattggaattctgctgccataagacaaggaatgccaggggcaccagaagcaggagctttctgaaggtgcatggcccctgccagcaccttaatttcaagtgtctggcctccagaactgtgagagaacaaactctgctgtttaaaccaccaaatttaggctgtgagtggtggctcacgcctgtaatcccagcactttgaaaggccaaggtgggcggatcgcttgagctcaggagtttgagaccagcctggccaacatggtgaaatctcgtctctattgaaaaaaaaaaaattagccaggtgtggtggtgcacgcctgtagtcccagctacttcggagagaggatcacctgagcccgggcagccaaggctgtagtgagctatgatctggccactgcactccagcctgggcaacagagtgagagccggtctcaaaatcaaacaaaaaagccactaagtttgtggtaatttataacagcagccctaggaaactgagacaatgggtgaccatacagcaccaaaggacttctatttcatgattggtgaacattttaaaataagaaaaggccaggcatggtggctcacgcctataatcccagcactttgggaggccgaggcgggtggatcacgaggtcaggagttcaagaccactctcgccaagatggtgaaaccctgcctgtactaaaaatacaaaaattggccaggtgtggcggtgggcacctgtaatcccagctactcgggaggctgaggcagagaactggttgagcccgggaggcagaggttgcagtgagccaagatcacgccactgcactccagcctgggtgacagtgagactccatcccaaaaagaaaaaaaaaaaaaaagtattacagaaaagaatgtgagaacatgtttcaagtattaacaaataaaagaatgcatgctaaataattatttgcaacacatcatagagccagttctcacctggcaataaggtactccaaaagttcattcataagtaaattgagactcagaatgcatatttttcctgcaggagtcatgtgatatattatggatgttttcaaatattaatccataataatcattttaagttaatcatatgcggactatagttttcttgaagcgagggattgttctacacgtatttaagtcttgctgtctagcagagtgctttgcatgggtagggcctccaataaatgcttgatgagtagtagttcattaaaaaattctttaaaattttttttaccacaaaacatctgcaagtagagtagttcattttttaaagcaccatacactaatatttaatagcagctgttttagagtcagattgcaaggcttcagatcctggctctgccacttacagaatgcaaatcattaagcaaatttacataatctctgtgtgcttcaatttatttgtctataaaattgtgatattaatacctatctcacaatgctgttgtgaggagtaaatgaattattatgtactaaatacttagaacattacttgcatgtacggattcaataaatcttaaatattgttattagctcttaagtatatctcctcaactaaattataaactctgaggaagaggcaagatcctatcctttttaaaatcccggcatctacacaatttcttgcatattgtgtgcactcagtgagtatttgttgaactactaaaaggaatgaatgattggctatatgtttacaataccttctccataaaaaatacatatagaattgataacattctaacatttgttacagtaaaaaatgtttttagaaattaaatagaattttttttttaagacagtgtcttgctgtgtcgcccaggctggagtgcagtggcatgatgtcagctcactgcaacctctgcctcctgggtccaagcaattctcctgcctcagcctcccaagtagctgggactacaggcacgtgccaccacaccctcctaatttttgtatttttagtagagatggggtttcaccattgttggccaggctggtctcaaactcctaacctcaagtgatccacctaccttggcctcccaaaatgctgggattacaggtgtgagccaccatgcccagcctaaatagaatttttaagatgtcagagcaaaaaggaaattattaccagtgtgaaattcttcactatattttagcccctaagaggcagagaccttgtcctgtttctttgtaactgctgcattttgcgtgatgttttgcagaataggcatgtgcgaccttgtacacagaaagggcttaagcaaatccttatgcagattcctggagttatttttctgtgctggtcgctcctttccagaattctactctgcaacttccagctgccttagccttctgaactcagagccccctctccttacctccacgaggcctctggggtctctgggtttccccttcttgcacttgcagtttatacattgcctccaagcagaaggcccaggtgtttctcatgctcatcccatctgtttcccctctaacagagattagtcttacaaggcctcgtgttcagtctgaaaacagctgcttcctgtacttcgttcagttctctaattgctcacaataaaaagctaagtcctttcttacttcatcatggcyagaagcagttcccatgcgaatgtcttggttaaaggagaaaaatgtataaggtaactataaactaagactttcacatcaattcagttggttcttttgttaagaattacagggttgggcacgatggctcacacctgtaatcccagaactttgggaggctgaggcgggaggatcccttgaggccaagattttaagatcagcctgggaaacatagtgagaccccgtttctacagaaaaaaaaaaaaaaaagtaaaaattaggcacagtgtcrcatgcctctagtctcagctacttgggaagctgaggcaggatgatcaatcccttgagcccaagagttcgcggttacagtgagctataattgtgccactgcattcagcctaggtgacacagcgagatcctatttaaaaaaaaaaaaaaaaagacaaaaagaaaagaaaattacagtataatttttctgtgttgaagagcttctgctggacaaattttcagtcttggtcggcagtttaactcaagaacagactcttctatcttcacttccagcttacataaattagaatggagaagagaattctaaagtataaagaatgtacactgttctctgccccaattacacatctgtctcacggcttgttaggcagcatgatgaataagcgtgtcatctctctccatttatttgtgcatccatttttatatccatagtctatagagactttcattgcttctcacaaatttgtttaaacttttaatagtgatatatacagacttcctcatctaagcacagacacgatttctatttaggtcatttctgtgcagtcacttcctcttcctaggtcatagccctgtagttctatcatacatagactgtctattttaatagaaacctgcagcaatggtggaaggaggggaacgggagtcatttcatcagaaagatgcattgtatctactggagaattttcttgtcttagaaacactagaaattatattttytggaaatttcaaattttactaaaatgtggtcattgtcaattatgtaacaggggctttccttttcaatatagcgactatcagtaatagtgctggaaatatgataacaggccacattctaaaaattcatttcctctttaattaggacctaactcttggaaactccttcatgtgagctgccacaacatcatctaaaagcaaactgccaaaaaatcatcttaaaccgcatcatctaaaagttattttggcaaaatgcatggtctcaaatggaagataatgacagctaagatagaatttagaatgagccccagcactttgggaggccaaggcgggtggatcacttgaggtcaggagttcgagaccagcctggccaacatggtgaaaccctgtctctaccaaaaatataaaaaawtagccaggcgtggtggtgcatgcctataatcccagctactcgggaggctgaggcagaagaatcacttgaacccaggagatggaggttgcagtgagccaagatcacgtcaccgcactctagcctgggcaatagaatgagactctgtctcaaaaaaaaaaaaaaaaatttagaatgagcacgaagttaatgaataatacctcagtcacattctagtaagaaaccattcctccytgtgggaattagagccctgcccccagaaccctggctctgaggtttgacttctgttatgtactgrcagtccccattacgctcatggttccatggtgccagcacaggagtggctgatgacagaggctgacatgtcatgcacatcattctgtctatctcattgtttagtgtctcttccttggtaaatgctctctgataggtgttaccatgcaatcgaaagatcacacacctgatactactatgtgtctatccatttgcctctttcctagacatcttatccctagcctttcaaactttctccttctggatccctgcatatgtacacagtgtatacaatgaactgtaattaaataaactacataatttacttattgattaggtctcttttaaactatttcttgtgagttcaagaaagcagagatctttgtagtttttttgttttgtattttaattactactgtatccctagcacttataatagtgtgtggcagagaacaagtactcagtaaatagttgctgggtgaatccatactaaatataaatctttgtcaattagtatatgtgtgagaaatatctattcctagttagaggctggtcttttcatttactttattgtaaatgatgtttgaatgaacagaagtatggaattttaatgtagttaaatttatcaatccttattaagctatttttttgtttcttatttaagaaattctctgctgcaaagtgataaatatgttctggtatattttcttctaacccatctttcccccactgatctgcaatgacatttttgttgttaattaacttttattaccagtgaatctgtttctaggctctctattttgtttcattgtctgactatcctttttaaaataagtttttttagagacagggtctaactctgttgcccaggctggagtgcagtggcacaatcatggctcactacaccctctaactcctgggctcaagtgatccgccgcagcctcctgagtcactgggactacaggcatgggccatcacttctggctaatttaaaaagtgtttttttttgaagaaatggtgtcttactgtgtagcccagactggcctcaaactcctggccttcctcccacctcagtgtcccaaagcactgggattacaggtgtgagccactgcacccagcctatcctatttatttttatttaccattatttatttttaattgctggacagtttgacaagtccagtttgagctagttatgtatcacatcccatttgcaagggttgtttgtcttgttcaaaggacaatgagtacaaccaatgtcaacagaagttgtttttcttccttcgaagagaagggatgcgccaggatggagagtgcctgcattcctgcccatcagggtactatggacactgagccccagatatgaacagatgtgcaacttctctcggagaaaacaaaataaaaaatacgtcattggtccatgttcaactgcccatcgtaaaaaagaaatacatcattggataagcaacttcattcaaaagtcagtgccacagcaagcaagaaattagaagcttgtaaaaataagatggaattttgagctgggcayggtcgctcatgcctgtaatcttagcgctttgggaggccaaggcaggtggatcacttgaggtcaggaattcaagaccagcttagccaacatggcgaaaccccgtctctactaaaaatacaaaaattagccaggtgaggtggtgagtgcctgtaatcccagctacttgggaggctgaggcagaagaatcacttgaacccaggaggcggaggttgcagtgagccaagatcgcgccactgcactccagcctgggtgacaataaaaataaataaatgaaatgaaaataaaataaggtggaattttcacccattgacaaaaagttaataattattattrtatctaatttctggacattgaatagctcataagccaacctacttatgagcatctgttttctggatgagcttcaaccgttgcaagtggatttttcttctttggactacttgtcaaactgtagtgtgaatcagaggagtttaatacagattgctgaagtttttgatttgtaggtctgggatgggacttgagaatttgcttttttccaagttcccatgtgatgttgatactgctggttctgggaccacattttgagaaactttgttgtcaataatgtgcccacagctgcattattttttttttattttcccaagaattaatgtcatcagatttaaatagtagtatatattaatactgaatgacaagttagaaagatagatttgtttaaaagataatattggaaataggcacatgaatattttgaacttaaaataaatgtttcagtgatttttattaaagtaatatgaatattgtcctccaaaactttgatgatagagttttgtttctttaatgtgaattactttcttacattgtgaaaacttagagcatattcttcctcaggcctaagtactgtataggaactattaagtgagaactttaacagtaattctccatatgcaaaaaagcatttttactagtctgtacttaacaacttgcaaatttgcttttatccraaaggaagagaattagagaaatgattttagtaagaaatgctaaaatcaaaaagataggtaaatatttaaggaatcattgtagtattcccaacagttttatagatgaaattttaagttctctgggttataacttgctttstgatgccattataaacctgayggctgagacactggtcgatcacccattaggaatatatgctaaaattgttgctttcagtttttaaaatatggcttaattttatgtttgcttaaaattggtttgttttggcctggtaatatctcgggtcccacacatatgatcattcacaattatcatatcgggctgagcagggtggctcacgcttgtaatcccagcactttggaaggccgaggtrgacagatcacatgagtttgggcccagcctggccaacgtagcaaaaccccatctctactaacaataaaaaaattagccaggcgtggtggcacgtacctatagtcccagctactcgggaggccgaggcaggagaattgctgaacccaggaggcggatgttgcagtgagccaagatggcrccactgctctccagcctgagcgacaaagccagactccctctaaaaaaaaaaaaaaaattattattatttagttttatcttctctatctgttaatgagagagactaaaataatgatgaagaaaacattttaatatggtatatgaatagtaataaaataatataataagatgtatctccaaaatctgaatctaatggtactatattcgtattatagctgattctttacaaaaagcagtcttggcttactggaaaattcacattttaaaagtcgatcagtttcattttttctggagaatgttagctttactgaaagtataaaagtttcgttgttgtagacaccaggtcctaataaaaacaagtaaaagaagaaaaagtttgttatgggtrgaactgattaagtgaggtaccactgaagaattaaagatatctcacacatactttgattaattaaatggtgaataagaacttgttttaatctcattattcaagtcactaaaatgttaaacaggtaagacaaaaaggcaattattacaagtttttacgtaaaactatgataagattttttaaaaagtgaaacaccacccatacacactgaattcatttggctggtattgattctgaatatgtattttataatatttcattggccttgacccacaaactaaacacagacattttctcaattagtcattttcaggtttattgcctaagatgctaattgaaattcagggcaggcaaaaatacatcattggcctttgtatatctttgaaaggccttctgatgggaccttgctccgtataaaggcttctcttctctgcaaactgaaagggaccctgtgtgtgaagtgtgttcagtggggtcttcaaggaacaacatagagagcagccgctggccagccggaagccaccatgcgctgtcctcaacagagcagctccaggctgtatgacccccaggcaattaggcaccaaaagaagatgytcacactttccaaaattctttcccagggctgggggaagggagccagacttggagcccctatgtggaacttagtctccaaggaaagaaagcatgttctcatcctacaaacactccattttctccctgaattagtgtcctttctttgaaccagatgagacttcgctcagagctggaggctatggccccttagttctgtttccacagtgcttccagccctctccccagtttggaggcccccraaatgaggcgcttatctctttgattttgtgaaagaaaatgcacagttcgtctatttggggcttctgaaagatgttaggccctgaagaaggttgactgggagactgagtggggagtgacagaccatgaccttaattactgaccttttgttatagattaacttccttcctattttattgttcctggcccagaccwgatagcacttgagataaaagatcccttgattattacatccttaatgtggaatgttaaatactcccttcccccaaggaatcactgcctaaaaccagtcagattgctgcgactgtgcactaaccttgtgtggaaaatgctgtcatcctgttaagcttccccataccgtgcctgtataaacaatcctcaaacctcgctgcttcagagcactaaccccatctttttggagtcctcctgggtgaccctcctcaaactttgtgctcagtattttaatcctattgcctggatctcgatttaaagttgataattttcagagaattcttcattttctctttgcatattttattgtttcctttccatctgtttttcttttacttactgcctgaagccaagagacaatgtcaaggtgtcttagtgaaaggagctcatacttaagggttcctgggtcaaaacctacatctctcatttcttagctctatgatctacctgtttccttaatctctctgggcctcagtttacccattattgtagtaaaacatgtactacaagttactttttatttaactacttatgccatatttaattcccaaccactaatattacatattagttatatattgttaaatcataatgttctttcactatttcttttatgactgagaaatttcttttcaatgtataaatcatatacatgttgctcctggacaaaactgagggtcaggctgctacttctcstggcccaataatgagatgcagacaaactggggaagagaggttttatttttgcatytggttacagggagaaggcctagaaattgtcaccacaccaactcaaaattacaaagttttccagagcttataaaccttccaagctgtatgtctacatataagtgtgcattcatctaaagacataagtgattaacttcttttaatctataactaagatctgagtcctgaagacctttctctggagcctcagtaaatttacttaatctaaatgggtccaggtgctagggtgattacccttatcttgtctcctgctaaatcacagaggtttggggagttccttcagacctccaataaacttgtgtgtggaggcctggggaatttcttcagactgacaataaaacttgtttattccagtctggccaacatggtgaaaccctgtctctactaaaaataccaaaaagttagcygggcgtggtgacgtgcacctgtaatctcagctactagtgagacctggcctgccacaatgtggttaaggaaacatattaaaacatttttaaaaatcaagattttccatttcaatggccttgtaattgattgaaaagtttattttgagtcacatggtgttctagactcttgtggagggtttagattggaaaataagtaatgacagtgaagcagttgttatgttcgtataaaagaaagaaaagaaaaacccacaggactttatttggttttaaaagtctatctgcaaagatatagtttataggaaaattcaattccaaatgtttctcattgctctggagtgtgtgaagaagaggcctaagaatattcttaggaaggcaaaaactttcagatgcagttcatatgcttgacacctctgtttcacttttggctgacttgtgtagtctgatttttggtcactgacaggctcagcatcatgagtgtgcaagacgtaagggaggcaggaccttgtcttttcaatggtgtcttcctgggtggctgccagaattcatcattattgcactctactctcatagcctcgatttctgtttttgtttgcttttactgaaattggagtagtgacacagagtcagatcattgaaaagactcacaagattccaaagggtatactggtagagtataaactggaggataaggtacagcgggagaaagcaagtaccagcagacacagagggggctgagactcctgcaagcagcgcctttcctcaggctcactggrtgtgctctgtgtttgggtgtgaaccaccaagatgcatgcatgatatctgttttcagggaagccaagatacaagtgtacagaaaagccattatacccccgtcacattgctgaaactggatgattaaaccacgtaccaagcggtgtctaaatttcagtaataatgatcagctagtagagggtgcctcaaggcagtttcagactttaaataacatagtagaaatcactagctagtccatttcatccttatcattgttgcagaactttctccttagttcagctaaaaccgggttcttgtcacacaaccggaaaagattaggctcagggacacatagaagggtgaggggcagaatttattgggtgaaaaggaaaaaggaaaaagaactctcagcaaagcgagagggagtcttgccaacaggccctccacctcacagactgaacaccaggccaccacacaggaactgaagaggccaggctcctccccgctgaacaagcgtaaacttctcttggctccaccctcttcccccagtgtgcaggtgggcattattcagagagaatcagctgagaaagggcaggctttatccgggaccagcagtccagttcttcagccttcaggctcttttaggcttgaaggcagggtttcgtgggggaccttggtaagaagagttcttttcgacactttaatgtagattgtaagaggtagaaaaaaattgatcacatttaacatatagttacttaaaaacacatctttgagttttctagacttctaatatgattgtagaaaatcagcgtggcagccaacttaagacagatcaatacctcgaagtctgtaactttaataagaacatcagaactgaaattctatattagttaccctattgtactcacagtcatggaatacagaacaggaaagattctggaaacacattttgatagtcagggtcacagatattgctctgtttcagtaaccaggttttctacttatgaaagttatttaaaaggcaatgaatattcaaaatgtgagcagctattgctaccattagctccagaatcagttctgaagaatttgtaggaagtcatcttgaaaataataaagcaatatatttttcagaaatagtatccactaaatcataatctgaggccactttactgaggcgtttatatttatatttatattaatttgttattttacacagaaagggaaactatgacctaaagacagagataacaataatctgattagcattagccaccccattccaacaacaaatcacgttaataaggcatttttagaagtagcaaagcatagtggttaagaacatatgttctagaactagacagtctgagtttgactcctgataccacttattttattctaaaacttttggcaaattattacataacctcccttgcctcagttggccaagctgtaaaatgggactaataatggtgtccaactcacaggattgctatgtaggctaaaaggttaaaagagttttatatttctaaaacaatgtgcttgtaatagtcttggcacattgtaaacattgtgtaagtgcttattaaacaaataaattcatgcttgtaattgaagatcgccatatgagatacacattctagtgatctatatgtttatcattagatatatgatatatacacacactcatatttcagtcccctgagggattaacttttaatcccttgatttgcaaatcaagttgtaaattacacgtataaataaaatacctttgtagtgattcgttcattataaaattatgctaactatgttggttttcatgtaggcataagctggctctataaataaagtttgaaaataagtaaggtataaaggaaccctggcgggatagataagatactaggaacagtggtttgggagtgaggatgggaagtagactgatgtggaacaagatgggagtgagactttttttagtcaccgtctatatttttataatttctgggtctggaatcagtatctcctcatcctaacttgttcatatgatgagttagagtcatatctgcctgctgttagttttttcaaagaatcttcaaatggggcaaccccctttgggtcccctccctttgtatgggagctctgttttcactctattaaatcttgctactgcactcttctggtccatgtttgttacggctggagctgagctttcgcttgccgtccaccactgctgtttgccactgtcgcagacccgccgctgattcccatcgccgctgactcccatccctccagatccrgcagggtgtccgctgtgctcctgatccagcgagactcccattgccactcccgattgtgctaaaagcttgccattgttcctgcacggctaagtgcctgggttcgtcctaatcgagctgaacactagtcactgggttccacggttctcttccatgacccacagcttctaatarctcatcgcatggcccaagattccattccttggaatccgtgaggccaagaaccccaggtcagagaacacgaggcttgccaccatcttggaagccgcccaccaccatcttggaagcsgcttgccaccattttgggagctctgtgagcaaggatccccggtaacattttggcgaccaygaagggacctccgaagcgtttgtctcttccagaattgaaactgtaaaactacaaatggttcttcaaatggagccccagatgcagtccatgactaagatccaccgcagacccctggacyggcctgctagcccatgctccaatgttaatgacatggaaggcacccttccggaggaaatctcaactacacaacacctactatgccccaattcagcaggaagctgttagagcagtcattggccaacctccccaacagcacttgggttttcctgttgagagaggggactgagagacaggactagctggatttcctaggccgactaagaatccctaagcctagctgggaaggtgaccgcatccacctttaaacacggggcttgcaacttagctcacacccaaccagagagttcactaaaatgctaattaggcaaaaataggaggtacagaaatagccaatcatctattgcctgagagcacagcgggagggacaaggatcaggatataaacccaggcattcgagctggcaacggcaaccccctttgggtcccctccctttgtatgggagctctgttttcactgtttcactctattaaatcttgcaactgcaaaaaagaaaaaaaaagaatcttcaaatggctattgatgctaaagaaagttctgaaggagcattctccaatgcagttatttcctacagaagattttaagtgattttttaaaaaactgcctcttttytaaaaatatttcagcttttattttagatatgggggtacatatgtaggattgttacatgggtatattggatccaggtagtgagcatagtaagcaataggtaaaaaaatgacctcttattcaagagggtacctcattactatttacaaagtgctttcaaacattctttctcatttttttctgacaactctggacgtccccccctacttttagaagaaaactaacagtcccaaaaatgttttggtgtaagtcaatatatgaacccaggtccatgtccagaactgtttaccactcacctctttataaaacggtaactgtggccaggcacggtggctcactcctgtaatcccagcacttygggaggccgagggaggtggatcacttgaggccaggagttcaagaccagcctggccaatctgttgaaaccccatgtctactaaaaatagaaaaattagttgggcatggtggcacgcacctgtaatcccagctactcgggaggctgagacaggaaaattgcttgaaccggggaggtgggggttgcagtgagctgagatcatgccactgcactccagcctgggcaacagagcaagactctgtcttaaaaaacaaaaacaaacagtaacagttacttctctgaagctattattttttatcctgttacatatatcaaagacttcatttgggtaactatattcacgattattttaagctttctttttcattaccaatagttgggctaacctttattttctggatggtaaaggtgttttatagcaacaaaaacaaacagctaagtcaatccgtccaggtaccctgttaaagcttcaaagactctggatcagaatgatctctgctatacacacatacccaaagaataaacaaaaatgctattgctaatawctctcagtcccttgagggattaacttttagtcccttgatttgcaaatcaagctgtaaactatattaattcccccctttctgtacctttcctttcggatgatgctcatctagcattttgctgtcttgaataccttctcctttctcatccctatatattttcattctttatttgagtataattccactttaacacattaccttaatgcaaaccattatctccatttttgctcacttctttccctttcacagcacctcttctcaataaaagtctatatgtagtgtgttcccatggtgatgggaactaaaattacttataatcaatggtttttatattgtcgctgctgcttatctcttgggttaggcctctctttgcagccaggtcacaggtaagtctatgaaggtgagatgaaacaatatttaccagagattgaactacttctggaatatttgtgaatccagccttcaccattattgcaccatctagatttcacatctgtttagtgtattaccaatatttcctttttccatataatgaattcttttattgtagtaattgtggtatcagggcaccatggatattcatagttataagaagatattatcatagaagaaaattgtcatgccatcattcattatggtgttttgcatctttgaattttaaacagagaaagagaaagaacagtcaagctagtaagcaagagataaccaatctactttgggaaatgaccaatggttcttgatttcagggtagattatagaaaagagaaaagattatagtattttatatctgcaaaacttattccaaaacaaatcagtaaatccaggttaaaatacccaggtcagacagtcacatttttactaataaaaawtaactagcagcccgggygaggtggctcatgcctgtaatcccagcactttcggaggccgcggccggcggatcacgaggtcaggagatcgagaccatcctggctaacacagtgaaaccctgtctctactaaaaatacaaaraaaaattagccgggcgtgttggcgggcrcctgtagtcccagctactcaggaggctgaggcaggagaatggcatgaacccggagggcggagcttgcagtgagccgagattgcgccactgcacgccagcctgggcgacagagcgagaccctgtctcaaagaaataaaataaataaataaataaataaataawttgcagcccattgagtgaactttaaatgatcatgctactttgtgaaatagaatatcacattactagatctgttgtgtgctggacaaatgccagcacaatgcagtactttgctgatatagtgtggaatagattttgtgctgcagcaaagctgtctatagacttcaaaaaacaaaggttatatgagcattaaccaaactgtttaaaatcttacagtttcaaaggaccacatattctatgattccatttatatgaaatgtccaaaataggcaaatctataaagatagaaaatagattagtggttacctgggacttgcggggatagaagcattacagggtcagggcagtgaccttccctaaaagatacagaatttattttctaggtgatagaaatgttctaaattgattgcggtggtggtcacaactatgtgacaatattaaaaatcattcaattgtatactttaaatgagagaattgtaaatatatgagttatagctcgataaagtgataccaaaagaaagatcttccccaaaaagctttcccgtaaaaatacatgttccacccaattaaaatgcaatgtcaatacgtattcgtttattttattgcttaaaataatgtgttcttttgcacaaagaagaaaaaatagaaatcagaatgtaagaagacaagtcatttatgatttattttgcaccatttatttcaactgtttaaaataaaagggccgattttatgctgctgtcaaggttttgcttatgataaatgtttgaagtgacactgaaatgtgaactggttgtgagacaggctctccttggcttctaatggaggcaggtatcccatgggacagatgcttgtattgcttcaaattcattgtaggagaattaacccttcgtggtgccactttcttcatatgaattaaagtgaaaattgccagggtcagtggcttacgcctgtaatcccagcactttgggaggctgaggcgggtggwtcaccggggtcgggagttcgagaccagcctgactaacatggtgaaaccccaactctactaaaaatacaaaattagccaggcatggtggcacatgcctgtaatcccagctacttgggaggctgaagcaggagaatcacttgaacctgggaggcggaggttgcagtgagccaagatcatgccattgcacgccagcctgggcaacaagagtgaaactgcatctctaaataaataaataaataawtaaaaataaagtgaaaattatgcagtatgggtttcactgtagttttactactcttgtatagaggaggaaaaatttctcctctaccttcttacaatctctggctaggcctaagaattaaacttatataatacagattaatagaagagaagcatacaaattttattataattttacttgcacatgaaagtcctcacaagacaatgaagacccaargaagtgaccagaagtagtaaacttatatatcttttagatgaagaaatgataaatttgtgaagaagtgataagacaaagcagtttggattataggcagtaaattgtgaggaagtcactaaaaatatagagggggaaactaatggaagataagggatattttagtaagtttgtacagatctatttcagagtcaattccaagtctcaggtgataaagatgttcttttcttcctggtacagggagggcacctttctcctggaaattttaatggtgtgtttttaagtagaaagggggaggtcaaaaggctttcctgcatctgctatttctccattgctttcagctctaaataatcagtatgccaaagtggcatattttggggtggcacgtcctgaagtccttcacttgtttactcactcgttgctaatcaggacttgatcatctttgtctcacccctttttacagccgtccagccctatgctttttattttatgccattatttaaatctgatgttccattcagttctctacagttggaagggtctagcttgggctacctttgkattgttcaaaatgcttttttaaaaggacaaaggtcttgtggtcaaatcagtttagcgaatggtgcataccatatcttgctcttacagagtctcagtgcacactaacatattaaagkttctgagaaatccagaagaaaaaacaagtatgtaactttatttaacctaatatttcccaaacttttttttagtgactcacagaaacactccgtagaactagcctctgcagaacaccctatgggaaatggtgttctggagtcataattatctccccctttattaccttattactctttcccagctatgacagatctttttatatttctttttttcttcccgaacatgtttgttttaagccacaattcaaacttgctacatttactttttcctggttattgcccagttgttaagtctggattgccctgggaagatgctgattacatggtgctctgaataccttgcgttctttgccagtagctctcctaaagatttgtgatgcatacattactgcccaacagagaattgggcttgcctcattgcaatttcagaagacaatcctcctgcgtccatcagcttgttattggctggcaccacagagatgtgtttctctggccctcattaattgtaaccaaccctaagagagttaagttgtatcaggcatgtgtayaccttacagtggataagtttgtcagatactttccttagtgcatattttttaaagagatagaataaagtataaatacacatggaatggatgtcaccaataagggtttttaaacactggagaattttatatgggcctgctttgtagatatccttttttttttcaatctatgaactcaaatatatgaaatatgtctgtaccctccttcttttggctgcccagctaagctcatcccaacaasgcttcccagctttcttcaggtcaccaccaatccaatccaggctggaagtgatgagactgagctgtggaatacaaggagcgtgcatggggtgctcttctggatcctggggatatagtggttaaaccgttactgacaacatgctctcatggctcttagatctagtgggggaaagatagccaataaacacacaaagaaatcaaatcttgataaacacttttcagatcactaaaatcagattatgtgagtgtgaccaagtggctgctgtagaaggaatggtcttagaaagctgcttttggagatgacagttaggttgaggatcctagtgaaaagagtgtgaacaaggagaaagaaatccaggcagaggagacagctgctgcaaaaactctaaagcaagacccagcttcaggtcttcttcttyttttttttttttttttttttgacacagggtctcactctgttgcccaggytggagtgcagtgacatggtctcggcccactatagcctccacctcctggactcaagtgatcctcccacttcagcctcccgagtagctggaactataggcacatgccaccacacccagctaatttttgtattttttgtagagtcagggttttgccacgttgcccaggctgcaccttgaagtctttcaagaaccaacagaaggccagggaggggagcaaagtggatgagtgggagaaggatacttcctgagctctttcaaggaggtcagggcaagtcgcatagggttttgttaaccctgacgtggatttgagaawcatcagcacgcaaggaggtatctaaagctggaggcctggatgaggttgcctttgggaagtgaggaaacagcaaaaggaggggcttggtacagacctggatggctcaacctttagaggttgagcagagacgaggggactgcaaagaagcagccaggcaggtaagagttcagatgtcygggaagccacacgagaaagtgtttccaaaagcaacacatgctgttgaagaagcccagaaagaggaagatacagaggtggccaccgatccaatgacaacgtgcaagttgttgatgactttgacgagaccaggttcagtgttctttgggargattgaggaggaatgtgatttaagaatagatgttcatgaccgtagaagtggaaatatgaatataaaggttaaggtttgtttgttttaagatgggacttactgtctttaaactgtctgcagtagaatggaagcaactaatgaaaatgaaggtggggatagaagccatatctccttggggtttttttcccccttaaggaaatatgaggcaaggttttcagggagggaagatggactgactgtaggaagagagagaartaaataacttgctatactgtgaacatgtagtatgaccactggacagtatttacagcctattagaatttgagagattcaggactatttgttttttttaagtccatcactcttatcagtgattttgaccaaatttagttaatacygaagtcaggatctgaacccggggacgtcttgctcagagtctgggcatttgaccactccactccactccactccactccactccactgcctctccacgagttacagctgaaactagtccccagtcagcacagatctgtcatttctccagttctcctcagctatgagcrtgcatagagaaggcasagagttaggttttatgaccaaaagagagagatgagacagaattaaatgtgtttgcaagtcagtaagtatgckatgatggtgaaatcaaagaagtgaagaaccaccgttgtagataatgagcaaattggggatcaaaggataggaaacgttgatgaggtggaagagygagtggtttgattggaagaagtgcagagcctgatttggaagaatcagaggtgcagttattggtgataacatgacaaatgatatgggtgtgagtggctcatgtgggtacaggagcagatcacctgtgttgagaaggttgaggattgagaagtctgggcctgtcccatggatctgacatccaggggtcccagccttyttgttttctacaaaagagaaactcagagcctgtgcccctggaattttcaaataaagcatgtgcttgtcccaaggtatggagaatagcggccgtgcagccaataatgtcactgggctcacttgggctaaagtgggtctcccctttccttccctgccctccctctacccygaaactttccttaactactgaagatcaggccttcttggccccaacacagaaatccctgtggggtggggggcaaggagaactgttgtccactcctgtctgcaacaaaagaagagttcatttttggccaaatgaatgacaatgaatattagggtcttggactgccagaactccctgccagtggcactccctgggagagaaggcctgttcccacacccctctctccagctttctccacctggaccrgatcagttgttctcccttactcccctctaggatccagaattcctggtttgactatcaaaagtaacactacttataaktatttataggatacatcattgactctcacattcactttattataaaatttctttttctmtaacaactctaggtacttttattgttattaggccattgttccttactctttgttttcttgtattatcacatcagtcagcgaccaaatcctgttcattctaactgagatgttccccgatctgtcccctccgtattcttcatgtcttctctcatgttgggcattggagcagctgcttaatttgttctctttgacctttcttgctaaagtccaccctcgcaactctcaacagagtcacttggcaaaacgtaggtctgatcgtgtggctgttttgcttaaaagtctttgatggttccccagrttgctttgttaaacaaaggaatttctactttaaaagtagaatttcctgcggaatctttctcaagttactttgctccaaccacactaaaccgcaccgttccctaaaccacagcctagttaagaactttaaagattccaagcactgactatattttggttcctcccactacttcagaggttcgcgacactagactaatttaacattttattctacaaaatagcaccgaacttaggcatatgtggaaaataactagctgttttccagatttttctgtttctgtcttctcttttcttttgatcactgctccaggcttgctggggctgtaaggaaatgctcagtctaactggagaattttagcattgccttcaacacaaatataaggctacttctgtttgaaggtttatctctggctggaaaatctgccctcctctatctccatttagttaacctttacttttccttcaaggttctacccaatgataacttcctttataaagtgttccctggctcacccaggggtaatcaattgcttagscttttgcgtgtgaacttctgctyktgttaccataaattatctgtatgtctagcatccttgctcattttaccatgttatatcattaaatcctcataattatcatgtaatcttaagtattaggattcctgttttgcagatagtaaacaggggtttgttacccacctaaccaagctattattaatatctaatgtgacaatgggtataattaatttataaaagactaagagcattaaaactggaaggcagtattatttttaatatattgactctgtgtggtgacaagcgttcatctgtattttttcttcttgccaatagtgaagggaatttatgattcctacataaagaaatctttttaatgttaattaaactaaactgtaagaatgctgctatgctcaggtgcaatgcaaataatgaggtgactctatccctgccatctcaggctaatcccctctcccctgaggagctgagactcagctccctggaggtgaaargctaaagcattcccctgttgtgccattttcttccctttctctcatgcattatttttcttactstggttattcttgatgggaatttttagcagagctcagygccatcttatcccaggaagaaaaaaaaattgtaggagataaatgtatgatgaatggtgcaaaacacaacagttgmaatcttttaaatttattgtgaaattaaagaacatgcccctagaatataatcgctggcaattcaaaaagcaaggatttttagcaaaataaataagaccagttttcttcctctgggccttgtgtctgttcatctcagtgagtctttcagcttaaccagtgttgcagcccaagctcttccttgtccttaattagcatcaggagttttcattagttattttacgagttgttagtgatcctcattagctttgctgtggtcttaaattttcttgacatttactgtttcactgcataagattttatggttaattcccagagtatataagccagattattagccgttatattttttacaatgtatatattcccatttcagaatctcttgtatcttaacatttttctttacaattttatataaatgactgtcatccagttcgttgggcttcctgatatcttttttatacatattaaataaggaaaaataagtaaatatatatatcattcactcagttgatagatttttcaagaaagaaaaaaattaagataatatgtttctacaaaaaaagaatgtaatgaaatactgtaatttgactttatagccaaattaggggaacactactatttttcattctacaattattccacactatgctgcaagtattgcccaaggaacagaaggcagaaaccaagtaacttgacaatatattagagaagaataacaagtcaagttattttgaagatttaggtgtattttatttcaaagtgcattgttctccctttgtgcctccttctcaaataacacaacacaggaagctgtcatccatgtaatatatattttttgggggattaatcacttgtatacctgttttattattcattccatggtcattagggcctaaaatgtaccaggtattagggacacaggataacaaggcagcaaaggatcattatattcagatgcaaaaggaaatgtaataaatataaaaygtataaaaagtaagtagccagtttcaaataataatcagtgtcattctgtcaacacttattttctaagtatgtactccatgctaaatactaatctataaagtaactctgatgggtgagtggagggcgaggggagctattttatattagttgctcagggaaggtttccctgaggagatgacatctgaaatgagacttaaataacaagtaaacacagaagagtttttcagctgagtttctgggagtctgtggatagatttcaggaggtctatagacttggatcagaaaaataattacatctgtattttcactcaactcagactgaaatttagcattttcttctatttgaatgtaracaacaaatctcagtagtactagtagcacttgttactttgttaccagtagaaagtatagtttttttaaattatatctcagttttcacaggtgtcttgaaatgttatcattgctttgaaattatgagatttcttggatgtgatactagatctgattctaattgtgttaataaagaagcacatgtattactgtattgattatgtattactgggtaatgaatgacccacaatttgggagctttaaacaataacccatgattctgttggtcagcaatttgggctgtgctcagctgggtggtgtttttttttttgtttttttttttgagatggagtctgtctctgtcgcccaggctggagtgcagtggcacgatcttggctcactgcaagctctgcctcctgggttcacgccattctcctgcctcagcctcccaagtagctgggactacaggtgcccgccaccacacctggttacttttttatattttttagtagaaacgaggtttcaccgtgttagccaggatgatctcgatctcttgaccttgtgatccgcccgcctcggcctcccaaagtgctgggattgcaggcatgagccmctgtgcccggcctcggctgggtggttcttaaggacttgccaggattgctcatgtggttgcagtcatctgacagccccactgggccaaatagtccaagatggccttcctcccatgcccagcagctggtgctgactgcaggctgggccacatggctccaacaggctaccctggggctcttcacatagtcacagtgttacaagacagcaagagcatgagccacaaagccccgtgaggctcaggctcagaactccccagcacttccactgtcttctgtgggtcataacaaatccaaaggccagctcagtcagtttgagagggaattccatgggttgtgacttcagggaagtgtgattaattgggggccattaatatacttacctgtcacctaccaagtcctaatttttttttttttttttttttttctgagacagggtctcactctgtagcccaggctggagtgtagtggcatgatcatggctcactgcaggcttgacctttggggctcaagcartcctcccacttcagccccctgactagctgggactaaaagtgtgcaccaccatacctggctaattttggcatgttctttttttgtacaaaataatcttctggatggggctcmccatgttgcccaggctggtctcaaactcctggactcaagtgatcctcccatctcagcctcccaaggtgtggggtttacaggcatgaaccactgtgcccagcctatgtcataattttaaaaattattataataagttggccgggcttggtgactcacacttgtaatcccagcactttgggaggccaacgcaggtggatcacttgaggtcagaagttcaagaccagcctggccaacacaacgaaatcctgtctctagtaaaaatacaaaaattagccaggtgtggtagcaggcacctgtaatcccagctacttgggagactgaggcacaagaatcacttgaacctgggaggcggaggttgcagtgagccaagaycatgccactgtactccagcctgggtgacagagcaagactctttcaaaaaaaaaaaaaattatagtaattttaacatgttcggtgttttctgtaattttgtcttttacactttttaaaatattattctgagaagaggtacataggcttcagcacattgtcaaagagggtcaagcacattatgagattaggagcccttgatctaaaggcagggagttctggaaagaggagtatagaagcctcaaggcagaagcaagctggcatgtccaatgggatagaggagcagaaggaaagctcctgcggccagagccaaagattgaggggcagagtggttggagacagaggtagggccagatcatgtgacttctttgaaagcttctgaaacttgcaaagggacctccacttccccactgcaccatacccacagagtgtgaaagtaggtattgtatgtaaattgtattttatgattttttggggtcattgytaacttttttcagttatcytggcagaaataagaaaattcttttttgctattccatatatctattgtgatatcagagtctgttgtttgtttgtgtgtttgtttgtttaagacagtcttgctctgttgccaggctgaagtgcagtggtgcgatctcagctcactgcaacttctgcttcccaggttcaagtgattctcctgcttcagcctcccaagtagctaggactacaggcgcgtgccaccacrcccagctaatttttgtattcttagtagagacagggtttcaccatgttggccaggatggtttgatctctcgaacttgtgatccgcccaccttggcctcccaaagtgctgggattacaggcgtaagccaccgcacccagccccagagtctgttgtttatagaggatgattgggcgtagctttctagagctgggaaaaccacctttmaacagtattatataccaatatttactatttcataaattcaggcatatttgcttaaaataatctcctgtagagaggcaagaaacagaagcccatttttttgtttttaggaaattcatagaagccwttggtaaggttcttttaagttggcaaactctattttcagaagacttctatgttgacacttgtgacctacagaattgctttaagaggtcagcactgataaaaacagagggaagctgtaaagggaggattaggctaaagtcaactggtggagtaggcataggtgaattactaaagtgttgatgaaatgactctgttggagttaccagtttattataatgagagctaaagtgaaaaacgccagacagcctagaagcattctgaataacaaggagctccaaccccttatatataaatgaggttacatatagtaggttgaaagcaggtttccaaaacaaccaattagtttgtatagcttcagcttcaggattgatgattacattccataggatattacattaaattgatgaaatctgcacgtctctggggaactccttacaagctagccagtgagcttttatgatgataagatacagaatggataaaaatcttctgatgccaaaaaagctttggccctgcccaagttaggatctatattcatattatcaccaggtaaagtgtcttgcaaactttcttagctttcattcctatcagactgcagttcatgactgtgaggtgtcaaagactctctccttaaccaagcttcagtcatgctctgctaatgtctcttttggaccaggcttcaagcttgctccacccccagctttggcttgcccagcccagccttagcaaggaattctgctaagtcatctcccaaccctagatatctaattacccttgatatctgatcaagttcttcatcctccacctttttgatgtctaagtccttggactgcctttagcaagagtcctgttaggccagcttagcaagaattcccctgcccttgatgtgttcttttagcaatttcccatcctttgacatcctcatgctgttcttggctataaatcttcacttgctcttgctgtttcagagttgagccccttcttttsccccctccaattgcaatggttttgaatgaagtcttccttaccattttaacaagtgtcagaataatttttttaacatctgtctttacaccacagtcaacaaccccttatcctccccaaaactctgagctaacgccactacttagagattacagtgtctgcctattttattagctggaactgcatcagtgattttggagttgaatttttcattttttacatgaaagattatgtgtttataatttgttgttttcacatatgcataaacagaactaggaagagctgtactcaggagtcaagtcagaagaaaaaacatcaccatgttcaaatagacaactgaacatgcctctgaaaaccagagacaaagggagttatttacagttaacatctatagaatatgggccgggtgtagtggctcacgcttataatcccagcactttgggaggccaaagcaggaggattgcttgagcccaggcattcgagaccagcttaggcaacatggcragaccccacctctataaaaaatttaaaaattagctgggcgtgatggtgtgcatctgtaggcccagctactcaggaggctgaggtgggaggatcacttaagcctgggaggtcaaggctacaataagctgtgattaaggcacctgggcaacagagcaagaccctgcttctaccaaaaaaaaaatatatattaaatttgtagaagtctgggcacagtggctcacacctgtaatcccagcactttgggggctgaggcagaaggattgccttcacgagtttgagaccagcctgggcaacatagtgaaataccatctctacaaaaaatacaaaaatgagccagttgtgctggtgtacacctgtagtcccagctacttaggaggctgaggtgggagaatcacttgagcctgggaggtcaagactgcagtaagccgtgatcatgccactgcactgtagcatgggtgacagagtgagamcatgtctttaaaaaaaaaaaatctgtggactatgaagcaagatgagagacatttgaaagcatatgtcggaaagtcaggtatacttctagagctggctctctgttaggatagagacctttaaaatgtttctagtgcttgcagatgtcaccctaccctcctgcaaagataacagtgcatttacttctgtcactgtagattagttttgcccaggtattcttttcttagggctgccgtaacaaagtctgggtggctttaaaacaacagaaatttatcgtctcacagttctggaggccaaaagtcagaaatcatggtgtcggcagggccatgctcccyctggcagctctagggaaaggcctttccttgccccttcctggcttctggtgtttgctggcaatccttgatgttccttggcgtgtagatgggtcacttcggtctttgcctccatggtcacgtggccatcttttccctgtgtttcttcacatagtcttcccatcccacatgcagaagtatgtgtcagtttctgtgtggctgaatttcccctttttataaagacagcagccctatcggattgggcctcctctaatgatctcattttaatttttgcctttgtaaagaccctgggagttaggacttcaacatgtcttttttgggagacaattgaacctacatagcatgtttttgaactttacatgcagaatcatattgtatgtagtcttttgcatctggcttatttcagtcaatatattagtgagattcatctgtgttgcaatagcagtttctattcattgtcagtcctacctaccactatatcaaggctctgcaaattatggtgtgaaggccaaatgcatcatgacttatttttttcgcatatggatatctaggtattacataagaaaatgtggtttttggtttctatgatacttcttcccatatttctctttgtttgaataggaaacaaatctaattaatccttaattaaaagaaaacttttatatcccatctttccatgactatgaatatgttacatgtataaatgtttatatctgttatgtggtcattatacattttgaactaaaacatagcttatacttgccatataagtttatggaaaaagttaaatattttacttaattgattgatttatatcctgtaactttacacataagtcctggtaatacaagcttgttgttaaaaaaaaaattgaaatgatccagaaggacataaaatcaaacgaataggctcctctccttatccctgtggcttgcccagtctaattctttataagtcaccgctattgacagttttctggatattcttacaaatattttttctgacatggaagtgtgcatgtatctgtgtatgtgtgtgttccctgtatttctaacatacctgggatcctaatatgcatactaatctatgacttgcttttyacatttaataatatattgtgactacatttccattttagtacaataaagtttctcctcattctttttttctgtttttgagatrgagtcttgctctgttgcccaggctggagtgaagtggcctgatctcggctcactgcaacctccgcmtcccaggttcaagtgactctcctgcctcagcctcccaagtagctaggattacaggcgcccaccaccacgcctggctaattttttttttttttggtatttttagtagagacggggtttcaccatgttggccaggttggtctcaaactcctgacctcaggtgatccacctaccttgacctcccaaagtgctgggattacaggyrtgagccacagcgcccggcctttctcgtttcttaaaataattttataatgttccgttcaatggatgcatgataatgtgttccccaaatagcaaacgtttagactgtttccaattttttgtgtaagtatacatggatttgtttctgtttctatttacttctatgaaaacatacttaagaatgatttttagatgttgaattgctgggtaatatatatgtgcttttaagtttttgacagataccactaaattgccattcgaaaaaatgcagtaacaatttacaccccatgaggtrtttttattattatttttaactaccaggactttacaccttgtaaaatctacaataagagagttatayattgactgtttactctgttgtttcagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggtaaggtttaagaaattttttgttatactgaagatggatctacatcttctgaccactagggttaaatctccaaacttgtcagaatttattgttactcttttatcttctctctataacatttatgtactgcaatgtcccaaccctcctatttcagctaaaatatagaaggaaaaaatacacctgtaagtagtatagtgtacactaaagtttyattgaataagaaaaagaattttagtttttattttagctctgtgttcatttatttcataagtcaaatgtatcgtaacaaatttaacctgacaacttytcattaaaagcctgagtcttagccgggcatggtggtgtgttcctgtaatcccagctacttgggaggctgaggcaggagaatcacttgaacccaagasgtcaaggtagcagtgagcccagattgtgccactgcactccagccttggtgacagagtgagactccgtcttaaaaaaaaaaaaaaaaaaaaaaaaagcctgggtctgtaagcttgtctatgagcttagggtctccctacaatcactggtctctcactcccttaaaattttttctgtaaattgctttcaaatcgtagaggggaatggattatgaagtwtaaatcaagaaragcaaaattayaagaaaaagaggccgggcgtggtggttcaygcccgtaatcccagcactttgggaggccgaggcgggtggatcacctgaggtcaggagtttgagaccagtctggccaacatgatgaaaccccgtctctactaaaaatacaaaaattagccaggcatgttggtgggtacctgtaatctcagctactcaggaggctaaggcaggagaattgcttgaacccaggatgcggaggttgcagtgagccgagattacaccactgcactccagcctgggtgacagagtgagattccgtctcgaaaaaaaaaaaaaaaaaagaaaaagaaaatgcctgttttctttttcagctgtaacctgactacaaagattacattcgtacatttaaatgatttttttgctgtaatgggggtttgatagcttaattttcctgattggtttgcattgtggattttcagaactattaataattattgaatctgtaattttagaagaatttatttatgaatacagttgaatcragtagttaattaagcaaaggtgaattggatgttcgagttcttttcaaggtgcttcctcagcgacacctctattctggtctaaacgctgttgccacctctcagttcagatsaacagcctatgtgccaggtgctgtgctaggttggacagacacaagaatccayagggcatgattcttgtcctctgtaaacttagaagccagcccagatgtatgcttttacctcactcccttcctgagttggtatctacatgatacactgattgattgattgattgatagatataagggttaagagggaaaagaaaaaaaatccagaagagaaaaatccatgtagtggcacaattaaaatttgatttcttttttttttttttkgcgacagagtcttgctgtgttgcccaggctggagtgcagtggcatgatctcagctcactgcaacctccacctcctggttcaagcaattctcctgcctcagcctccsgagtagctgggattacaggcatgagccaccacacccagctaatttttgtattttcagtaaagacagggttgtaccatgttggccaagctggtcttgaactcctgagctcaagtgatccgtccacctcagcctcccaaagtgctgggattacaagcacgagccacagcgtctggccaaaatttgatttctgatcattgccacttcccccagatttggagtgctggggggaaggcatgtaaggggacagtttcagtccatcaaaaaagggctactggagtatccccatgtgtttctgcctcattccttccgtaagcactgaatccccatatgtgtgctgagggctggccattccagaggctccccaggtcttgatttggctgggataagtgagctcacagtggagaaatgtagacttagaaaaatacatttgtaaagatgcttctcgaatactttttaaaataagaaggggtttttttttkttttttttttttgagagacggagtctcgctcygtcaccaggctggagkgcagtggcgcgatcttggctcactgcaacctctgcctcctgggttcargcgattctcctgcctcagcctcccgagtagctgggactacatgcatgtatcaccacgcctggctaattttttatatttttagtagagatggggtttcaacgtgttagccaggatggtctcgatctcctgacctcatgatctgccsgcctcagcctcccaaagtgctgagattataggtgtgagccaccacgcctgacctaagaagggtattttcttgtggtcctttttttggttattgatgaaacacatagaggatttgaaacaaatttacttgaagtgcaactatttaaagtggcccttccttccygattcctacactcctcactgctctctagagcatggtgagagcacgatcagcagcctccctggagagccttccctgaccgcatgtggagactgatggactcaggaggttaatgaaggccagtattagatattcttgaaagactgccaaggtatcccttgagtattcattaacccagatgccggttctgggagaatttgtactgtcattcctgttgtgagtttccccatgcccttctcccagtaattgaaacatggaatccaatggttaactcagaagttttttaaaaaggaggggggacttacacattttttatttccaacatgccatatgctaattttcccaattaagtatctaattaattcattcaaaatcattttctgcacagagcaccattctggtttattccctgaaattgggggaactgaaatgccacaagtctctcccagctaagaaaatgctgtgtttgtttccagtagtaactgatctttctttatagatgctagcatctatcataaactctctctaatcaataaagttttttggttttttggggttttcttgagacagggtcttgctctgtcacccaggctggaatgcagtggcttaatctcggctcactgcaacctccgcctcctggtcttgtgactcggcctcctgagtagctgggattacaggcgtgtgccaccatgtccagctaatttttgtatttttagttgagacagggttttgccatgttgccctccctatgttgcccaggctggactcaagtgatcgcccacctctgcctcccaaagtgctgggattacaggcatgagccaccatgcccggccctaattaatgaagtgttaagtacaatattgtatgtacaaatgccacagagttttttaaagagatgacaatgagtagcattcggtcacaaaattggactgtgttactttgtactgaagttcccaatacgttgtatagtccttcagcctggtttgatgtttctctaaacagcaaagctactaccattttaaaatgcttagttcaaagaattttcccttctgaagtattatttttcttttagttatttattattttctaagtacagtgtaattattgtttaaaaaacacctcttactttctataaagagtctatttattcatttgtttacattccatttccttccattaacatatagcacctacgatagagcctgatccacagtagatattaaataaatacttgttgaaagaataagaaaactggccaggcacggtggctcatgcctgtaatctcagcactttgggaggctgaggaggatcacttgagtccaaaagtttgagaccagcctgggcaacatagggagacctcatctctaccaacaacaaaaaaaattaaccaagtgtgatgatgcacacctgtggttccagctacttgggaggctgagatggaaggattacttgagcctgggaggctgaggctgcagtgagctgtgatcacacctctgtactccagcctgagcgatagagtgagaccctgtctcaaaaaaaaaaaaaatgggaaaaaaaaaagcaacaattcagtcacacttctaatatgaaacatttcctccaatgtcaggtaataatatataagaatatcmccctgggtgcaatggctgatgcctggaatcccagcactttgggaggccgaggtgggcggatygcgaggtcaggagttcgagatcagtctggccaacatagtgaaaccctgtctctactaaaaatataaaaaagaaattagccgggcgtggtgacaggtgcctgtagtcctagctactcaggaggctgaggcaggagaatcgcttgaacccaggaggyggaggttgcagtgagccgagatcacgccactgcactgcagcctgggtgacacagtgagactccgatccacctcaaaaaaaaaaaaaaaaaaaaagaggctgggcatggtggctcatgcctgtaatcccagcacttggggaggccgaggcgggcagatcacctgaggtctggagttcgagaccagcctgaccaacatagagaaaccccrtctctactaaaaatacaaaattagccgggcgtggtggcacatgcckgtaatcccagctactagggaggctgaggcaggagaatcgcttgaacctgggaggcagagattgcagtgagccgagatcatgccattgcactccagcctgggcaacaagagtgaaactccatctcaaaaaaaaaaaaaaaaaaagaatatcataaggtaatatcataaaagacctaggaaatgtattcagttgttttatttcatttaaccggtatttcaggkgtatctctctatgagatcatgtactttttagagacaaaagatacagtcactggctcaaagagcttgtagtcccaatagggactcctagcaatttgtgtaaatgaatattaaagccacatgttaggtttggcaacacagggatagattaagatctttagagttcctaagctctgaaaggattatgatatctaaccttgaccgtcatgtagttaaaaataaagttattaaactatgaagttgccataaggaatcctaataaagcacttatttttcctatggtgactgctttgatgttgtctttaaaatatcaaacaccagtttttaagcaccttcttgttccgtttcttgcttcctctgctttgctggggctctaatcacatggtgcagccttacaacaacggcacagaaaggagtgatgagtttgcctcagtgggcaccaaagacttcagttaggatgagattcttaacttaggtgttaaaagaggaataagagttttccagatgacagccttttcccaggcggagaaacatgaaacagctgggtgaatagtaggagcttgtaccacatttgagtgagtggtgtgagtgaagctgcccagacagaaagagatcagggccaggcacggtggctcacacctgtaatcccaacactttaggaggccaagtcacgaggatcacttgagtttgaaaccagcttgggcaacatagtgagacctcgtctctacaaaaaaamaatttaaaaaatgaggcgagaggatgacttgagtccaggaggttgaggctccaatgagccatgattgtgccactggactcctgcctgggtgacatagcaagagatygggtcttacaggaagtctaggccatcaattgaataaatactactgaattttaaactctgcagtgcaaactaaattaatgtcttcaagtcaagaccagagttagcaaactttttctgtgaagggccagatagtaagtatcttaggtttcataggtcacatgatctctcttgcgactacccagctctgctctggtagaagcagccatagacaacatgtaaacaaatacatgggagtgtgttccaatagaactgtctacacgaaaataggtggtgggctggatttgctccggaggacatactatttttttttttttgagacagaggctcgctctgtcgcccaggctggagtgcaatggtgcgatctcrgctcactgcaagctctgcctcccgggttcacgccattctcctgcctcagcctcccaagtagctgggactacaggcacccgccaccatgcctggctaattttcttgtattttttagtagagacggtgtttcaccgtgttagtcaggatgatctcgatctcctgacctcatgatcctcctgcctcggcctcccaaagtgctgggattacaggcatgagccaccgtgcccagccaggacatactattattggacaacctctggtctaggccatcagtttaacaaagattgcagcaaaacaggtctacaatgcaaactaaagtaatgtctgcaaatataagcttatcacataatctggggcagtcagagggttggttgaaatactaggaaaggttggcaagaggtgtcctatgttgtccagggaaagaaaaggaaagggttgagaggaagatgactttacagtattttttttttttttttttttttttttttttggagacagagtccagctcttttgcccaggctggagtgcagtggaagcaatcctggctcactgcaagctctgcctcccgggttcacgccattctcctgcctcagcctcctgagtagctgggactacaggcacccrccaccatgcccagctaaattttttttttttgtatttttagtagagacagggtttcactgtgttagccagtatggtcttgatctcctgacctcatgatccrcccaccccagcctcccaaagtgctgggattacaggcgcgagtcactgcgcccggcccaactttacagtatttaagcaggcctgaaagaaaccatgacacaaggaaacacactgctgtctgaagcaatttccaagttgcctttcttataaccacactgagggcaatccttgcttctcctttcataaggaggtaaaggcccttctgatttccatactccttcatcccaagtcacctgcaaagcagtaaatcatgttgagcatgcgtttctggattcctctcttcctccacacttcatcctcagtttccccctgcttcctggctaacaaattgagattcctataatcagagaatgaacctttcatttcactaccagagataaagtaaaaaatgcatgtttttgcttgaagtaacaayctagttgaaatgcagtcagtcagcaagtataaaggaaaggtgrctggatgctttagtgtgggaaaggttgtttgctcggtggaaaaggttggagagagtcagtcacagggcaggagcagtgaactcaaatgaccacaagcagcttataaatagcattaagtacaagatgtaaacaaaaagtagaggccgagtgcagtggctcacgcctgtaatcccagcacttcgggaggctgaggtggaaggattgcttcggtccaggagtttgagaccagcctgggcaacatggtacaaaaccttgtctctacaaaaagaaaaaaaaagccaagcatggaggtatgcgcctgcaatcccagctacccaggaggctgaggtgggaggattgattgagactgggagatcaaggctgtagtgagctgtgatcaagccactgtactctagcctgggcaacagagcaagaccctgtcacaaacaaacaaacaaaagaaaaagtagatggaaaaggaacagccagtgctcacttacaggtgatttttgtgctctgtgaaggtgggcccagtgttgcctgaattatttatttatttttatttayttatttttagacggagtcttgctctgtcgcccaggctggagtgcagtggcgcgatctcggctcactgcaacctctgcttcctgggttcacgccattctcctgcctcagccttctgagtagctgggactacatgcacctgccaccacgccccactaattttttgtatttttagtagagacggggtttcactgtgttagcyaggatggtcttgatctcctgacctcgtgatccgcccacctcagcctcccaaagtgctgggattacaggcgtgagccactgagcccagcccgaacttttgatttttttaaaaaagaaatcagaagttttcaaatgtttgtgaaatcatcagttttctaaatattggcaatcaattccaaaagttttataacgtgttacaagccaaataaagcacatctataggctcgatggtctatgggcaccccttgtgatctctgctttaaatcatttgatgtctgaattggtggaagggacacgggagcacacaccagcctggggagcccacyagagtacagaatgcaaactacagggacacatgcctttgagcaggtagtagatagccagggcctgtcaagttattaggtgtcccaggccaggtaataactccttggagttgtgaaaagtatatttcatttccatgccatcatgtttgtaacatgctatttatagtgcccagttatcatttttcccaaagtgcaatttttctcccatgaagtactcataatcttaagtaatgtagttgatatgtaacccagaaactcctacttgattagaagacagttattggtagtatgccattgatagatttgttaattttttgttatatttattcaaatgcatattcatggtagaacaattagcactttctagttttcattctaaataatggatattataaataatggtctccaatattgactcttttgagtaattctatcagggacatgttgaaattccaatgaccattttttttttttttttttttgccttagaggcatcttttgtacataatgtatttctttttttttttttttycctcaagacagggcctcactctgccacccagattggagtgcagtgacaccatcagggctcactgcagccttgacctccctgggcccgagtgatcckcccacctcatcctcccgaatagctgggactataggtgcacgccaccacacctggctaattttcytattttttgtagagagagggtttcattatgttgcccaggctggtctcaaactcctrtgctcaagcaattcaccgagattacaggcctgagattacaggtgctgagattacaggcctgagccaccgtgcccagtcctcataatgcatttcacacaccatagtgtggtgagcacattctttcactgaaataacactatccatattcacatatacaactggcattgttagaaacatctgctatacatatgtctttatgagttgcatcctattagagcaccacagtgtttcggtgaccagtgagtgctggtttaccatcagctttcattgttcccttctgacggtgtatttctcagttttttcctgggcccagtgctgcccagagtaaaggctacattcttcactcctcctcgcagccaaatggcataagactagtaccagccaatgatatataacaagtgatgtgggtaacttttaatgtccttaaagggagacagtgtgctccttattttgtgccaccrcttagaacatgatcaaatggcaagccacctgagatagtatggtctagactagaaggctgtacaacaacagaggaagagcctggctcctggatgacctcatggagcagagattccatgaggaatctcctcctgtctacctccatactgttacataagagaaaaacctctggctgggcgtggtggctcacgcctgtaatcccagcactttgggaggctgaggtgggtggatcacaaggtcaggagattgaaatcatcctagctaacatggtgaaaccctgtctctactaaaaatacaaaaaaattagccaggcgtggtgacgggcacttgtagtcccagctactcaggaggctgaggcaggagaatggcgtcaaccaggaggtagagcttgcagtgagccgagatcacgccactgcactccagcctgggcgacagagcgagactccgtctcaaaaaaaaaaaaatagaaaaagttccatcttgactaagtcactcttgcttaggtgtctgttacatcagccaggctacatcccaactaaatctctaccctaacctttgcgagacaaaccattgcattgagattatataaagggaagttgggggagaaagagaaatatatgatgatgatactggtcaatgttccctattcttcagtttttaaaatattttttaaaattcragttcaaactaatatatrtgctaaaataaatatgaawctragcacatagtktgtattagcatctaatatcatgatgactttattttactttttctactttattttttcattctccatagttctttattcagcaaatgcacattgaacagcagaattstgttttamacmccatgaaggaacwctgaagcactatgaggagcaatgaggtggataaaaaagtacttactttctctaaggagattacagtgtacttgtggagataaaatgtttcttaaaaggtggcatgtgataagtgccatggaaaggatcccaaggaggcatgtcggctcagaggagacatccctgtcacccgtgggccttcatgaccaagagattgtttgaggaggtttatttttattgcatttcaaaagaatattacctcaataacaayatatggccaggtgcagtggctcacacatataatcctagcactttgggaggccaaggccagaggattgcttgagcccaggagttcaagagcagcctgggcaatacagtgagaccgtctctacaagaaataaaaataaaaaataaaaaaaatagccaggtatggtggcacatgcctgtgatacttgaggagctgaaatgggaagatcacttgagcccgggaggttgaggctgcagtgagccatgatcataccattgcaccccagtctgggcaacagagcgagaccctctctcaaaacaaaccaaccaacaaacaaacaaacaaaagcaatgtaggtattttttgttactggatagtttatgtaactgttctttcagattctgtctatcctttaagcacataacaatgatctttgcattttcatcttactctcaaacattttactgagattatgttattataatcgttaacaaatttatctctgggtataaaaatttcctcattattaataaggaaataaaacaaagtaatggtgatgatacaatcttttcttagattgcaaatattctcataagttattacaaaaaatattccctatttattgggcaaacagtgcccscttttgaccactggatcctatgaaagaaatcctaagacaatagactcttcatctctgctaaaaattgaattatatagagagttatatagatgtatattattagatctaattatatataacatttatgttatatcactataatacctaattatatattttatatatggtatataatttctaaagaaactatcctatataactttaaggatatattgtgtgctttttattatttattttttagactcatgttgtattttgttaagtgattaggtccactagagtgtttaatggcagttttgtaagatccacattttagttttatgaatcttctttatcctgtctgattcaggttgaatacgaaggcttaaagcatgagattaagcgatttgaggaggagacggtactgctgaacagccagctggaagatgccatccgattgaaagagattgctgagcaccaactggaagaagccctygagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctcygacttattcagtgagctgaacatttcagaaatacagaagttgaagcagcagcttatgcaggtaagaactttgtktagggccgctagagtgaatttcttgtagattgcaggtagcatgttgtgggacttctgattctcgcatttcacttctagatttcttttcttttttcttttcttctcttttcttttctgttcttttcgagacagagtcttgctccatcgcccaggctggagtacagtggtgcaatttcggctcactgcaacctccgcctcccaggttcaagtgattctcctgcctcagcctcccgagtagctgggactacaggtgcccgccaccatgcccggctaatttttttgtatttttagtagagacggggtttcaccgtrttagccaggatggtctcgatctcctgacttcgtgatccgcccgccttggcctccaaagtgctgggattacaggcgtgagccaccgcgcccagccccagctttcttttctaaatattgcttcttcarctagaaacttcgaaagtgcagtattttagaaagacatgacagaaggagcgttaaagagaaatgcagtctctcatttgcatcacttcaagaaatgaacttctgagagccacaaattgagctccaatgaagtctgagaaaagacagaaaaaagttccttgggccgggcgcggtggcttacacctgtaatcccagcactttgagaggctgaagcgggcggatcacctgaagtcaggagttcaagaccaacctggccaacatggtaaaaccccatcgctactaaaaatacaaaaaattagctggacgtggtggtgggtgcctgtaatcccacctactcaggaggctgagtcaggagaataacwtgaacccaggaggtggagattgcagtgagccgagatcgccattgcactccagcctgggcaacaagagtgaaacgtcatctcaaaaaaaaaagaaaaagaaaaaagaaaagacagagccttaatgcatttctgattaacaaaagaattcaaaagctttatatacaagtaaaatgatggaaaccatgcagtttttcatcacaagcaactgtgtttatagcttccagatttatggttacatttcacaggaatacttgaagccttaaaagacgtaaaggacttcctatgtacaaattatccaggataccgtatgattaaaaatacagaacaggtataatctaagaccaaaggattcttattgcaacatgagttaaaccttaaatttttagcrtcttcaaaacaaatgtcttgtgaagatcccagccttgaaaaaatcgctttctagtttagagtcttgccttcctgccacatgtaatggaaatgttgtttaagaaacagcagcattaccatcacctgggggcttatttatacaaattgtggagctccgtgtagatctactgaactagaaactgaactagaaatctggtataacaagcttgttaagtgattaaatttgaggcttaatcttcaatctcaatcttatctctccaaggttcttcatgtatagctgataattagaggctgttaagcctctggcagtcatctgcctccacggaaatgatgactggaaaagtgaaattagcagaaataagtaagagaacagagagccaatgatgttgatttgttaacaggtttattttctatgtctttttgctcagtttacactaatatgactagattgattgaaacagaaaacatatttccttgtgaaaaagttttacatgacagatgtattcataagaatttgtgccccccagattgaataccattaaatagaagttttatgagttttgtttaactctcatattggtggctttgagataaaaagttagtgggttcaggctttttgtttattccttttgttttggtggcagtgcagaagataataggaaaagaggcttctatgcatgaaacagcacaacaattttcaascaggtcatctattggctgaaagctcagagctgtgctcagatttaattctaaatgtgatctgaattgggtaatacaaaagtctaaaaaagatgaaaagttcaattaaaagaatggtggaaaacaagtaagtactcagctggagactggctctcctgagttctcaatagactgtcgttttcgtttggtttaggcggttcctcattgccagagaatgttttcttccttgagaaggtttagcgtctctgatcccaactcatgagatgctggttacatttcctcagttgaagtgatgaccagaaactccccatgtatttcaaatgctctgagagtcagccactagttgacagtcattcttagaggacagcactttactttcccatggaatgggatacataataccttcctcgttagagtgtcatgaaggtttatgagttatatgcagagtgctgagaacagggactagtgcacagtaaatgctcattaattatgaactgttatcattatttcaactccattggtcctttaatttattaggcactcactttataataatttagataattattattaactattatttttgggctattagctcaaggccaatcaccccaaaagggactgatgtggatactggtaggaatatagaaaaataacagttaagtctcatggtgcaagaaggtctgaaaaaggatattcatttagcaaaatgttagggtgagaaaaactttgctggataaaccctccatcagtctattgagaaagctgtgtcccttcaaatctttcttcaacccttaactgatgttgacagtttgcaaagatgtagaggggcgcaggtaggtccttatatcccaaagtttgctccagatttagttgtgaaaaccaggttcaacacaggaagggctttgcagcttccaatctcatactaacaacactaactgtaaatttttttttaggtagaatatccatttatcttcttgtaatcagcgtttttaaaaagcatgtcagcttttcctaagaatatattttattcaaacaagtatattcatgagaagtataccttctcatgaactatttttttgcaatacagttttttccttagccacacatctttttgggttaaatttatgtaaataaacacattacaaaaacattacaggatacattgcctagaatttattgtaattggctttgatgttaataaggattaaaaataatatggcaagtctgatcaatgagagtactgtgcacctgaagcatatatgtgtcagtaccattgttctggaaattatgaagaggaaccaatcaaatgtactttaagtatagctatctggaatgcttgggaccaggtgtgttttaaaaattcaggtttcagattgtagaaaggtaatatgcagcatataccacatagattgtgatatctccactgggatcagatgcagcatccggtgatcaaataatattaacatttctgcagtgaaacatgagtattcacactaagaataagatgaggaccattaaaggccttacaccagtcaggtgcagtttggctgccctgggagtttaggactgtctgaatactgccaagtgagttttatcataatcaagtgaattatgataaaacttgatttcgagctttttggattttgcagttgcaggcgttgtaggaatagcactgtcctgttgggcggctgtcagttttgcgcacctcagcttayagtgtcaacatacttggaacgtgacagtttgtattttcatttttttttattattattatactttaagttctagggtacatgtgcacaatgtgcaggtttgttacatatgtatacatgtgccatgttggtgtgctgcacccattaactcgttatttacattaggtatatctcctaatgctatccctgacagtttgtattttcatagttcctttatctcttaggatttctcctggcctggatccaaaacactgcatgggagaggccgccttgtgcctctaatccaacagctgtgcttagctaacagctcatgacagtgtagaggggcacaggcaaggctgtaackccctgaaccaggtgatatgcagcagttcaggttttcttccttctgatcaagtacccctttgatggagtaagttcaagagatctatagtacaacacagtgactgtagttaataacaatgtattgtattgaaaataaaagagtagattttaagtgttctcagtgttgtagaacccctaaatgtaggtccacgtgttggatgggcagtaagccaaatactgacacatcagtgcttagcagcagagaaaggtgtattcatttttccaaaaatgacattgtgggagaggcaatcggtcaaatcctacctgcctttgaacgtaactgggggtttttgtgagtaaggcagctgtgcaggagaatgaaatcccccaatgatcaaagttgtttgtgtcccgcagctcaatcagacttctggatgccatcaaggaggtctgcatgacctaaggatcattgttctttgaaaggaaaacaagttcattaatcttactggctgccagggttaggatgcaaagttaatcaattattagtgactaccgtctaccgaatgactacgtgcaagcagtcatgcatggaggaagaaaaggacaaagagaaaggaaaataagtaaaaaacaaacgtttaatgattttgataatataggctcagttacatcaccacaaacatgataagtatgtcaggtcatgcatgtcataattagctcaatttccactttgcctacatatttcaaaacatcatgttgtacatgataaatatgtacaatttttgtcagttaaaataaatacattaatttgtttttaaagaactcctttgaaaacagtatacctagtccatataccctttcggccttttcttctcctacaaggctcaatgtatgcccatgatttatgttttcccatccataggtatttatttaacctggttccaggaaaaaaaaatgcctctgtcgacgaagcaagtcaaactctgtaaaatattttaagagatttattctgagccaagtatgagtgaccatggcctgtgacatagccctcaggaggtcctgagaacatatgcccaaggtggtcggggtacagcttggttttatatattttagggaggcatgagacatcaattaaatacatttaagaaatacattgggccgggtgcggtggctcacgcctgtaatcccaacactttgggaggccaaggtgggtggatcatgaagtcaagagattgagaccatcctggccaacatggtgaaaccccatctctactaaaaaaaatacaaaaattagctgggcatggtgatgcatgcctgtagtcccagctacttgggaggctgaggcaggagaatcacttgaacccaggaggcggaggttgcagtgagccragatcgcgccactgcactccagcctgcgacagatcaagactctgtctcaaaaaaaagaaaaaagaaagaaatacattggtttggttcagaaaggtgggacagctcacagcgggggcttccaggctataggtaaatttaaacattttctggttgacaattggttgagtttgtctgaaggcgtgggatcaatggaaagaaaatgttcaggttaagataaaggattgtggagaccaagttttattgtgcagaggaagctctcagatagctgacttcagagagagcaggttgtaaaatgtttcttattgcacttagaagggtgcctggctcttagctgattatctcctggatctggaaaggaaggaaggaaaacaaagcggggaaaggggattytctacagaatgtggatttttcccacaagagactttgcagggcaatttcaaggtatggcaaggaaatatattttggttttctttctttgccagtatcagattggaaagtaactcttgatatacagggttaaataaaacgcatccgatgagaatttatggtttgtagggcatgaactccccagaccccttagataggaatttgggcaagataaaaaaaaatcagatcttagtcctcacctctgccttaattatcaggaatgttgagtgaattgttttgcttctctgaggctcattcaaaaggggaaggtaataaattagccccaccatttgtctctkycatgcctttgttggaactatggaaaaaacaaaacaaaacaaaacaaaaatcaggtctccttcttgaagccatcatactgccatctgctgggaaatggtaataacaagtataaacatttatagctactacaatttaaatagcacctcctggagttgtttgcatacaacctgcagacttctgcattgaagccctggtgataatgccatgcctcctctgtagaattgtgaggaccaaatgggatggtaaatatgaaactrtgtataagtcataacattttataaattattattgtcctggaaactgccatcaggtttcgagatgccaagaaggtccccactatccctgtgtataaacggtcaatacataaattataaaaagtatgggaaaggcaagtggtggtaagcctgtatctaaattagggagagctttttctcagaataaattagagtgaatattttactgaattgtatgccttcctaggttatggaataaaatacaggaatattttaaacttagctaatcatgctaagtttcacataatacagaaacatatacacaaaaaatacagtaagaaaacattttgattcacctcagtctctataaacttgacaatagtccttgatagtgaatagttcaatgagtgtcatcctttattcatgagagaagtttttcagagtattatcggataaattattttggttttttggtgccctcaagacctcattatttcaaataggttgtaattgacattttccagtggcagtcaaataccttaattagttttattagaatgaaaataagtagattctgtctggaaatactaactaaattacttaatcaatttaaaggtgtcctgtatgcttgtgctgaaatttctgtctttgataaatagcctctaactttacatctgcatagagtcaaactaagcaggggaaaactctttggatttttttttttcagtattatgctgggtatataatttcacatgtagtatgagaaaacagtaatgtttctgtaaaactaaaattaatatattctgttgcatcctcatggatgtggaagaaatatattcatattatgttttgatccactctattaaaggcaattttagttttttctataatgattgatgttaagtggtgatggtaatttgctatatgtcccataagagttcaaagcaatttttatatatttgcttaattggttgctgcttataacaactgtatggggtagagagtattattatcttcatattatagatagggaaactgaggcatgactgtgttatgtcattagttcaaggtcaaaaatctagtaagtggagttgctacacagagacagtcgaacaagtgaaatattatctctgcttaaasactcacagaatatttataggatgacattaatgaaaacaagattggttagttcttgggttctgaaacttaaagtgacaagtataattatttcctagtacaaagctgacaaatggctaaactattacagattttatagttagagattacaaactagctgggcgcagtggctcatacctgtaatcccagcacttcggaaggctgaggcaggaggatagcttgaggccaggggtttgagaccagcctgggccacatggcaaaaccccatctctaccaaaaatacccagaaaaaattagctgggcacggtggtgcgtgcctatagtcccagctactagggtcgctgaggtgggaggattgcttgagtctgggaggaggtcaaggctgcagtgagccatgaccatgccactgcactccagcctaggtgaaagagcgtgaccctatcaataaataaataaaataaaaataaatggaatcatacaatgtgtggtcttttgtgactggcttctttcacttagcataacattttaaaggttcgtccatgctgtaatatatcagcacttcattttcatttctttctgttgtcaaataatactccatggtatgcagataccacatttcatgtaaccattcatcagttgatggacactttagttgtttgtttttttagctattatcaataaagctgctatgaacatttgtgtacaagttttcgtgtgcacrtatgttttaattcccgggggagttaatactagaggtggaaatgctgggtcatatggtaattctatgttttaccttctgaggaactgctagttttgaaaacaaatcgagtgtaccattttttatccccaccagcagtgtatgagtgttccgatttctccacattctcactaacacttgttattatgtgccttttcaatcatagccatcctggtggatgtgaagtggtatttcattatcatcttgacttgtatttccttgatggctatgatgttgagcatcttttcatgtgcttatctgctcttttatatcttctgtggaaaaatgtgtattcagattattttttgactgggttgtctttttatttctgagttgaaagtgttctttactgatttggatacaaatccctcatcataaaagtgatttatgatttgcaaatattttctcccattctgtgggttgtcttttcactttcttgatggtgtcctttgatgtacaaaggagtttttttttttttaaaagagatgggtctcactatgttgcccaggctggagtgcagtggctattcataggcacaatcatagcacactgcagcctcaaacccctggactctcctggcctcaagcaatcctcccaccttagccttctgagtagctgggactacaggcgcatgccactatgcccagctaaaaaaactttttaatcttgatgtgtctagtktatttttttcttttgttgtttgtgcttttggtgtcatacaaaactgttgtctaatctaaggtcatgaacattcatggctaggttttcctctaagagttttatagtttatctcttacatttaggtctttgatccattttgacttaatttttgaatatgatatgaggaagagatcaacattactattttacacgtgggcatccagttgtcccagcaccatttgttgaaaagactattctattctttctttcccctattgaattatctttgtacccttgtccaaaatcaactggtcatagatgtatatatgggcttatttctagactttcaattctattccattaatttatatgtctgtttttatgccaatactatagtatcttgattatagtttttttgtagcaatttttgaaataggaaagtttgctagttctttttcaagaagtttcttcaggactgttttggctattctaggtcctttgcctttccatataaattttatgaccatcttgtcaatttctgcaaagaatccagctgaaattctgttggagtttgcattgaatatgtaaatmaatttgggtagtattgccatcttaacattcagttttttgacccagaaacaggggctgtttatccctttatttaggtcttctttcatttctttcaacaatgctttataattttcagagtacagatggtccttgacttgtgawkgttcgtctagacttttttatttaacaatggtgttaaagcaataccatttagtrgaaaccatactttgagtacctatacaactgttctgtttttcattttcagtacagtagtcaataaattacatgagatagtaaacattttattataaaataggctttgagtggggctgggcgtggtggctcatgcttgtaatcctagcactttgggaggctgagatgcgtggatcatctgaggtcgggagttcgagaccagcctgaccaacaaggtgaaaccccgtctctactaaaaatacaaaaattagccgagtgtggtggtgtgcgcctgtaatcccagctacttgggaggctgaggcaggagaattgcttgaacccaggagccagaggttgcagtgatctgagattgtgccactgcactccagcctgggcaacagagtragaccctgtctcaaaaaaaaaaaaaaaaaaggctttgagttagatgatttttgcccaactgtaggctaacgtaagtgttctggacacttttaaggtaggctagactaagctagaatgtttggtaggttatgtgtattaaatgcattttggacatgatattttcttttttttttcttttttgtttgagatggagtctcactctgttgctcaggctggagtacagtggcaygatcttggctccctgcaacctccacctcctgggttcaagcgattcttgtgcctcagcctcctgagtagctgggaatacaggcacgtgccaccacgcccagctaatttttttttattttttattttttagtagagacggagtttcaccatgtcggcctggctggtctcaaactcctgacctcaggcaatccacccgcctcagcctcccaaagtgctggaattacaggcatgagccaatgcgcctggccatacttaggatattttcaatttacaatggttttattgagatgtaaccccatcacaagttgaggagcgtctgtatacattttgcacttcttttttttttctttttttaaaattttattattatactttaagttttggggtacatatgcacaacgtgcaggtttgttacatatgtatacatgtgccatgttggtgtgctgcacccattaacttgtcatttagcattaggtatatctcctaatgctatccctccccactctccccaccccacaacagtccccggtgtgtgatgttccccttcctgtgtccatgtgttctcattgttcaattcccacctatgagtgagaacatgctgtgtttggtttttttgtccttgcggtagtttgctgagaatgatggtttccagtttcatccatgttcctacaaaggacatgaactcatcattttttatggctgcatagtattccatggtgtatatgtgccacattttcttaatccagtctatcattgttggacatttgggttggttccaagtctttgctgttgtgaatagtgccacaataaacatacgtgtgcatgtgtctttatagcagcatgatttataatcctttgggtatatacccagtaatgggatggctgggtcaaatggtatttctagttctagatccctgaggaatcgtcacactgacttccacaatggtcgaactagtttacagtcctaccaacagtgtaaaagtgttcctatttctccacatcctctccagcayctgttgtttcctgactttttaatgatcgccattctaactggtgtgagatggtatctcattgcggttttgatttgcatttctctgacggccagtgatgatgagcattttttcatgtgttttttggctgcataaatgtcttcttttgagaagtgtctgttcatatcctgcrcccactttttgayggggttgtttgtttttttcttgtaaatttgtatgagttcattgtagatyctggatattagatccagatttgtcagatgagtaggttgcaaaaattttctctcattctgtaggttgcctgttcactctgatagtagtttcttttgctgtgcagaagccctttagtttaattagatcccatttgtcaattttggcttttgttgccattgcttttggtgttttagacatgaagtccttgcccgtgcctatgtcctgaatggtattgcctaggttttcttctagggtttttatggttttaggtctaacatgtaagtctttaatccatcttgaattaatttttgtataaggtgtaaggaagggatccagtttcagctttctacttatggctagccagttttcccagcaccatttattaaatagggaatcctttccccattgcttgtttttctcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcctgatgcctccagctttgttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttaacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgctttggctctctgtttgtctgttattggtgtataagaatggttgcattttgcacttcttttgttaaatttattcctgccgggtgcggtggctcacacctgtaatcccagcactttgggaggcctaggcaggtggatcacctgaggtcgggagtttgagaccagcctgaccaacatggagaaaccccatctctgctaaaaatacaaaattaaccaggcgtagtggcgcatgcctgtaatcccagctacttgggaggctaaggcaggagaatcgcttgatcctgggaggcggaggttgcagtgagctgagatcgtrccatcgcactccagcctgggcaacaagagtgaaactccatctgaaaaaaaaattttattctgaagtatattattttttgatagtgctataaaagcaattgttttattaattttatttttcatttttcactgctagtatatagaaatacaactgatgttcgtatattgattttgtatcctgccaccttgctatacttgcttattagtcctaatagttgtttcttagtgaattccttaagaatttctattaatatwtacaagagcacgtcatctgcaaataaagatcattttacttttttctttccaatctcaataccttttatttgattttctcacctaagttccctggctagaactctagtacaatgatgaataaaaatggcaagagcagccatccttgttttgctctgggtgtttcatagatgccctttatccgggtgagggagttttcttctatgactagattgttgacttttttttattatcacaaatggatattaaattttgtcaaatgctttttcttcatatattgagatgatcatgtggtttttgtcatgtattctattagtatggtatattatatttattgactcttgaatgttaaatcaacattgtgtttctatgattgcatttggttatgttgctggattcagtttgctagtattttgttgaggattttgtgtctatattcataagaggtcttggtctttagttttcttttcttataatatgtttctctgggagggagaggtcgtttgttttttagtttcgtttttttttcttttttgaaacagtcttggtctgttgcccaggctggagtgcagtgacgtgatcttggatcgctgcaacctctgcttcccaggttcaagcaattctcctgcctcagccttccaagtagctaggattacaggtgcccactaccacatcaggctaatttttgtatttttagtagagatggggtttcaccatgttcaggctggtctcaaactcctgacctcaagtgatcctcccgccttggtctcccaaagtgctgtttctctagttttggtatcagagtaatactggtctcataagagttgggaagggcccctctccctccatcttttttagtcttcgtccagttgactgacttttgtgtgttagtgtgcatgaattttcttttcaccacacactctaaagtagacacttttaacaactgatgaattccctcatatagagtttctttgttctatcttgatcttttttcatagaattatcttttgttggggcacagatatgcattatcagagttgtttctcttcaagcagagaagaacaaattatttaggagttccgtttgtgcatatcgatgctatgtatactgttagaagaatcacatgatcatttaagtgtcaaactgagagtcaaaagacttggctgggcagggtggctctcacctgtaatcccagcacttgggaaagccaagttggcaggattgcatgaggccaggaactcaagatcagtctgggctgcatagagagaccccatctctatttataaaaaggttttgaggctgggcacggtggctcacacctgtaatcccaacactttgggaggccgaggcgggcagatcacatgaggtcaggagttcaagaccagcctggccaacatggtgaaaccccatctctactaaaaatacaaaaattagccaggtgtgttggcacgtgcctgtaatcccagctactcgggaggctgaggcaggagaattgcttgaactgggaggcagaggttgcagtgatccaagatcacgccactgcactccagtctgggcgacagagtgagactccgtctcaaaataagtaaataaataaaaaataaaaggtaaacactcagtgaaataaaaaaaaattctatgggatataggaacaacaatgacaatagtaaacatatgttgtatacttacactagactaaacagttcacaaatactgaagtcaggttttctggcaaaacaaccagctctgctgtgaaaaaataaaatctccagttccagacagaaactgaagattgtaggaagagaaataagacaactattctcagtcactacagaagatcataataaactcctcaactctctgttggataaattctttacaaatggaaattaaaatagtaacacttaaaatgtatagtaattttaagctttaaagtgctttgcatgttattcattcagagcactaaatctaaaacaatttaggccaggtacagtggctcacgcctgtaatcccagcactttgggaggccaaggtgggcagatcacctgaggtcaggggtttgagatgagcctggtcaacatggtgaaaccccgtctctgtgaaaaatacaaaaattagccgggcgtggtggmacgtccctgtaagcccaactactcgggaggctgaggcaggagaatcgcttgaaccccggaggcagaggttgcagtgatccaagatcacaccactgcactccagcctgggcgacagagtgagactctgtctcaaaataaataaaaaataaaaggtaaacactcagtgaagtaaaaaataatttctatgggatataggaacaacaataatcatagtaaacatatgttgtatacttacactaaacagtttacaaatactgaagtcaggttttctggcagaacaaccagctcttctgtgaaaaaataaaatctccagttccagacagaaaatgaagattgtaggaagagaaataagacaactattctcagtcactacagaagattataataaacccctcaactctctcttggataaattctttacaaatggaaattaaaatagtaacacttcaaatgtatagtaattttaagctttaaagtgctttgcattttattcattcagagcactaaatctaaaacaatttaggccaggcccggtggctcacgcctgtaatcccagcacttttggaggccaaggcgggtggatcacctgaggtcaagagttcgagaccagcctgaccaacatggtgaaactctgtctctgctaaaaatacaaaaattagccaggcgcagtggcagacgcctgtaatcccagctacttgggagactgaggcaggagaatcacttgaacctagraggcggaggttgcagtgagccgagatcacrccattgcactmcagcctgggcgacagagtgagactccgtctcaaaaaaataaaataaataaataaataaataaaacagtttaagcatctgctctttgaaatccaaataccatttaaggtactctaagccttaatagctgagtgaaaatacagtgttggagttttacaaaattacctgtattttagtaatttttttgtcaggccaaacttaattatctgggagaaatatatatagatagatagatatgatatatttatatgtgtataatatatatttacatatgtgtgtaatatatatgtaatttggatacaatttcctattcaattgatttcagcagaaacgtattaaatatagaaagtagtactgtatagcagcagtccccaactttttttggaccagtgatctgtttcatggaagacaatttttccacagatagggtgcgggtggtctggggccattagatctcataaggagcttgcaacctagatccctcgcatgcgcagttcacaatagggttcgcactcctatggcaatctgatgctgccactcatctgacaggaggcagagctcaggcggtaatgtttgctcgcctgccactcacctcctgctgtgtggcctggttcctaataggccacaaactggtactggtcagaggcctgggagttggggactcctgttgtgtagggaggaaacacacatgcaagagacagtgttctatttgatgttttctggagatgctatcgtgaagacactgtagacttacctttttaggcttagaaaatgtttatattaaatctcaactgtcagagtccagattgaaggctgttctaaaggcatgaccttattcatcataacacttttgctgctaaaacaagcttcagacacattcagtacattttgttttgatccaatatttatttgatccagaggcytttccttttgaagggcgttttggaaacagccttatctgtaatcatgtgtactaattgaataacgtttacactttccagtgcaaatttgcttaattttcaaaggaaaaarggaaaacaaaaacacttctgacataatcagttttcactgagattgtatagaatagagattttccatctcctttatgaaaaattcaaatgacatggctattcatgaaataccatattacataattaccaggtttttcactgaaaactattgcccaaatagtctgggtaagcaaattcatcatcacctctggagatacagtctgttataactaatgaaatccagctaagatttgtattcaaatatttcctgactctaaaatgaaagagttgcttttataaaattttcaaaattgtgagaacagatgtgtttgccatgtaaaaacattttggttgtgggaggtggaccacagctaaccaattgttcacaatagctaacattgtagaaccttcagtattaaattcactaactcacttcatcatcaaaattccctatgaggcgttactgtgctccttgcataggttaccaaactgaagctttctcagagtcacatagctaagtaaatgttggtcccgagatttgactccagtgttctctgatgccacaggcccagttctttacctgcagtactatcatttgggaataatttggtttctgcagccataatatataatttgtgggttgctttcctttcataggtatggacaaacactatgtcataaaatcagagctacaacttaaaagcctctaaataacaccttgagataacaaaactgtatcttaggttctaatatatgtgatcatactatacaggcagtccttggtttgcatagtagtctgggacagtaaaaaatggtcrtgcaaactgaaaccatgcaaaacaaacttaataattaatggggaaatttacaattgttttgtgatctttaaatatttttgtgaaacattaaaaagtctcttactgttggttataaatatatatagaaatgaaaatatagtaaaactacttagtacttcataatttaaaacattaggaayattgagagttaaccttttatttctttgtaaacagcttatcaagagtattttgatcttgccttcccataaagcttagggccgggcrcggtggctcacgcctgtaatcccagcactttgggaggccgaggtgggcagatcacgaggtcaggagttcgagaccagccgccaggctgaaaccccatttctactaaaaaccccatggtgaaaccccatttctactaaaaatacaaaaattagccaggtgtggtggcgtgtgcctgtagtcccagctgcttaggaggctgaggcaggagaatcgcttgaacccgggaggcggaggttgcagtgagcgtaaatcacaccactgcacttcagcctggtgacagagctagactccatctcaaaaaaaaaamaaaaaaaaaaacttaggacactgagcaagaatcttttctatgctttggcaaattgtcatcctcatttctaagtttggatcaccttccaacattttatcctctgcactttaaacatctggaaatatctttgtgagtacctttaatgtgccagcatcacttcctcttcgacattttcatcctttttgcaactactgtactgtacttttctttttctttttctttttcttttgagatgaagatggagtctcactctgtcgcccaggctggagtgcagtggcacaatctcggctcgttgcaacctccatcccccgggttcaggcaattctcctgcctcagcctccccagtagctgggattacaggtgcgtgccaccttgcccggctaattttttaaaatatttttagtagagacggggtttcaccatcttggccaggctggtcttgaactcctgacctcgtgatccacccacctcggcctcccaaagygctgggattacaggcatgagccaccacacccggccatactgtactttttcatttaatagattgaaaaatttgcctccactaaatttctttgggtgmacatctaaagtccctcaaacagcattagtgtcaacatttccatattcagttatttcttctataactccatttaggtagttttggggatttttttagaggcagggtttcactatgttgcctcagctcctgggcccaagcaatgcttctgcctcagcccctggagtagctaggactacaggcacaccccactgcacctggctccatttatgttttttttttcagatttcatttccaacattgtcactctttgttgctgtcctttctttcttgtaattcatttttgtaaaacatcacatggatttatcactaggagacaagacaaggcaactacatccttagctgtctatgagtgaactgaataacagatacstagtaaccaatcactggccgactttgaatgaagtggtgtcattggccgttggtcatgatgttatgtagtgmttttatagactgaagtgctggcagcaaagattgtgcgttatgcattgctcacaatcaatrtatttggtcattgaaatttggaccatggtttgaggagtagctggtgttttaactaaagcatagtaactgaaacttacccatatyagaacctcgccaagagaggactaccatgaaagttaaatgaggggcattaggttccataaaggatcataaaaatactactctactctattatacatttacatatacacatgtgtatcctaaagtaataagctagttttaaaatattaaccatacttaatgattaatatttattatatctaattataataattttacttgccacctagggatttagaagagttcagagggatttaatgtatgatccaggaagtttgaaagtttgaattgggccaggcgcggtggctcacgcctataatctttgggagtgtaatctttgggaggccgaggtgggcrgatcacgaggtcaggagatygagactatcctggctaacacggtgaaaccccagctctactaaaaatacaaaaaaattagctgggcgtggtcgtgggcgcctgtagtcccagctactggggaggctgaggtgggagaatggcgtgaacctgggaggcagagcttgcagtgagccgagatygcgccactgcactccagcctgggagacagagtgagactccatctcaaaaaaaaaaaaaaaaaaaaaagaaagtttgaatagatactttcctttagatatgaagacattcagcatcaattcattgctcttaaagcagatctcatgatggtttattttttaaaaagaagaagaaagaaaagaaaacacaagtgcagaaggatatgaacaccatgatacttcttatagaacrataatgtaaacaatattatttggttattgagaaacatttacattataaatgtaaaaactcataattcataatattyacccatatggaaggagagaaaatggtttaaaatttttccacattgcaatttcttatatacctatgtttaatgagacagtattttatatggacacctgagtgtttttcatcacacggtaatacttacatatcacattattcaaattaattactaatatttaaaattcctattttggactgaaggaattgaattgacttataagttgttcttttagccctaaaattctgtatgtattctttgacttttatattagaaaccatcaaagctgggcgtggtggctcctgcctataatcctagtactttgggaggcrgaggcagggggctgacatgcgcctaggcattcaacaccagcctggacaacatagcaagactctgtctctacacacacacaaaattagccaggtgtggtggtgcatacctgtagtcccagctactcaggacactgaggtggaaggatcacttgagcctgagaggcagagcctgcagtaagccctgattgtgccactgcactccagtgtgggtgacagagygagaccctgtcttaaaaaaagataaaarctatcaaatrtagtgcgtgtttattttggggactaaatgcttatttttaaggggatggttaaagtactcagcattatttagggagttaaagccttaggttttaaacctgatttggggttgagctctgggaaggaaaagatgattgattcataggcaccctgatacagtcacttatratctgaaaagcagatgtactctaaggcactcaaaataaaaataacaccrgtcctatgcttatctcttaaagtcatgttgttttctgcaaggtgttaaaaatcaaaataagattgttctaataacattgaagtttcktcagtatatgtgtatgatacaagcgaaattgatgggtaactacttgcagtataattcttttagaattatgtacttttagattgacttaccagaactgctgaaataaaaaacactccaatttaatttgaaatagtgggaacattggctctgctgcagtgattttaagtgtatacatgcccgactgtgaatggattaagttcatcattggtgctgccttgaggtgattcagaaactttcttttgccattgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagyacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtstcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcycccatgattgataaagacaaggaagccttaatggaagagatcctcaagctaaagtccctgctgagcaccaaacgggagcagatcgccacattgagggcggtgttgaaagccaacaagcaggtaatctcattctactggtgaaagcatgccagtcaaagctttcttaactaatttattccctaattttattgagtatcgagtatcgtcragatgagagttcagattcttggtaagtggataaataaaactgtcccagtgccagatcagaatgtcataataattattgtttttaaatgatgaaatacctgtgcccagttaggtggaggcagaggtgaggaacttaaagcaggaacacaggagaagatctagatgcctttctgcagatgtagaaaggcagctcaggcggtgctgggctgaagcctggcagtgagtggctgtggaaacaggagatggagggtggcagaataggctggcaaggcaggttacaccaaccagggcgatacagcaagaaagacaaacacccagcaggcagctagagcaaacagagggaaatctgggtacatatggtgaagaaggtctgatggccaataactggaccccagctttggagctggaggttcagattcaagactcaatttctaggagtatagcaaaattattattattwttwttttttatttttgttttgagacagagtctcgctctgttgtccaggctggagtgcastggcgccatctctgctcactgcaacctccgcctcctgggttcaagcgattctcatgcctcagcctccgaagcagctgagattacaggcatgtgccaccatgcctggctaactttttgtggagacagaatttcaccatattgtctaggstggtctcraactcctgacctcaagtgatccgcccacctcggcctcccaaagtgctgggattacaggcatgaaccaccgcgcccagccaagtatagcaagattaaaaggagtgttttgtccttcatcccaaacttagagaaacaagagcgctaaataaatgaataagtcagggatgaaaggcaagacaactgtgaggacctgagtgagtaacagaaacaaagccagacagattgttaccaacaaattaaatagtttggggccactttagcaaggaaataatagagagtgtgtgtgagagagtataagaatgagctctacctgtgctactgaccacgtatctgaaatttaggttcatttgggatgttaacccacctgggtcagaggttaagtaatagggagcttttcctagctattgatcttgtccttctggacaagtagtaatgttacaacatgaacctgtctaattcccagccctccttaatgactgaaattgttttcaccctgagttttaccttggtgggagtgctgcgaaatataggcaggaaaattattttcacctttatttagtttatctgaaaagatattcttgaaagacacatatttgagaaaggtgctgaataaatgttggtgttgataaagagaagcaacaaagcaccaaataccctcctgcaaacgcaagcagtgccagtgaatagtaggtcaagggagctcttggtctttggagaatgaggattaatttcagattcagagtgtcttctccatttgccatcatctggggaaaaccacgcccttattatctcatctacagtgcagctttcaagtcctcatctctagttcccataaatctatttatataattgacatctataccataagccataatattgtttgcactattaacatgttttatataaacctaagggcaaaatatgactttattttatgttgtcactttagagaaatagaaaagattagagtgaatgaaaccatcattctcagcaaactatcgcaaggacaaaaaaccgaacaccacaagttctcgctcataggtgggaatcgaacaatgagaacacatggacacaggaaggggaacatcacacaccggggcctgttgtggggtggggggaggggagagggatagcattaggagatttacctaatgtaaatgacgagttaatgggtgcagcacaccaacatggcacatgtatacatatgtaacaaacctgtacgttgtgcacatgtaccctagaacttaaagtaaattaaaatatatatatataaaataaataaaataaaaaaagaaaagattagagtgaatgaagaatttgtgagagatctgactctaattttaggtcggaataaaggaatttattattrtaactctgctataatttaaagacccaatgattcagagtggtcataaataaccaataccatattagataaggcttacacaaggacatgctatcctggggcattcttgatcaagccatccagataacttctctgacttcttcctaaaggttgaatattaacaatttaggtctgggcgcaatggctcacgcctgtaatgccagcactttgggaggccaaggccagtggatcacttgaggtcaggagtttgagaccagcctgaccaacatggagaaacaccgtccctactaaaaatacaaaattaaccaggcgtggtggcgggtgcctgtaatcccagctactcgggaggctgaggcaggagaatcacttgaaccccggggggcggaggttgcggtgagcctagattgcatgattgcactccagcctgggcaacaagagcgaaaatctgtcttwaaaaaaaaaaaatcaagatgcttaactgaaacagaggtatagataaggacacttggccaaccaacagagactaatttgtgaacaagcattcattgattacatattttctgggaggcagtaagtagggatgcaaaaataaatgacataatctagtaggaattccgcaattgcctgtagctgtttacaagacaggacttatcaagcactttagagtgatgtaaacagtaccacaggaaatcagaacagaacaaagcattcctagctgaagttttattttcactgtgctttgtggtacaggttgagtatcccttttccgaaatgttttgggggacragaaatgtttcagattttggattttggacatttgcatatatacataatgagttatcttggggatgggatccaggtccaaacatgaaatttacttatgtttcatgtattcctatatacatagcctgaaggtaattttatacaatttttttaatgattcygtggctgaaacaaagttttgactgccactcatgacatgaggtcaggtgtagaattttgtggctcatgtcagcactcaaaaggtttcagattttgaagcrttttggattttggattaaggatgctcaacctgtaccatttgcattacattagagttacagtctatatgggctcagtaaattaaatgaaaacacatttctagcaatgcatttggtctgcacgttcatgatgttggggctgttgctgtgatgcttattgccgtaaatagcttcaagtattaacagatgacattcactatatttatttagacattgtgaaatgtttgtttttaaggttaaggtgagaattctggggtacaggggaaaaaaggaaatctccctgttttaaaatasgcattctactatacagccataagaaagaaaagaatgagatcatgtcatttacagggacatggttggagctggagaccattatccttagcaaactaacacaggaacagaaaaccagataccgcatgttctcacttataagtgggagctaaatgatgagagcaaatagacacatagaggggaacaacacacactggttcctgttggaggctgaaggatgagaggaaggagatgatcaggaaaaataacaaatggatactaggcttacakacctggtgaagaaataattggtacaacaaacccccatgacacacatttacctatgtaacaaacctgcacatcctgcagctgtacccctgaacttaaaagttaaaaataaataaataggcattctgtagtctctatgaatcttctcatttacttaaggattttttcataggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatgcagaggaagcaactaaggtttcctagaggagcggaaaagacttcacagaagcaattataccttagtttgttattaaaggataagaagttgttttccagaggaggaggaagtaattccagacagaacagtaggtagagaggctttggagtgacaaaatagaataatatattcagggaatgctcacaaaggcctatgtggctggaaataagactttttttatttagaaagtcaactttggaatgtgtggagaaagtggtgaaagcagaaatcagcaaatccagtgagttatggatacttaaaattacttaattctggaaaaactttgcacagtcaatggacaaacaaatctacaaacaaaactgaggctttggggtatttgtcacaaacaataaatgattttgtatttctgtttcagatctagctcttctgttatcccccaytttattccccttagatactgaccatgggattctatgtgcttacaaatttgttacatctacatttcacaacttaaacatacttttctgttttaaatgaatatgtgtctaagctttttaaacactaaacaactgccgtttttccccaggtcaatttctgccttgtggataattttctgaatctgtaatatttctgaagattcctccaagtatttacagaacatacagaagtattttatgagtaaagtctcattttaatctgaatttaaatccaatcaaaactcacaagaaactacttcggaatcaaaacagtaacaaagtaccctatcccaacattgatttaattaagaaagaatttatttctatagatgttggcactttgcatatgaaggtttgaagctgcccatttcaagcaacaaaaagaaatgttaaaaaccaaggtagtsttcctgggaaatcccgttagtaatggatttctctgctagtaatggggttgttcattagtatggggtatttgtatacactttgaaaagttatagtttccagtttgtaaaaatcatgtgttcccagtttggcttcaacatgcaaactgtgtgctatgcatcaaacaggcaatccctaagtatacactgattttatgcattgattcagtcagtgtgtttttttacttgtgtgtgtgccagggtagctcttgatttgaaacactattaattccaagaacttcggacatgcccaaatcccagattcaaacaaatgttttaactcattcaacattttataacccctacttttatggagattttgaaggaattatatttcactatatttcattgtttggacaaattgtatgcaaattagaaagtaattagttctttatcacttcttttccttaaatgtatgataacatggatttatagtttatcatatactcatattataaattacaatggtgtatgtcttttattctatgttttgggcccacagagcacaggtgacaaaatttgagttctaacatattccaatttgattattccwattgaagctgtgcttctttactaaataattggtaaaaaaattttttttghataaagtttcattttggctccctccttgtcctaaaatcgcatactttcagcaatctgcattaaatatttattaaactactgtcattctcttagctcctgatactgactctggctcgcagcgggcttctagggcaatttaaccacattatgaattcacaacacattttgacattaaagaaaaacttccctgtgtccaaagcgcatacctatgtttatataaaatgtaaccaaatcaatttcactttccttttataaaagaacataataggcacagcatgaagcaatctgtatgatggattttcctgatatgaaaattgtaagcagtgtgattttctgctttagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaaggtaacagtattttcttcctatgactgggtgtggtaggtggggwaaaggctttaaaattcacagccctgcctttgtgcatgttgagtgtattcggtgagtagtctaggatggctaagtgtgaagaaaatctgtggaagtccactctgacrtatctaaaagcaagccttctgtgctgttttccagagccccctactgaacactctggatccagaaattctattacataaaaatattttttaagtaagctaatattaataggttgtttctagaatttatgcaccccaaagagagtctccctccaaataaaaagctttcaataaggraaaaaaccccacttcctagaatagctaaatattatcacctctgaaatagagttctgtgaaggaagtacatgaaagtatataaaagtgccttacctttagtactgtgcgagaagatactgtcataatgaagattaataatcatcacatcagctaattacttataattttttttttttttgagacggagtcttactctgttgcccaggctagagggcagtggtgcgatctcagctcactgcaacctccgcctcccgggttctagcgattctcctgcctcaccctcccgagtagctgggaatacaggcacctgccaccacgcccggctaattttttgtacttttagcagagacggggtttcaccctgttagccaggatggtctcgatttcctgacctcatgatctgcccgcctcggcctcccaaagtgctgggattacaggcgtgagccaccgcgcccggctgtattttgtgtttaaacatgaagtgattgttaagaatgtatttgatttgaagttttcagaatcttgagattttcaatatactgttgaaatacattttttgctgtcacaatgcagtgtcaaaaaagacctacttttttttttttttttttgagatagggtctcactctgtcacccaggctgaagtgcagtggcgctatctcggttcactgcagcctggacatcctggactcaagcaatcctcccacgtcacctcagcctcccgagtacctaggactgcaggcttgcactaccacacccgctaatttttgtggtttttgtggaggcagggtctcgccatgttgcccaggctggtctcaaactcctgggctcaagagatccgcccacctcggcctccaaaagtcctgagatacgggtatgagccaccatgcccgaccaaatcctaccaattgtgtatcttgtatgatgcaaacttggtgcaaaattcacgaataattactatggctttacttgcagatttagtaaataatttacatttggctgatacatgtaaaagtgttaaaaacaaacaaaaaaagatctcttgagctttataggagtcccccagaaactgagatcacaccactgtactccagcctgggtgacagagcgagactccgtctcaaaaataataataattttttataaaaaggaattgttatccccaaattgtctattttcacagacttttttttggcatgaacagtatttgttattcatattttagcgggtaaataaactcagaaaaaaaacaaaacaaaattcagaatgagctttttctccacgccacctctaccttccaaatgtatatgtgccaggttttgcctttggtaaggaaaaaagatcactaagcttatctttcttcttcggcacaagtatgaaacctgaataaagatgtttcggacagcctgctgtatctgtatgaaaccttgtgaaatcttggtttttgcagggttttctgttttttgttttttgacaactcattgctctgtcatctggttgagaaatcattgaaaatactcagttttctaattcaggcaaatcagtcaaattgacaagaccaacagctgcaatctatactaaactaaaacgtataaatatagataaggaaatgttttctttataaacattattattttggatactataggcatagcctataataaacttgttacattcctccaaagaatacaatgtcatacagtaaaaagagctactgtaagacacttcaggtatagtggacattgtgtgagacttgactgttattcgtctgttacacagcagccccacgataactctgtccctggggtttaagacattgcctattaagactgtctccatatgggctgggtgcagtggctgatacctgtaatcgcagcactttgggagactgaggcaagaagatcacttgaggccaggagttcgagaccagtctgggcaacacagtgagaccctgtctctttaaaaaataataatgactgggcgtggtggctcatgccagtaatcccagcactttgagaggccaaggtgggaggatcacttgaggtctggagttcaagaccagcctggccaacatggtgaaaccccgtctctactaaaaaaaatacaaaaattagcttggcatggtggcacactcctgtaattccagcaactcggcaggctgaggcatgagaatcgcttgaacctgggaggcagaggttacagtgagccaagatcacgccactgcactccagcctgggcgatacagcgagactcagtctcaaaaaacaaataaacaaaacaacaacaacaaaataataataaatttttwaaaaatgtcccatatatctcattgtatggatgaacatatattccarttttctgctattgtgggttatctacattctattgctagacctttaaaccagtcttctaaatttctaaatttcrgtcaaatttattacttttcarcttaastcccaaattcagtttcaccaagattttcctctgaccacttctctgttttggttccagatgtgatgaatatgtcacccagttggatgagatgcagagacagttagcagctgcagaggatgagaaraagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcratcttcatagtacggtgcagtggccagattttagttaactgcaaaaataaatgtgctcttgttgtggaggatggaggaggggaavsaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccartataaataatgttgtcactggtgaggcgttaaaaggtaattaaagtraaacttttttgtttcctatatgtatttttcttggatctcctgcaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccaggtaaacattttttccttgggtgcatgtgatgcaaatgattagttgaatagactctycccttccttccggtcactcaggctcacccagctgcagagtatacctttgatgatgtgtaaattcctataagtcaagtaaaaacttccttacacttagcttcccatttcctccttcactcatattccttagaatgacagacttccatttaacagccaaagatggcaaatgagagttggaaggaatgggataggtaaagggaaattagcaacaagcacaacgcacacacacttggatcctatttgcagtttggtagctcatggcgattccatcttggtcagatttggccagttctctcttatcgtttttaatgtaatttccgtaaagggagagccatatgtataacaaggcttttgggctgatttccttttgtggtgactcagaacgtctcctcaatcattatattgagaataaaagtaaaaccttctaagattttgctcctcaagaacatttaggtcttagtataatgttcttgtagattgcaggccccccactggttaatgcttaccaacatgttcacacttagcttcactattttgcatttttctttcttccttccttcctttcattctttttacttgttctatgaagaggcctaacttgaaaatgtgacatatggcaaatagagaaaattattcttgcaaataaaaatcatccttttaaggaatccctgcatgtgagtatagggcagaagtggcaaacaaggagcccataaaccaaagtaagcttaaaggcagctgttatttgactattgccagaaaataaaaaataaaactatttaagttagttattgacagttaaaaattcaagagattttatatgaacatcagtatttctggcctcttttggaagattctgaatatctggcagccctaggtctgcgttcacgcatgtcaacacctgttggagctctgtagtggctgctgctgttagggcaagcttcgcactttgccacagtcaccactcctccttattacttatacccagcctgctatcctcatttctattctctcctggcccctcctgtagtctttgagtttgccaccgttgaaatagaattttttttttcattttaccttaattcctttttgcaaacctcagcctttggatctctaatactttccttatctgattcatgaagtcagcctactgattgggattaaaagatgtggtgtagaaactgatagtgcatttcacgttctaaaggtgtttgaggaaattggtagtgataatgagttggaatggtgtaatagccaaaatatacacctaagaagaaaaaaagtaaaaactgcttggtgtttttaatttcataactgatttcctattgttttagacctccttggaaggtaccttgaagtattctgtgaatcaccaaagtggtaatgatttatcaggatacctaactcggataaaacccacaagtcttctttttagtgttccaaatggatttagtagcactatctactggaacttagaaaagaaattggtatgattaataaataactcctattgctgtttaattaaaaagataacatctcaataaggttaaaaattaataatcaatgttaacaacaataactgttttcatttttgtatgactggtttttgtttacatgratatataytttatattgttatcattacattgtttaagccatgaacattatatcacaagcttttccatgttgctatctagtcttgtttttatttgttaaagttattgtatcatagattttgtttcagatgctgttatcacattaatcactacttctcttcttgtccactgaggtagtttttcattatttgttatattatagagcactgctgggaataccctcatgcattcagcttctcatctattacatttttctcaagagtgagatcactcagttaaaagttgaacatccttatgttttttgctccattctgatgttgctgtcaagaagggtatatcaatgtactaaaagcccataaaacactttccctttttcccacattgggaatctttctgctactttatccacactgtgcacatcttacaactctaaagtcagttagcatacatgaatgagagtaccatatattgtcttaaactctttagttttgaataaccagaaaataccattgaccttagaaatgattactatttatgagattcgaggccggctgcagtggttcacacctgtaatcccagcactttgggaggccaaggcaggtgaatcacttgggctcaggagttttagaccagccttggcaacatggtgaaaacccgtctctacaaaaattagccaggtgtggtagtgggcacctgtagtcccagctactcaggaggctaaagtgggatcccttgagacagggaggcggaagtttcagcgaaccgagatcgcaccactacactccagcctgggtgacagagtgagacactgtctcaaaaaaaaaaaaaaaattagagatataaggaatgtggaattcagaataatcaccagaccagaaggtcatgctaatgacagcttaacatattgataacctttataattctcaccatttatgtaaagttaaaataataaaagaggaaaggaagtaaagctgttattatagccttaggaatttttaattatgtatcgtggaatcaaccagattaacgcttagtaaattattatcaaatcaatcttagcaacattttctaaaaggtcctagttaaatgaattactacagaaagtgackgaccatccacaccaaataaattgtagcttctacaaatatctgcattattaccaatatatgttaytttccctcagctgaactatatagggtaagacatatcaaacattttttatgatgcttttactatataaaatcttttcaataagccaagaaagagaaaakatgacatataataccagtcttatgttctatataagaaatatcataagcccatgggaaatagtagattttatgagtatttttaaattcaggagtttaaccattataaaatttgctagctagtaacaatatctattaatcattttaaaaggaaaattctctattaatgtatcagaatgtttttgataagcattgttttacatatatatgtatatatatatgtgtgtatatatatgtgtgtatatatatgkrtatatatatgtgtgtrtatatatatrtgtgtgtgtgtrtatatatatatatatatatatatatatgtatagttttgggggtttgtttttttttctyttttttttgagacggagttttcctctgtcacccaggctggagtggagcggcgcaaccttggctcactgcaagctctgcctcccaggttcatgtcattctcctgcctcagcctcccgagtagctgggactacaggcgcccgtcaccacacctggctaattttttgtatttttagtagagatggggtttcacagtattagccaggatggtctcaatctcctgatcatgatccgccatctcggcctcccaaagtgctgggattacaggcgtgagccactgtgcccagcctaaaatatatttttagtacatctttttagatgatttttaattattctaataagcagatatgggctttatttttctattgaggaccattgaaacaattacctcaactaaaaatgaaatcagtttaatttgtttttaatccttcagttgaagaattgagagaggtatgtgtcgtttaaaaatttaagacacagaacataaaatgttatttattctgtacaagagttactttcaaatagattttatttctatgagatggtaaacagaaagcctcatctccttaaatgcacaatttctccattctggagaatcaactatagggtgrggcactgattttcaacattagtagaatattgtatagtaattgattaatgcattatactgatcggtttgctgcattagtacaaccttttaagggaaaattctggcgtttccctctggctggctcagcttctgcaacctcagcccttacaattgcagtgcttctggccatggcttgcttgttaactttcttgttcttgactttatccttatcctggcacacaaattccagtgtccttccacatgctcatcttagttttcacagtttcagttaccagctgatctgagaagtgcctatcagccttgatgaccttgactcaaaagggaccctgttgtcatcaaggagtttgtaattrgrcagcagattgtatgtcttcacaaaattgttgcctattttttagccagcattttatcttgactccttaactacctaggcctatatccttctcctcctcctccgtcccctcttcctcytcctcctccgtcccctcttcctcctcctcctcatcatcttaccatttaatcaataattgcaatcagcctgtcagaatacgtaaagggaatccatgtaattcacaggcgggagttgttatttctgtagtaaagacctgactgcagcatttacacatgataaataggaaatggcaaacctggggaagcaagtttgaactcaatctggaagtaatagcctaagcagcttgctcttcacactgtgtttcccatgtcacccttttcctcttaggtatcttgcttctccctctcatttcaatctcctccttccttctgttcctccatccttccatccctccctcctgtctttctctgacacaatgactcagctagtttaagagaatggtattattttgaagtctgaaaatgtttctgtgatattttgctttttactgatctttaaagcaactcacagaagtgtattagccttagatacgtaatcaccccttgagatatatagtcaacagtacacacygacatgttcatagtaaaaactgcctttatgtttcactgcattcaagcaagtagatatttgtttgtttcacgtattgcaaagcctatgttcttaagcatgtaccaaaatcacatttatttcattaatccatttactcattcaccagaatgtaacaaaatttagtgaatatctgctatgtgtcaggcacttttcttggctcttgatatacaatgatattcaaataaaactcatagtctggtaggggaggtaggagacaaatatgtactgatgttaatagatattcctgaaataaataaaggaattaggatggttaggaacgtccttccagaagaaatgcaaggctggccatgaaaggtgactatatcgtaataggcagaaggtggcagcgcaggtatgggtcgtaagaagaaccttataggaaaggaggtcaacttgccccagtgccatgagctcagcactacaacctggtgcaggacttcgaagtaatagaaagcgaggctgcaaaggtggacagggacctgaagacagagggccaggttagtgagagcagacttaccacgggcatagcttagcagttttaagaataggatcagattttcatttgataaaatcaccctgatgacaaggtggagagtggattagatgtgggtaacatcgaagataaagaagcaggtacagagactcataaaatatgcagatgagaggtagtggagaccagaatcaaaactgtgaggaataggaatgtttaaatatgtcccaagttacaattcagttacatatttcatcagccagcatgtcctgtgcacacacgacctgctcttactgctttccatgttctgtatgtggaaggagatcagtcaatcttgaactcatggcctcagtattttgtactttataatttatattttttcctatagaggcttttctatttatgtgtattccacttccccatatcactaaactgtctttttccacaggattcaattcttgaactagtaggagtgaagggcagtctgttgaaacctgtaatctcttaggcttgtattttctttgaacatagtttccacagaattcttccctgtaggggaaggcctgggcacttcttgatgtcagaacatgttgtctttagtttggaatctgccaaaacaaaagttaaatcaaaaatgttaattcctgtcaccccagcacttcgggaggccaaagcaggaggattgcttgagcccaggagtccgagactggcctgggtaacatagcgagacctcgtctctacattaaaatttaaaaattagctggatgtgctggcatgcactcatagtcccagctgctcaggaggctaaggcgggaggattgcttgagtctgggaggtcgaggctgcagtgagccactgcactccagcgagtgatggagtgagaccctgtctcagaaaaaaaaaaaaaaagaagaaaaaatatattaattcacaaaattgtcaaccacatgttgagaaatacatttttatacttgctgtatatttttcaataggtaatggttcaaaaattttaaagtacaaagggtatacagtagatggtagatttctgccacaactgtgcccacccaaccttttgtatttttccagaaacattctatacatatataaggaaatgcatataaatatatacatatataaaaacatatgcattttacatatgtgttaataccattggcacaaccacagacattatgcatgccggtttttttcacttgatgtatctgggttcttctttcctatacatttatctttttgtttcttttgagtcagaagaagttatgaaggggaaggaagacatgcttgagctctttaagaaagcttggaatgtttctatgtgtgcaatagaaatatttcttgccaaatgataaaatgacagctacaagaatgtttctattcagaactattcaatagaaatatgatataaaccatatatgtaaatttaaattctctagtagtctagtagtcatgttagaaaaagtaaaaagaagtcaggcaccatggctcacgcctataatcccagcactttgggaggccaaaatgaaggatcacttgagcccaggagttcaagaccagcctgggcaacatggcgaaaccatgtctctacaaaaaataaaaagattattcgggcatagtggcatgcgcctgtactctcagctactcaggaggctgagatgggaggattgcttgagcccaggagattgaggctgcagtgagccatgatcgtgcaactgcactccaggctgggtgacagagcaagaccctgtttcaaaaaataaataaaaagaaacaagtgaacttaattttagtagtagattttaattgacacactatatccataatgtgatcatttcaacatggaattcataggtggctaacacctataattccactttgggaggccgaggtgggtggatcccttgaggccaagagttcgagaccagcctgggcatcatggtgaaaccctgtctctacaaaaactacaaaaattagccaggcatggtggtgcatgcctgtagttccacctactcaggaggccaaggtgtggggatcgcttgagcccaggaagcagaggttgcagtgagccaggattgtgctagttctttccagcctgggtgacagagtgagaccctgtcaaaaaaaatatatatatacgtgtatatatatatatatatatatatatatatatatatatatatacacacacacacacgcacacacacacatacacatacatacacattctgtttttcttattcagtctttgaaattcagtattatgcacttacagcatatcttgatttgaactagccacatttcaaatgctcaacagcctaatttcgctaagggctactgtgttggacggtgcagttctagaacttcttagttttaactagatagaatttccacacagaaatctaaatttgaataactaatgactgattttaaaataaaatttaagatggcatgtatttcggttttatttcttttcttttctttttttttttttttaagacagaatcttgctcttgttgcccaggctggagtgcaatggcacaatattgcctcaccgcaacctccgcctcccaggttcaagcgattctcctgcctcagcctcccaactagctaggattacaggtatgtgccaccatgcctggctaattttgtatttttagtagagacagggtttctccatgttggtcaggctggtcttgaattcctgacctcagttgatcctcctgcctcagccttccaaagtgctgggattacaggcatgagccactgcgccctgccctcatttttcttttaaactgacatagaccaaagtgctattttgctgattctgctttgtctctgattggtggcagtgctttttaaaatagatacatattaaatgtttgagccaggcgtggtggctcatgcctgtaatcccagcactttgggaggctgaggcgggcagatcacaaggtcaagagatcgagaccatcctggccaacatggtgaaaccccgtctctactaaaaatacaaaaattagctgggcatggtggtgcgtgcctgtaatcccagctacttgggaggctgaggcaggagaatcgcttgaacccaggaggtggaggttgcagtgagctgagatcacgccattgcactccagcctgggcaacaagaacgaaacgccatctcaattaaaaaaaaaaaaaaagtttgtacctatatacccttttcatacatctcttatttgttactagatctccttgtcaatataaaaacttaattacttaggtatatcctaacaaaacatattccttaaacattcttaaaacagtataatgacttagttttttaattaccgtaatgaagttgtaaaagcccatgtttcttattttaagcagagagtgccttaaaaaggtttaaaatgcatcctgccagttttaaatagcagaatttattgataccatatatatagactgaaaacacatcaaagtctttcaaggttgattatttcttgtgccttccttcttcccacagtaagagagaagataaagataatactgagtaaaccattccatgctacaaattggacccattcgacaaaaatgcaatacttagtagaacatctgatgaccatggtcctattcgtgtttttattttgttttatttttgtttttgtttactgttctctcctctgtccagtattcctgtccagaaattacatttccttaaaagatttcatattcaaaacctgagcattgtatgcaaaataagctatgatgaaaggatgaaactttttaattactgaagagatcaacatgaaaaactctgtagcaagaatgtgtattttatattagatcatacttttcaatccatattgactattttagtaccattatgtaattttaaagtcttttagattttgttaaaattttattaaatccatggaaattgaaagttccttattttaatccttaggagaaaaactataatttttctctaatatatccataaagtgaaagaagaagtacttatttgatattcttaattgttacatatttaagagcaagagtaattagttcatacttatgttcacctaagtccacccatacattgctgaggatagcggccttcagaaggtggctgtttccggaggagtaacagggaggaacaggtgggctgagatatacatgaggcccaggacattccaggcaataactgtctgcctctcctgactctgcccaaacccgaaatgatgctttctagctcacacaaaaatrtatatatatatatcagcaggcagatactcaagctgaaagagacattactggggttcgtttctagatcacagatcctgcctcaggctcactgaagtgaccagcctccacccagtaacaacaaactagtctaaatccagaataaaacaattatacattttaatcttaccaccttctacctgtgtgtgctgtccaccctcaagacagagaatagcccgtattccaccaaccagcaatcactagcctacaacaccaaatccacagtttctttggtatcctttgtgccagggagttgggtgctgaacaatctacctgtaacattcccttgccttcatatcccaaagctctgcaagcaaagaagwgttctggtgggcagctagggccatttgttgtagtccagagraagagagccatccgtatcttctgtgctgtactcatacctatttaatccaatctgctggcaccagtctattatattcaactgtttgcccccactgtaactacataacaaccacctctattacaacagtgattataaggcattatctgagagggtatatccaaactgtaccttgcaaagggacttctatctgcaaagaatactaagaaaacatattatgagaaagtcacaataggtacccagagaagccaatctctaggttaaccaactacttccctgtccatttctccttataaatgtgaaaggagagcctacaatgaagaaatcctggaagggcatctcccagctctgagactctctgatgctatgaattcaagttattctgtccatgactgggtctggaggtcactgtgtaaaatctacgcttctaaataaatgttatgatatctcagcatactataccatacttataacatgtatgcttataacagcatactatwccatatagtatagttcccaagaaaagggaatgtttcttcccccctaaaaaaaggaaaattcccattatctaatatataaaacaaacttttttgatgatttaaagtgactgtgtgttgtgaactgagtagacaaggcaggaaggagtagtgatgttcctgagttcttgctgaattctgacaacgtgccaacactttgatttctctgtcaaaatgggtgggatttgatatctaaaaaagtataccattacatatctaaaagtatattgttacatggaatatggaagccactgatttaattctggaatgtccgtcaacatgacagccacctaaactcctctgaggcattgtaaacggttaggaaaattgacctttctacacactaaatctggcttcagtggctctcctgagctctaagggagttgggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgcactttgggaggccgaggtgggtggatcacttgagcccaggagttcaagaccagcctgggcaacatggtgaaaccctgtctctacaaaaaawacaaaaattagccaggcatgatggtgtgtgcctgtagtttcaggggaggctgaggtgggagaattgcttgagcccaggaggtgggggctgcagtgagctgtgattgcaccactgcactctagcctgggtgacagtgcctacataaataaataaaaagaaagaaagaaatgatgtagtgaaaatatagttacatagcacttatacctagactacttaaagtgacctagtaattaaacttatatagctcatcaaccagcaaagattcctagtgcaccacactcgttatagagcagggaagcatcgctgccaccctcagggattcctcttgcatatctctgtgttctgtcctccacacacccatctctttagtcatctattgattttattcaattttcctggcagtttccccagtgtattttacctgaaaggtatgagaggaaaaaggaaaagcacaactcaaaatggttgactattccattctttgttttcttcaaaaagtgtaaagtcataaagatgccatagaaccactaaattcattgtcctttgtcacctctcagccaataatagtcattgatatactctccataccacaaatttaaagttttttgtgaactgtacatgcaatagccaagtttattttaactttagtcattactggatcccagagattttctttctcttttttggcatatagattatttatgtcacttcagtatgcccagtccacagatgagatcttctgagggactgcttctggagccggccctcttgtgtgattgaattagtcagtgatggttctcaggactagattagattgttactcttaaaataattacttaaaaaaaaaaaaaaaacttccataacttgaaaattttgtggccaggtgtggtggctcacgcctgtaatcccagcactttgggaagccgaggtgggcggatcgcttgaggtcaggagttcaagagcagcctggccaacatggtgaaaccctgtctctactaaaaatacaaaaattagccgggcatggtggcgcacgcctgtaatttcagctactcaggaggctgaggcaggagaattcgcttgaacctgggaggtggaggctgcagtgagccaagatggtacccactgcacttcagcctgggcaacagagcaagactctgtctcaaaaaaaaaaaaaaaaawaaaaaagaaaggagaaaaagaaaagaaaaatttgcatttaagacttatatgaaaatacataatttattttgyagaatgatctagagcaggactgtcattttaactaaagttatttttggccaggtgtggtggcttatgtctgtaatcccagcactttgggaggccgaggcaggtggatcacgaggtcaggagttcaagaccagcctggtcaatatggtaaaaccccatctctactaaaaatacaaaaattagctgggcatggtggtgcattcctgtaatcccagctactcaggaggctgaggcaggataattgcttgaaccaggacgcgggaggcagaggttgcagtgagccaagatggcgccactgcactccagcctggactacagagcgagactctgtctcgaaaaaaaaaaaagttggccaggcacagtggctcacacctgtaatcccagcactttgggaggccaaggcgggtggatcacaaggtcaggagtttgagaccagcctggccaagatggtgaaaccccatctctactaaaaatacaaaaattagctgggcacagtggcgggcgcctgtaatcccagctactcaggaggctgaggcaggacaatcacttgaacctgggaggtggaggttgcagtgagccgagatcgtgcctctgcactctagcctgggtgacagagcaagactctgtctcaaaaaaaaaaaagttattcttagtggatataaaaattggtgtttttggccgggcgtggtggctcatgtctgtaatcccagcactttgggaggccgaggcgggtggatcacgaggtcaagagatggagaccattctggccaacatggtgacacgcacctgtaatcccaggtactcgggaggctgaggcaggagaatcacttgaatctaggaagcggaggctgcagtgagatgagattgcgccactgcactctggcctggcgacagagtaagatgccgtctcaaaaaaaaaaaaaaattggtgttttcttggtttgttttgtgttttagtttaaggagacacatttcctcatcttaaggacttttttgctgctctgatgctggtcatctagtccattcttttgctctaaactgagccttgcctcccagttcttcattgcacttcagattgtgtcttactacaaagagaaaattagtctgtgatcagtttggatcagaagaactgaaawtgtacatttagaatagaagccagggatgtgatgcacacccgtgatcccagctactcaggaggctgagatgggaggatcacttgagcctgggagttagaggctgcagtgagccgagatcgtgccactgcattccggcctgggtgacagaacaagaccctgtctctaaaaaataaaaagaagaaaagaaagaaatttaaagtaggaagggctaccgtttgcttctggccaagcttcacctctaaccataggatcttttaaaagactagttctgaggtcctttactctgagtaggtatttatggaataagccattatgtattgacattagaatcagttaaacataaatttttttctctttttatgcactacttgacatcaaaagcaaaaagaggtaagttggctataaacctgtaggtgaacctaatttttcttagtagatttgttcctgagtagctttgcttcaattaaatttctgtgaatcaaatacttttacattaggaagattgtcattggaaattcttattcttttctttgaaaatgaataagcatcttctgtaaacttagattttcaagatatctagtatttaaacattttgcttttcctttaatcaagttatacttacggtttaatttgcttgtgaagacaaggcattttcaaacacttggtttagttttgagataactgaattgtttctcccaccagaaatgtggattacatgttataagtctttcctattttcttaaaaatgaaaaaaaaagccaagaaacaactgacattggtgaaagtctgtaattttcagatccattgatttacagaagaagatgccctgaacctctcagaatattttmtagtgtgattttttttaatgattaaaaaaaatgaagaaaatattaaacaagaagatcaaacacatttcattgagtggtgtctcatatgtttttcttgtttgggatctatttttataattgatctttttagtggattcttgattgtagtttaacttatttctcttttgtttctttttgatgatgcatcaattctgacatttcaaaggtacagctggtcttcattagatatgtgctgttattgactttgcttaacaagaacagaccatcatcgtaccaccttgagttaactctgtgccagctggccttgctcttgagaaggtcatttctaaacagaaggttattttttgaaagatttttaactggtrtaagaatctggcagcagaatgtacttttacctcttggtgccactgtatttaattaccctctccccatttatcctccatgtctttcctaccataagctattgataacacacatgctcatggtttaattgtaagttgttcagaaatagaaagctgactgtactgcagggcgtttttatatttctcttttgcaagatttgaaataaaaatagatttttgcatgaatattactttgttttatcagctagtcatctgatattcatcaggacagcaaatgggaagatgggtgaaaggttttgtcaaatctataaccactgaaaaatctaaaaatgctccctctctacttagcaaggcatgctctcattctacatcgctgaagacgactttcatgcttgtcactgaagtgtgatgaactatatgcagttgtcatttatgtgaaggaggaaccagatgctttttaagatttgtcaccaggtcttatttttgcattgtctatattgaaattttttgatgtgtttcaacaattccttctttttgttctctggaaatttttaacgaagaatgattgtttctatcaagagtatacgctataatggactttgctgtgttaaagactgatgtaaatatgtctgaagtgtttggtgatataaattagcagatttcacccgataagtcagaaattacactatcatctgtgggtacttttagaataactgatgttttaacaggggatgtaatacgtttggtgaaaagggatgagatagccaactctatgtgtttgattataaaatgctgacagtgcttcacagctctccatttttattcatatcagtgtaccattaaattcatcattagatttttgaaaatagttattttcctagctactgttaatatttatgtaaatgtttctatctcatgctcttcttttatatataatatttctttctcagtttttccttattatttctaaattctctactctatatgtgtgtttttcagtttatttgtttaggaattcataggactgtttaaatgttcaagttgttactacaaggagaatgtattttgatgcttctttccattaacctttctgttaattcactaacattattaatcattttgtagatttagtgaggaataatttactggttatgttatttggcacatcttaaatgatggcaatttaaaaattattttcaagacttatatattaaagtcctacagttaccaaagaagaataattgatcatctgataacactaaattaaccttaaaatctttatcagataatatttatccattcttattccttttgttagaaagatgttgttacaatgacagggatgtctaaattgtaaactctcctttcaagtgaattaattaaacagtgacattgatgatactaataaataaatccaaggattttttttaagggaggtggtttgcaccacataaattccctagcaaagtgttgtggggaattraagaattataaggcagggtcctgcctgctctcaaggagctgcatagtgtggctagagagaatagatatactgcaagggaagcaggggtctagaattctgtaagaaatgccaaaggaagctgggcgcagtggctcacacctgtaatctcagcactttgggaggctgaggcaggcggattgcttgaggtcaggagtatgagactagcctgggcaacacggtgaaactctgtctctactaaaaatacaaaaattagctgggcgtggtagcatgcacgtgtaatcccagctactcgggaggctgaggcataagaatcacttgaacctgggaggtgaagattgcagtgagccgagatggagatcacgccactgcactccagcctgggtgacggagcaagactctgtctcaaaaaaaaaaaagaaatgccgaargagatgagagaagtgctaaaggagtttgcaggaagcagacacctccttttgggatggccagaaataatgactgaaatttgactttgcatagtctgatagacaagagcatttccgatgaatataatgatagcttgttgaaatgaatttctcctatgatccattttgacctttcttatttccttgttgttaatagcatttactttgtttctcgaagctgaaaaccttaagggccttcgactcctccctttcctttgtccatcatgtctaattgatggactcagagctgcatgctttcacaaacattctctcacctgatcttcacgtgaaccctgcaagattggtatttaatgttctcacttaaacggatagaaaaactgaggctaagaacagttaagtcacttcttcagtgtccctagctactggttgttggaactggtatctaaaagagagacagagatctttctgatggactctaaatttcatgctgaaatggagaagagctgaagagcacagaggagagagaatagagaataaagagggccaggcgcggtggctcatgcctgtaatcccagcgctttgggaggctgaggcgagcggatcgtttgagtgcaggagttcaagagcagccttggcaacatggcaaaaccctgtctctacaaaagttttaaaaaattagctgggcgtagtggcactggggaggctgaggtgggaggatcgcctgaacccgggaagcagaggttgcaatgagccgagagcacactactgcactccagcctgggtgacagagtgagactccatctcaaaaaaaaaagaaagaagaaagctgagatgccataggaaatggctgcagaagcatcattggcaaatgcaaggaaattattgtgatgtaccctcacttaagactccagtgcatctaagtgtgttagtaactgattatggagagcacctttgtgctattatcagaattcctgggtgtgggaaacttytataactgtgcaacttttctatctccacgtcagtgcacagtatatggacatttatattttctactaacacaactgacattccactcccgtcagtttagtttcccccagtaccactgttttgaccactttcacacttctgtctatagtgcttttgctaagaaggaatctgctaaattcgaatgcagattctcctgcttttttttttttttttttgatggagtttcgctcttgttgcccaagctggagtgtgatggcgcgatctcggctcattgcaacctccaccccccgggttcaagcaattcttctgcctcagcctcctgagtagctgggattacaggcgcacgccaccacgcccggataattttttgtatttttagtagaaatggggtttcaccatgttggccaggctggtctcgaactcctgacctcaggtggtccacccaccttggcctcctaaagtgctgggattacaggcatgagcaaccacacccagccccagattatccttcttaatttgtgcttcttgcctttcgtatatatctttttcattttgagtttccttgaattaaaactttttaattcaactcttggattgcttarttttgaataatttgagagaatttgggctgttcttggtttatttagactgaagaagtactctcggcagagtaagaaggagcactaactgcttctactttggagcaagtatcaaaggctgtgttagtctgctggggcttccatcaygaatgaccacagactggatgccttaaacaacagaagttaattttctcacagttctggaggcccgaagttcaaaatcaaggtgtccgcaggtctgttttctcctgaggtctccgtccttggattgcagaaggccaccttctcactgtcctcgcatctctgtgcactgcatccctggtgtctctctgcatgtattaatcctctcttctttacaaggacaccaatcagattggattagggccaactctaacagtgtcactttaatttagtcacctcttgtaaaggtcctgtcttcaaatacagttgcattctaaggttctgagagttagggcttcaatatatgaatttaggggaacacaattcagtctataacatcatgggccattccactgaaagggcgtgggtggacagtcagaaacctgggcacaagttctcactctgccactctctccatgggccctaagaaaatcacttaacccttctgatcctcagtgttctaatctgtaaaatgggcattatgactaccaatctcagttgagtttggtttgtttgtttgtttttgagacagagtctcgctctgttgctcaggctggagtgcagtggtgtgatctcagctcactgcaacctccacctcccgggttcaagagttctcatggctcagcttcccaagtagctgggactacaggcacgccctaccatgcccagctaatttttgttaatttagtagagatgagttttcaccatgttggccaggctggtcttgaactcctgaactgaagctatctgccagcctcagtttcccaaagtgctgggattacaggcatgagccactgcgcctggactcacttgagttttctaggcactaaaaagcttttgttcattataaaagccatacagaggccaggcacagtggctcacgcctgtaatcccagcactttgggaggctgaggcaggcggatcacgaggtcaagagatggagaccatcctggccaacatggcgaaaccccgtctctactaaaaatacaaaagttaactgggcgtggtggtgcatgcctgtagtcccagctacttaggaggctgaggcaggagaatcacttgaacccgggaggcggaggttgcagtgagccgagattgcaccactgcactccagcctggcgacagagtgagactccacctcagaaaaaaaagtaatacagaaagtgaccttgcataaacttagtttctcatttctaaacaaaaataaaatgtatctcatagagtttttacaaggattcaagagcttttgcatgcaaattgtctgcaaatatatatatatagcactttttataagcattacatattaccattatttctcatccttctttcttctacatttcttctgcccgctcttccttttctgtcattgcctaaaatccctattaatgaatagtttgaaagaacatggccaggtttgcagaaagaagaaagagagatatccttttccctcccataaggactaaaagaggatgtctctgtgctttgatcattaaccatggcgtgttgattttaggacaatctataactctctgtcaatttcctacttaacagctttcaaaattaaatgttcttgcttttctactaactgttaatcatctgttcttattgaaaggtctttaatgaatattgactgtttactccaagtttataagatttttggtctaaagtggttgtcttagtccattttctgttccttataacagaatacttgaaactgggtgatttataaagaaaaggaatttgtcatttgcagttatggaggctgagaagtccaaggtcacggtgagagccttcttgctggtggggactctgcagagtcccaaagtggtgcagggcatcacatggcaagggggctgtacatgctaagtcaggtctgtcttcctcttatagagccaccaatttcactcccatcataacccatgaatccattaacccatgaatccattaatccatgaatggatttatccattcatgagagcagacctttatgatscaatcacctcttaaaaagttccacctttcaatactgccacattggagattaagtatcaacatgaattttggaggggatattcaaaccatagcagtggtatctatttaaatctatttactttcaaatagataatagcagcatgttctatgatagcaattgttcaaagaaatttattaaaccttttttatagacagtcttgggaagaatacagcaagttagcaaagataataactaagagtctcatcaagaggcgtgtgtgttccttatatcatcaacttccatttctcctgcctatttttaaggatatgagtatgtgggctgggcgcaatggctcacacctgtaatcccagcactttgggaggccgaggcaggcagatcacgaggtcaggggatcgagaccatcctggctaacacggtgaaaccccgtctctactaaaaatacaaaaaattagccaggcgtggtggtgggtgcctgtagtcccagctactcgggaggctgaggcaggagaatggtgtgaacccaggagggggagcttgccgagatcacaccactgcactccagcctgtgcgacagagtgagactccatctcaaaaaaaaaaaagaatatatgagttgcccattttcaaaacaggaaaggaaaagaagaaagcacacgtccctttttttctcacttgttgaaggaaagagactgaaaaatcatgaacttatgaaagatagaggaagaggtgcctaaggagaaagagaatatttaagtaagaggattaatacctatatatgtcagaagaagaaatgtagaaatatagtttttacacggtggaaaagaaaagtttctctaaactgtagaccaacaaactttgcctcatcctcggcaaatttctggaaatggatgaattacaaatgctctctatagaatggggattgttaaaagccagtgtgagttcatcaagaatgacttgaactggactacccacattctctatctcataagaccagggaaatggtaaaataatgtgtctgaacttgggcaagcaattaaccaggcatttttttttaatattcttgagacaaatagagaaatcaattctagaggataatataattgtgtagactcataactaattgaatgatatgtgcaaagggtccaaattcattgacttatatttatgaaatatggtcttcacttagcctgaccttattattaattgctaatcttacataaagctatcgaggtcatgattctcatattttctgatttaagagagaaataaatgctaaatgayggaataggatccaaaatattcatcagataggaagaggcgaaatatttcacatgtattttaaacataaagtttaaatggatatgaawtattgtgctggaattccaagcactgtaagatggaggaaaaatgactttatagcactacctgtaaacaaagctcaatggaaatagcagtgtgatgtggctgcccaaaaatgccatgaggtttctgctgttttaataggactgggatgtctcagataagacaagacagtgccactgtactcttcactgggcatatcttaccacacatgatttcctttcttatcacctcrtttttagaaggatgtgcacaaaccggaacaaggtcagagagcaaggagacgagtgagggaaattgacatcaygtcttaaaaggaagaaatggggttgggcctgatggctcacacctataattccagcactttcagaggccggggcgggtagatcatttgaggccaggagttcgagaccagcctggccatggtgaaaccccatctccacyaaacatacaaaaattagccaggcatggcagcacatgcctgtaatcccagctactctggaggctgtaacacaagagtcacttaaacctgggaagtggagtttgcaatgagccaagatcacgtcacttcactccagcctgggcaacagagcgagactccatctcaaaaaaaaaaaaaaaagaaagaaagataagaaaaaaaggaagaacttggatacttggcctgaggagaactcagaggacagagatagttttcatgggaacacgtggagcatccggaggttgtttatggtcatgagggaaagagatgtggtgtggaaaatacgatcttgtgaaaaagtagggatgcattagttctcaagtcaggaaaatgaggaggtggagtcaagcgatgctacaggagactgtttgccacaaagagttgctgctgtgcctgccccagagcacttgggcccaaagaagccacctctgcagcctcactactcatcgtggctgggtttggtctccacagatgggctttcactcacatggtgctcaccagtgcccactgctgccatctgggccaggtgtggagccaaaacatagaagtgttccttgtctcctacatgagctgttccttcccatcccaaacagccaccagtgggctcctggactccctaaggcattgacttttagaaaattgggtagtttggctgggcgcagtggctcacgcctataatcccagcactttgggaggccgaggcaggcagatcacctgaggtcaggagtttgagaccagcctggccaacatggcgataccccatctctactaaaattataaaaattggccgggcrtggtggtgcatgcctgtaatcccagctacttgggaggctgaggcaggagaattgcttgaacccgcgaggcggaggttgcagtgagctgagatcatgccattgcactccagcctgggcaacaagagcgaaactctgtctcaaagaaaaaaaaagaaaattggttagttttctaaattgcattgaaaattttataaataatagaagcccgagagaaagccacacagcaaaactttctctctctgccaatgaaatgtattattttcagccacctctttttaaaaacaatattatcttcattcctgtacccttcattttgctttgtatttttgagagcgctggttgccttaaaatcagtatctcaaatctctggcaaagttccttctgtttctttgactctatgaccctgatattttctagaggtagctggtgtcaatttgagaagcatccagaggagtgaatagaaaagaggccttagcattaaaaagactaaatttaaatccttgttccgccacttcctaactgtgtgaccttgggcaagttaatacacatgctgagcttggattaatcartggaggcttgtaggacacctactgtgatggcaaattctgtgtttgtttctagcaggagagattttaaaaagaagttaaagaaaaaaatatgtgagactatgatattctcccatattatcaaaaacacttattttcctcaatgtaggaatagtgcaagcctgtcgacccagctattttagaggctgaagtgggagcatcacatgagcccaggagttcaagaccaggctttaagagaccctgtctcttaaaacagataacaaatgtaaagtttataggaaagattacatcatgttgattcagcaaatattttcctctcttatttctccctttcttttctatcttcccttctacgtgaggcccttgtttatggaggaatgtcatacaagggtactcttcttgtgcatatcgagacagacctatagatgctttgagctataatattccatattcatccctgccctggaggcattagtaatctcttgagccaggcacagtgtacacacttgtagtcccatctactcaggagattgaggcaggaggattacttgaactcactgcattacagcctgagcgacatagcaagacctggcctctaaaaaaaatacataaataatctcttgagtatgctatgacatttcccaagcctgtggccttatcatataaacgtacagcattttctaattccattctgatcatttcaaataaacactttaattttatgataaaatgtcttattactgttactaaagaccataaaaagtttgtagttacaaagaagttatttgactaactcattatgttagatgtcagcctagatatcacaacctccaggaagcactccctaaccacttagatttagttgtgtttggttagttagatttagttatgtttgattagttagattcagtctaatttaatttaattaacttccgctgtgaggtcctgtaacaccctacactttccctatcataggaggcaatacagtgatacttctgcaagttcagctcagcccttggaccatacaatcctggattcaaattgcacctctacctcctagtggagtttgtcaagttacttaacctaagttcccctttccttatagatgaagtgagattaataaaacagggttatagaagagcatgtatattaagtgcctatacagtgcctgagacatcgtaaacaataaataagtactagatgctgtcatcatcaccatcaccatcaccaccatcatcaccatcaccatcacacttcaatgtagttgcttaytaaatatgcttatcttccttgataaaacagagaccacattttctctgttcacctttttccccctgctgcctaacacagtttctgacacaaaataggagtttagtaacttgactgttgaatggtttagacaaaccctggtggccaaacaacagcaatggctttgtgggttctacaatgcctgctccttcatgcacatagttgtcatcttttattccccccaaagcaacgagatgtggtctagttccttcaagggtgagcctagcagaatagatcctagacggagcaggggagatcactcagagcctgcagcatctcagagctacaagggacttcctcagcctcccaacctacctccttcattttacaaagtacatcctaagacacatccgtggctcagccaggctacaattgacacaactggagggctgtagacccgagaagagggatttagaagacaactgagtcagagcaatgtagctacattttagtttaattttttaagtccatcaccattttatctatgaaatttgttttttattctttaaggataacacgtagctaagtgcttataaataataaatgaaaaataatcatcattagcttggctaggagcagtggctcacacctacaatccccacatcttgggaggccgaggcaggaagactgcttgaggcccggagttcaagaccagcctaggcaaaatagctagaacctgtctctacaaaaatttaaaaaattagcagggtgtggtggtgtgtgcctgtggtcccagctactcaagaggctgargcaggaggatcacttgagcccaggcgttggatgctgaagtgagctatgatagscacctaggcaacagcatgacatcctgtctcaaaaactaaataaataggccgagtgcagtggctcacacctgtaatcccagcactctgagaggccaaggtgggtggatcacccraagtcaggagttagagaccagcctggttaacayggtgaaaccccgtctctactaaaaatacaaacaattagctgggcgtggtggcgcacgcttgtaatcccaactactcgggaggctgaggcaggagaattgcatgaacccaggaggcggagattgcagtgagccgagattgtgccattgcactccagcctgggcaacaagagcaaaactcttgtctcaaaaataaaataaaataaaaaataaatattagccagagatgatgttacttctaatgaaggaaaaagtgatattcactacaaataagaagaatgtctaccacctctctagcatttcattaagggagtacactgtggttctgatcacctgctgtctgaattttaccataaattatattttgaatgaataataatctgtgactgtattggcaaaacaaagtcaaatatatgagatatttttaaaagatgtaagccattttaatactctagttactctaattctaaggatcgctattccacagaggccactactctgctttagaagagtttcattatacctccctggcaatgtaagacataaggaatccagagtggtttttacatccattgcatttacccaaatacaccatcggagggcagcacacacctggttgacttaactgcctgtctggtggccttatcaaaatagttgtcaaattagtctaagacattcctaaattaccactcagataggcaggaaagctgttggagaagacaaaaggagcaaagatttttaaaagacaaaagaatgcattccttaagactctgagtttctacaaaagggaatctggagctaatcaatgctgcaaaatgggaaaacggagttaaaaaaggaatttcctcaatctgagaaaacagatttgttatatttgaaagatttttactgagtatgatcatccgaacaccagctactaaacaaaaatcagatctccttgttcctattaagatgcgctaattaataagatggcaacaaagaccaccatataaaagggttccttcagtaatgttttcttgagtgaacaaaaatcaagcctgccttatattgtattctactttgcatcacaaacagttttagtgtatttctggaaaagcatcagcagttttttcgaattttaaattctggagttatgtaactatataggcaggcttttttataacagaatataacagtgatacttaaatagaagacttcaaatgtaaatatcagtagagcctcgttaaggctataaatccagactttgtgataatgtggattaaatattatttacataacatataaggaggccgggtgcagtggctcacgcctgtaatcccagcactttgggaggccgaggcaggtggatcacctgaggtcaggagttcaagaccagcctgaccaatatggtgaaaccctgtctctactaaaaatacaaaattagccgggtgtggtggcacatgcctgtaatccctgctccttgggaggctgaggcaggagaatcacctcgggaggctgaggcaggagaatcgcctgaacccaggaggcggaggttgcagtgagctgagattgcaccattgcactccagcctgggcaacaagagcaaaactctgtctcaaataaacaaacaaacaaacacatataaggaaagggatttgctaagcaaatacagtctaagcagttggcaagaggaaatgcttcaattatttaagaataatttttaagtttaattccaattttaacttgtttgcaaaaatctttttggagaaatatgacgtatatgcatttctaaccagcttcttgcatgattctaatatagtcacctagtaccagtaaacagactgctctttgatttttttttagaacaccaggcactactttcttggagtagatgattaacccagctaaagcttgatttttactagctagcactttattaacctagtgtgttatattgtgactttaaaatggtaaaaacaattayaaagtggagttctcattcaggttagctttctagtccaagtcactaacaatttactatgtaatagacattctaagatttctgccaacaattctattgtcaatatataaaatcaattttcagaaaactgtaaagattatttccttgtttaattaagattctactaatcatagaaaagattatattgcacacttttctcaagttacctatgggactgacaatatgtccatgtgtcctgatagtaaagtcagttatctgaatgcgttccattttggaataagagatctaagtgctaagcaagtaaccaccaccacattcaggtttagaattggaagatctttcattatattaatagaccctttatttttagatataacaaaataccaaagacaaatggccacatatatcctaatgtacttgagaaatctcgctactaatgctgtgtcactaattttttaatactgtatttaagaaaaaaaaaaagcctgtcttttctattggcatcattcaagaagaaaaaaaaaaagctgaatcaggatatttctgtgtgaatgcacattcctcactaaatctctcaggcagctgctttagtcactgttactaacaccttgctctgtcatctctttgtacacatgtctaatttatcagtttcttgtagattgtcagcagcctgctgcctccgtaccgccacagtgctcacaactagccgggaggcaagactgcccaactgtcaggtaaattcagatgtcctttcccttccacccagctgcatgtcagatccatagaccccagctcccctttccgacacctgaactgcctacgcatcattgtattttgctgtattttatttcaagtgtgggctacatagacacacattggacacctgcagtccctgcgttcccagtaggaatacaagagagctggggtttattttgctggctgccagctggtagactctacaggctgccttcagcccctttgtctgtgtaaatacttggattagtccactgtttcattcctttccaaaaaataaaagctggaattgttatgatgtttgtcctactttttattttcttttgtctttaaaatatatttattttcctgsggaatctgagggataccaatatactaattgacctgatttgattcctgtactttatatgtattaaaacatcactatatactccatgaatatgtacaattattatttgtcaatttaaaaaaataaaatccccgctactcaggaggctgaggtaggaggatcaatcgcttgagcctgggagttcaaggctgcagcgagctatgataccactgcacacctgcctggtgagtaagaacctgttgctaaaaaacaaaacaaaacaaaaaacacagtaaaataaaacttaaagtgtttaaataggccaggcatgatggctcacacccgtaatcccagcactgtggaaggccgaggcagagggattacctgaggtcaggagtttgagaccagcctgggcaacatggtgaaaccccgtctctactaaaaatacaaaaattagctgggtgtggtggcacatgcctctaatcccacctactcaggaggctgaggcaggagaatcacttgaacccaggaggtggaggttgcagtgagctgagctggtgccactgcactccagcctaggtgacagagagagattccatctaaaaaaaaataaaaaattaaaaaatatatatctcaggccaacaaacaggaagaatataaagaattagatataaaggctgggtgcagtggctcatgctggtaatctcagcactttgggaggctgaggcaggaggattgcttgagtccatgaatttgtggttacagtgagtaaaatcacatcamtgcactccagcctgggtaacagagcaagaccctgtctctagataaatagatagatagacagacagatagaacagctgtataaaagtgtttctgtgtttctgttctctgtccactcagtagccttggtaaaactgaatttgaaaggtggagaaaaacattgtagttagcattcaaaagataatatttgctgtgacagtgacctttatgtgagattacttgaaaaattgttaaaacaggtttgcacagtcctgaacactgaactggagagtttgctgacaattccgattccaaaggaaagctttccaaatcagtcatgaattgccctccatcctggtgaacctccacacagcrtctcagcgttccatcaggacctcacctccatcctggaatgcttcatctccagccacctggcctctgatggtgccagacctcagtagtcyggttgtggttttcatcatctgctcagtgttctctccttatcacagctgttgcccttctaccaggggaaggcttcttttgagcaggggcaggcccaaacactttccatgtgtgtctgaggagtagatgtcagtagcaagctacatgtggtcaggggtcagagccaggggacctggggtgccacaagtgtggaaacacagtggcagctgaagcccaagtgtcacatggtctcagaggcggttgtgcagccagctgtatcagtggaacattgagttagcacagaaaggtacattattggccaggtgtggtggcttacgcctgtaatcccagcagtttgggaggctgaggcgggaggatggcttgaacccagaacttcaagaccagcctggggaacacagggagacctccacccccgacctctaccaaatttttttttttttaaattagccaggtataatggcacatggctgtagtcccagctatttgggaagctgaggttggagggtcacttgagctcgggaggtcaagactgyagcaagctgtgattgcatcactgcactccagcctgggtaacagagtgagaccctgtctcaaaaaacaaataaataaataaaaagaaaaatacattataaaataggttgctagccagcagtttccaattggtgtgtgttagttgattgttcccaccaccttcagcaacagggctttaagaaaggtttttcgctaatgccattttacaacagcactaatttcggttagaaataataatgataggtcaggcgtggtggcgcaggcctgtaatcccagcactttgggaggccaaggccggtggatcacraggtcaagagatcgagaccaccttggccaacatggtgaaaccccgtctctactaaaaatacaaaaattagctgggcatggtgatgtgcgcctgtaatctcaggttctcgggaggctgaggcaggagaatcacttgaacctgggaggcggaggttgcagtgagctgagatcacgccactgcattacmgcctggcgacagagcaaaaaagaaaaaaaaaaaagaaataatgtaattatagatttatctcaattatataagtaacaatataaatattcaaactcgtctcagtgggattctgaatttgtagcggttaagaacagggctcttcacctacagtccattctccaccaagcacccccagcccttaccscaaggcctgggtcagtgctgggcacatgacagctgtgcactaaatattgattatacctgagagagtgaatgagctctggaatcagattgcttgggttgaattcccacttctaatacccactggttgtttaactttgraaaatttcttttgctggctaagattccatttcttcacttgtaaagttcagatgacaatagatactgagggaattcagcgaggcacgctcctggcttggagtgtctgctcagtatctgttatcaatacttttttagtatcttaccattcctcaagacaaagatctgcaatctcttaacctctctaatttgctgaagaaagcgtggagcgggctgctgttttgtttgcttcagagattgggtctggctatgttgcccaaactggacttgaaccctgggctcgagcaaccttcctgcctcagaagactactgcttgaagtgtttccattaagtaggaaatggaaaggctggcaggagatttttttaacttttttttttccaccttgcttgttttttgagaaccagtttgactaaacaattatgtagtctagttccatctgttctgagattaataaatttaggttgcttactactaccacagggatgatttactttaaagaaaagcaatttaatgaattacaaacatttccagcttctcaaatgtttccagtttctacccacatgaatacagcctggtctagagcccaattctactactgttccccatcgtggtctacgtaaagaaatgattaaatgcatatagatctgaaaagactcttttccaaaattgctgggatgatgactgactcttttcccacccatacacactgccaaatgggtcaatgttaataccttcattgccctttttactccttcttggcagaaaagttaacacatagccaacattcgaattcttagtataaaccagacaagggttcatttctttacacatattaaacattacagccttccataagggataagcacagttattacacccatttttgttgttgtttttgtttgtttggtttagttttttggcgtttttttgtttgtttttgtttttgtttgagacagagtctccctctgttgcccaggctggagtgcagtggcgtgatcttggctcactggcacctccacctcctgggttcaagcaattcttctgcctcagccacccgagtagctgggattacaggtgtstgccaccacacccagctaatttttgtatttttagtagagacagggtttcaccatgttggccaggctgcccttgaactcctgacctccagtgatctgcctgcctcagcctcctaaagtactggggttacaagcatgagccaccacacctggtcttacacccatttttatgtgacgaaattgaggtttgggaaggtaaaatgacttgttcaaggtcacatatcctgaacacaactgagcctagtgactcctacctaccaccacaggtggctgcactgcagaggagaaatctatttcagttacactgtgaggagcaaagtcagagtatgtaaatcacccaccatgattccttttccctcaaactgaagaggaatgtttgtttaatgagaaacagaagatgtgctaagaatgttgagttatttcacatcaggtgttctgtttctcattttgaaaaatgattttgagtgctgggcccagtggctcatgcctgtaatcccagcactttgggaggccaaggtgggcagatcacctgaggtcaggagttcgagaccagcctggccaatatggtgaaacggcatctctactaaaaatacagaaattagccaggcatggtggcaggcacctgtaatcccagctcctcaggaggctgaggcaggagaatcacttggaacagggaggcggaggttgcagtgaaccaagatcacgcttggacaactccagcttgggcaacagagtgagactccatcttaaaaaaaaaattattttgtacttccctcggtttatacatatattcaaacagcttttaaggtgaatgattttttaataaaagagcattttctcacctttaacaatgtagaacttttcagccggacatggtgactcacctctgtagtcccagcactttggaaggctgaggtgggaagattgcttgagcccaggatttctagatcagcctaggcaacttggtgaaaccctgtcctttaaaacaaaatacaagaattaggcatggtggcctgcatctgtagtcccagctactcaggaggctgcggtgggaggatcgtttcagcctaggagttcaaggcagcagtgagccgagattgtgccactgcgctccggcctgggtggcagaagaggaccctgtctccaaaaacagaaaaaaagtagaacttttccatgtatactttttacaggctaattccattgtagagctaaattatcaaaattgtttatagataataggtattataatatgaaaggaatgcccaaggtatatagccttggatataatattgaaatatatagagttgtttggtatttagcacttcccttctatcaagtagttttctacttgggaaaaaaaaagaaacttcctgaagatgtatccaattttatatcttagtaacagcttcctaaacttgccatttacaacatgatctacctatgtaaagtaaaatcaatggtaaatgttgaataacaagtggactcttgaaaatatttagcaatcacaactgaaactgaattcattctatgccttaaatgattataatttatcaaatatttatatccaagaaatagtatcttaacctgtaagccaagaatgtgtgtcttacaggttaatttacacataatatacaccatgtgattgcagcattttatgcaaattaaaaatattaatactatagataataactttatgtaagaaatctatctaaaggaatgaaaaaaatttaaatcatcacgaatgatgtaatgtcaaggtgttaggcaaagtgagttgtaacccatatttaagctatagctacacacttcagctggtcaggaagaaatatttgtcttcctttwtcaaaaagagtattggggccaggtgcagcggctcacgcctgtaatcccaacactttgggaggcygaggcgggtggatcacaaggtcaggagwtcragactgtcatggctaacacagtgaaaccccgtctctactaaaaaaaaaaaaatacaaaaaattagccaggtgttgtggcatgtgcctgtagtcccagctactcgggaggctgagacaggagaatcacttgaacccggaaggtggaggtggcagtgagccaagatygcgccagtgcactccaggctgggcgacagtttgagactgtctcaaaaaaaaaaaaaagtaytggattacacaaggtcttcaaaaacatatctttcttgggtggacacagtggctcatgcctgtaatccttgcgctttgggaagcagaggcaggctgatcacttgaggtcaggagttcgagaccagcctgggcaacatggtgaaactctgtctctactaaaaatacaaaaattagccaggtgtggtggcgcaggcctgtaatcccagctactcaggaggctgaggcactagaattgcttgaacctgggaggcagaggttgcagtgagctgggatcgtgccactgcactccagcctgggygacaaagtgagattctgctcaaaaaaaaaaagaaaagaaaagaaaagaaaaaaaagccatatctttcttgtgtaatgtgacgattctgcattacttgccataaatcacattgcataatatgtttagttccctaaaaagaaattagttctggtgctgacttccacagcacgtatagtaaaattggagttttttttactatatgtgctgtggaagtcagcagtctaagtcatgcatatttgcagaaaaactgttaggtcgatgggaaagtctggcctataacctgctgtttaccaggccgtcaaactctgtttggagggtcaagtgtgaatcttgccatacattattttctgttttaaatattttcttttctttcttcttttttttttttttttgagacggagttttgctcttgttacccaggctggagtgcaatggcgtgatctcagctcaccgcaacgtctgcctcccgggttcaagcgattctcctgcctcagcctcctgagtagctgggattacaggcatgtgccaccacgcccggctaatttttttttttttttttttttttgtatttttagtagagacagggtttctccatgttggtcaggatggtcttgaactcccaaccacaggtgatccgcctgcctcggcctcccaaagtgctgggattgcaggcgtgagccactatgcttggcctaagattttcttcatttattttcctttttttttttttttttttttttttgagacggagtctcgctctgtcgtccaggctggagtgcaatggcgcgatctcggctcactgcaagctccgcctcccgggttcacgccattctcctacctcagcctccggagtagctgggactacaggcgcccgccaccacgcccagctaatttttttttttaattatttttagtagagacggggtttcaccatgttggccaggatggtctctatctcctgagctcatgatccgcccgccttggcctcctgaagtgctgggattacaggcgtgcgccaccgcgcccaggcttattttccaatttataaatgaggccgggcacggtggctcgtgtgtgtaatctcagcactttgagaggccgaggygggcagatcacttgaagtcaggagttcgagaccagcctggccaaaatggtgaaagtccgtctctactaaaaatacaaaaaattagccggacgcggtggtgggcccttgtaatcccagctactcgggaggctgaagcaggagaattgcttgaacccaggaggcagaggttgcagtgagccgagatcgtgccactgcactcctgcctgggcgacagtgagattccatatcaaaaaaatttacaaatgaaactatgcactattttcttaggctttttgttgaaggtccagttctcccatgtttacataccacattttaaaaataggtaggaaaaacaatttttatcactgcttgtcttaaccagtacagaacagcaaagcttcttttaaactatatttacagcacttcaaagagtttgggaagaaagaataacctcaagccagtcagatattttccataattatgattttgtattaaaatgcaagagatataggtagaggataatttcagtaccaaagataaaaattatttaatactaattttaatgactccattacattttaaactccattaaatttaaagctaattttaattagctttaaaaagctatgcttaaattaatagtaataatgagccttgaattgttctctcaaacatcacttctggtagaaatgaattatatagtactgactttcatagtttaagggaatataacagagttttagaaaaatactcttttctaattaaaaaaacaaatctccatgttgtgattcccccattgctagtcacattttttttttttttttgagacggagtctcgccctgttgccaaactggagtacagtggcgccatcttggctcgctgcaacctctgcctcccatgttcaagtgattctcctgcctcagcctcccgaatagctgggactacaggcacacgccaccatacccagctaattttttttttgtatttttagtagagacagggtttcaccatgttggccaggatggtctcaatctcttgacctcataatcctcctgccttggcctcccaaagtgctgggattacaggtgtgagccaccgcgcccggccgctagtcaaattttaaaaggcccaaacccaaatgtgttttgtcattttaccctaggaaactcaatgattttgcttctttattcttcaagattattcatccagaccctgataggcctgagcacaggttcatttaaactagaggctatcacaggcgtcgtttggaaagttacattatacacttaacaaatgggaaatgttaggctgggctcggtggctcacgcctgtaatcccaacacttggggaggccgaggcaggtggatcaccagaggtcaggagttcgagaccagcctggccaacatagcaaaaccccatcactactgaaaatacaaaaattggcagggcatggtagtgcatgcatgtaatcccagctgctcgggaggctgaggcaggagaatcgcttgaactcgggaggcggaggctgcagtgagctgagatggagccactgcacaccagcctgggcaaaacaacgagactccatctaaaaaaaaaaggggggggggtgaaatataaaactcttccttatacctccaagcccaagcaggtagggggaattcttagagcaaattagacttccacaggcaaattctttatcctagtgaatctggatctaccagataactatagaatcctctaaactccaaagccttggtcaacctgtcagtaccatcagcatcactgggagctcattaaaaatgtagaatctcagatctcaccccacacctaatgaatccgaatctgccctttatactgagctccccaggtaatttgcatgcatattaaagtttgaaaagaactgatctcatgaaatcttacagctaacacagagacctaggagaacaagaccgtgcaaaaattgagaagaacttctgtaaaatgctgggggcaagaaaatagggaaaacaagaaaagagaagagtgactttgagggaagagtkcatatatcatttccttaatacatttcatttttcttttttatgccttgttttgaaaagctaccattatcttggcatgctttagatggaaaccatttactgtgcagatttctgttcttgttctcaaaatstatgcaaaaatatctcgtctaacccctaccattgtgcctggccctttgaaatgtgtttcttgctgacgtgcttgtttctcctttccagtcctgacacagctctccctgaggagcagccacattccagctcccagtgcgcccctctccactgtctctccaagcctcctcacccctagtcttcatctcctgtggacraacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaaraaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttakgcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcartaacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgccaaaaaaacaatagataataaaccttagctcattgtctacttttgacaaacactcaggtgcctacaaacattctattatcttgagataatacatgttcctggttaatttacagattctgctgggtaacttttatgacttgatttaaggcagtggattttcatagcaaaatttattttgcacataatctgacaaacaaggaaaacagctaactgagctgaaaggtctaacactctcgggctccttaaccatcaagtgctgcccacacaattgctcctagccctgattccttgtctttgtcaggtagccttaacttatttaaaaccataagggtttgaccttttcatataaagacatctgtaacttctcttcaaaacaaaaatgaccctcactgttaacacaaaggacagttaccagtgtagggcactgagaaaggagatccaggagccactcagcttattgagcggacatgggtggcacagaaatggagtggtccatcagagaccaaatggtaagtcgtaaagcacattgcaggagctttcgttagtcatacgcctattaagtagtggtcgctattaccaaagcaaccaggacgttttgtgttctttatatgagtgctattttccacagtgtcatttattatgcaacgtggagtaaagagttgaaatcttcaccaaaataagggttcaggttaaagtacagaaacagaaacaaaacgattcgacatgaagttcccaaccatagcagcctaaccttctgctcttttctacctgcatggccttgctgttcctaaacattgtcttcatttcactggcgttgtatctgcctagtaccagtattagtgagactgtggattttatcagagttcaatgaaagaaagcttacccctgccctcactttgtgttttttatttttccccctttctcaagcaccacgtatttggacctgagaagtggcatagctgctaagttgacttttaataaaaaactgtttgtgcctgagggaaatatatgcctttttaaaaagtacctcagaacatgttcgtagatcgtctcatcggttttgtttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattcaaaaggaaattgaaaaggggcagaactagtgagaaccaaaaagaatgaactccagtaagactaattgaagacatacttggagaggaaaaataaacagcagaaatgcactaaaaaatactggctaattattgcaaacagagtgagcaaagattaatgctaactagtaaaagtagttagcaaagtaaacaggtagttttttaaaagtaagcacaattacaatattgaatagtatggagaaatgcttttctcctgaggattttccttaatcaaaaaataagaagaagcaataaattgtctttggcctgagtgctgagtggcataaataaaggagcttggcttaatctttctggtccacacataatccattagatcccattcatatatccaactctggattctaataaaataatttggagaactttgagaaaaaggaaaactgttaaataagaaaagacctatttagaaattatactttagtctaacgaagaggaggtacaatagtagtcttcaagaaaagaatatttaacaaatgatagatatcagctatagatattgttactaagtctagaataaaaaaggcttcagtgtgaaggatgtatagtaactctaggaaagagatttttaacactgggaaattaacgtggaaattgataatcataaagaatatttgttttgtaaaaattgaatatcattggtggtctagtaagtattaagtggcaagataggagaatgcatttcagttctgggagctcataatcctgtgattcttttattttaagttttaaaatacattaaaattttactggttaatcataaaatattttatatttgaaaataggatggcaatctttatttttccaagatatttgttggaaaaaaatgatcgttggtattattttttctttcagctatattccatggtatctttaaaattgttcagaatataggacttttactaaaaaaattcaattgtcagagtctaaaaaaacaatgtcctcaggaatacttcagaaatagaaggtatgcaatcccttagtggggggcaaacacatttcagatttcgtctttatttaaaaggatcttcagtctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcgtttgtaacctgatcgtattatgtttacagctgaaagatttcatctagacatgtctttcgtccttattattcaaagtgtaattgaaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgaatcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaataccatatgaaaacacgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttcattaatgctgcctttttatcaatttgagcagtttttctgtatgtcattttgatgtatacttacaaaaaggaaaagactatatgaattcagatgtgatctatatgtttattcaaagtaagaacttatttgaactaaaaactaaatgctttgctttaacaacaattctatacattcctggtaagtaatgtgtatcaactctgctcatttcctccagttatcacctcttctacttgtaatcttttctagaaagctattttggcaggaggatatacttggctgaatttgattagaaatgtaccaacatgaagaaaatgcttgccctaaaacaggaaacattattttgatgaaagaagaatgaagtttctatgcattattttgggagacaattcctctttgttctttttggaacagcagagttccaaaactttgagggaggttaattttctagctcctcctacaaatacatattgtagtaaatcagctgctttgggaaccatccactttgattcgattttatttaaagggtggaggagggggagaggcagatagaacatggtgttctagtgagttaaaacgtctaatgcaatcctcattatagctaatcaaattcgtgcaacacgggcagccaacatcctggcaaaagctgtctgctcacctgttgcataaatacaacactagaaataataatgtaaacttttctacaaatttctcctttttctcttccaaaagcttttgtttttcttggaggttggatctataagtctatttgatacttgactttctcttacatgataaagctgatagtctgccacattcaaaagtgaaaacagctggacgcatcaagaaagtctcttctcatctatacattttgcaggcaacttggacagcctatattgcaacccacaagggatgagaaagagagcagaatcgatgggaacttgtggaagggatttccgtcttcttcttcttcttcttcttcttcttcttcttcttcttcttcttcttcttcttcttcttcttcttttcttcttctttcttcttctccttctccttctcttctcctcttcttcctcttcctcttcttccttcttccttctttcttcttcttcttcttttttaaagag

SEQ ID NO: 17996 - DNA, 41665 bp, Homo sapiens
aaggtagactgtgttctatgggttgttgttgcctgtgagcatgttcccattatagccctggagccacagctcagccttggtgtctgtacataactgacttcctttctaattaccacaggcagattggctaaagaagaacaactttggaggtgccatggtctgggccattgacctggatgatttcacaggcactttctgcaaccaaggaaaattccctctgatcaccaccctgaaggatgctctgggcctgcagagtacaagtgagttagggagtgagaagggacactaagcctcagacttaagagaaattccaaaggttccttggaagtcatggagctgttgcacaagtaattgtctgacattgtccattcctatctggtaacaattgattaatggtgggaagaacaaacagggctcttcaccatttcttccttccttcattcatttcacaagaaatttattgaacatctattacatatacagtgctctgtaggtaccacaggtgatctaaatgcataaatatccatatctactctatggaaatttacaatctagtgagagaaattggatttacaaaaactgcaaagctagacaacaatacagaagatattatgtgatactgtgccccctaaaagaataagtaaccttcttgtgagttcatgataatgaaaaatttcaatcagtaagatgtaaggaggaaaaaatgcactgtgacttgaaggatgaggaaggagttggtaagcaaaggggtgagtggagcaggaaggatatatcagatcagaagactgaaatatgtggagacatagaaggaggagccaagaacaaaatccaggtactagctctcacacatcaggtatcactggctaaaagcaaggaggttcaggatttgttttcttttttcttctcaggttgcaaagctccagcccaacccattgctcccattgccgaggcaaacatcacatgcggtgtcagccacagtggtagctctgggggccgctctggcaggagctctgggggcagccccagaggtagtggattctgtgctgacagggccagtggcctgtaccctgaccccactgacaagaatgcctcctacagttgtgtgaatggaaagactttcactcagcactgccagcctggtggtgtctttgataccttctgctcctgctgcagctggtgataacatttttcagatatcacctcacccagcctcagaagttgttgtgcaataaaaggttgagcattactgtacaatcgcttctgcttctttactgtaggatcttagatgtaattgatccctatttcccaatgatatacagttgctccaccagcacccaagcctgcagcatgcactgctagtcctggatgttgggtagcggaagcagggggattaaaggaaaatacatggtcccttcattctcaaaacatgtattcagatgaaggctggggagcccaagaatgtaagactcagataacaatgacccataagcaaatgtcattttaaagtgattgatttgcccttttggctgagaatgcacaattaggaggctattgcagtgattcaggggagaggtgcaggctcagaacaaagtagtagcagtagaagtggtcagaggtgattgaatttcagctgtattcttaagatttgttaagccagcaggtttctttatgggttgcatgtagaacgtgggagacaaaaaggggagccaaggataatttcaacattttggcttaagaaattgcaaatatgaaattatcatcaactgaaatggagaaagctaaaagtagagtagattatgaaggaagagcagaagttcaactttggacatgttgaatttaagattgttattgggtttctaattggagatgtggagtagatagttggacataacatttttagaggtagttggtatttatagttggacataacatttttagaggtagttggtatttaaagtcaatagattagatgagatcattaagggagacagagaaaggaaagcattcaaggactaagccctgagcatttcagcattcagagggaggctggagagaagagtaggaacaagtaatgaagaccaaaaaaggagggctaagtgaggtagaaggaaaaccaagtgtcaagtatcctgaaagccaaggaaagaaccatattaaggaggagaaagtgatcaagtttgtcaaatactacttaggtcaggtcagatgaagtctgagaattgaccattatgtttaacaacctgtagatcattgacaaacttgacagaagtggggttggtaaacatcttggtggcaaatgcctgagtgcagtaagtttcagagagaatggaaaggtaagaattgaagacagtaaggatacaaaaacctgtcttatatgtgttaaagggaagcaaaaaatgggattaagaataaaagattatggaaaacagaagctgaatttatgttttcaaacccacatttacttatttagagatatgggagataaaaatctaacattctttccatacctctcactttcttatttttattattattttcacagagtcaaaaatttttttaacttaaaaattttttttttttgagacaaggtctcattctgttccccacgctgcagtacaaaggcacgaacatggctcagtgcaccctcgacctcctggactcaagcaattctctagcctcagcctcctaaagtgctgggattacaggcatgagccaccacatccagccccaaatttttaatatcactttgttttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaactttttggacatagatattggctcactcttttactcaaaattttgtaaatattactgctttttattctggcattgaatattgagctagtgtttttcctatggctctttcatttactttttcaggtttggatgttttgtagttgaacagttttttcaagtagttctgtggctgccacaggccttaagttcttttatatgtgagaatatctgcctgtctccttggttcttgaaaagtatacttcaagaatattatacttggtagagtataatacgataggcttgtactttcttttcctcagaactcttcagatgtagacaaaacttcttaacattatttcaaatcatctctgccttaccttttaattccagttgaagctacagccaccaattctgcataagccttaatggtcttcatggcgttatggaatcttacctcagatctgtgttgtgtacttcttgctacccttcctagggcttctgagatacaggtttccactcaagcaggtacaatctagacacgcagaggggttactgtcacttacaaacatcagggaaacgtaatgtttccacctttcctcccctgatgttctagaagcacattttgtaagacttttaacaccgttccaaagggatagagcatttagttgtttctaccagtggctaatatgataaaagcatgattttattggccctcccttcttccctgtttcactcccctgtctcttacttattctttgcattccactcccaaattactctcacatgagctacttccaggtgaacttagccttagatagtaggcattgctccactgtgtcctggcattgaatattgttgtagggatgtttgaagacagtggataatcactaccctttctttaatccacacttttaaagttatttgatttttttcctgtgagtgcctgaagaattcatgatttattcttgaagttcaataacttaacaaggttataccttgattatgatggtttttgtcaatttctcctataaaacagttgagaggtaagatttaacttgcctgagttaacagacctgcaggcggcctcctggaaaagaaagttggcctgttgcctctggaaaccagctataatctatagcctaggtcctaatgcaatccatcctggcagagagctgaccatggtgaatgagaacttcagccaagtttacaccaagcagttgtgcataatcacggggttggattacaccagaagaaagccaagtgttctcccaacagatgaatgctaaggtagtagataagactgaaagccaaggttctgctatatcatactgctattagatcccatatcctaatctcactaaagaagagttttgttaagaagcttaaaagtcccaacatccaaagcccagagcctctttctcagagctagatatgtgctatgttagattgttgtatgctgcctgagaataaaataaacaccagaggatcactcatctgccatcgcttctgtctctgactttttacccagaagtactattccagaaagcccagtgtgcatgctgcttggctactcaccctgaatcacttgacaactggtgtagagagctggatgtcagactaggggcacctaccatggccttctagaagtgaaccaagggacttgggatttaaaaagtgtttctcagatgatcccatcgctttcaaagattggtatggcagtcatggggactagtccactaaattcctgaagatacagagtgataaaagtgatactgcgtagttaagatcatcgagcctagcattccatgattgttattattggccttggaagaattagctctaaggaggcagaccgaggggaacttgactcagcatcttgaatgaaattacaatttgaaaactttggtgaatgtgaaatgatttatatatggtcttatccaagcaggatcaaacaaattccatcctctgaccctcttcctatgactgataggatcagttcaagatggcacaggttgtcatgttattagggtgttatgagctccagttaaatgggtgcaaagggaaggaaagacaaagtatgtgacttatgaggttagttccctcataacaagtgaagaagataatctgaaataggctgattgaactaaccgaacttctgggtagactcccactatagctccgtcttagaaagtctatgtgattactgcttctatataaagggttaaacatgataaaattgatgatggtccctatctttgtctatggaaaaaaatatccagtgagttttgggggaactcatgacccaagtcataataggaatttcaggcttcataaagacatcatggttgaagcagaggtgctctgtttccagcaaagcccaacaggaagctaacttttgctttttgaaaggaggattccccaccagactgggaagcaacagcctaggctccagagtcggacactggacttaagttgttatcagatgaatttgctcagctgcgtactgttgtgttacaaaatcaaatggcattagatacgcttacctcagcccaaggagggttttgcaccttactgcatactgaatgttctgtgtatagccctaacaattctcacaatattactcacaaagccatgttgggtgtggtttttattaattgtgcttttaattctgctgtacttaacctgtatctgtaaactatatcaaatatcccttccccatgtatctgtaagggtattttcctgcaattgagtatcagattgaggccaaatgtggaggaaaagttaaacattaaatttgaactcaactgaacatggacacaaacaatggtcaccaagtcccgcaacaggttgtgtgagtcccttgaggcgttcatccagcactgttttggaaaaatctctatttcaatctagtcctatatgttagttattgaaaaaaatagacagtctcaaaaaacaagctgacctttttatgttccttgaacctagttgtgaagggcccttgttactgggcctcatgccaaacaactcattacaaaaacagctagagtcccagacggtgccaaagcttcatgaaacctctcctcgtctgtgcacgaacaggtggccaactctggagcccaggctgttgctttccagtctggtggtgaatcctccatagtctggtgagtgtaaatatatatatatcttttcccttctccctttcccattgcaatttgattgttatatcaatttgcttattatatcaagttgyttattatatcgtttgcttattacatctgcattgccatttatgtgagataaaggttgtttacccttaaaggtattgtgtgtgtgtcttttctcctcccctcacacatctctcacacagatcattttatacccaaagggatataaatcattctactataaagacacatgcacaygtatggttattgcagcactatttacaatagcaaagacatggaaccaactcaaatgcccatcaatgatagactggataaagaaaatgtggtacatatacatcacrgaatactatgcagccataaacaggaatgagatcatgtctttgcagggacatggatgaagctggaagctatcatcctcagcaaactaacacagaaacagaaaactaaacactgcatgttctcactcataagatggagttggaacaatgagaacacatggacaccgggaagggaacaagaaacactggagccagctgrggggttgggrgcaagssggggagagcattaggacaaatacctaatgcatgtggggattaaaacctagatgacgggttgataggtgcagcaaaccatcatggcacacgtatacctatgtaacaaacctacacattctgcacttgtatcctggaacttaaagtaaaattttttttaaaaaggggggaaaaatatatagcaaaatgcaactggaatttccaaatgaattagtattttatttaaacatctatattttaaaaataattgtaataatgagaatacatagacacagggaggggagcaacacacactggggcctgtcggggggsggtgggggtagggaaagcatcaggataaagagctaaagcatgtggggcttcatacctaggtgatgggttgataggtgcagcaagccaccatggcacatgtttacctatgtaagaaacctgcacgtcctgcacatgtatcacggaacttaaaataaaatagaattaaattaaatcttaaaaatagtaattgtaataaatttatatttgaaacatgtaaggtatttaattcacacacaatgttttgtgtgcaaactcccctttcccctataattaytcctcagctatccaaggacttgaggtcttcagattgggaaaaataacattaactaaaatttattaaataactaacatgtgctaggcccagtgctaggtaggttatctcatttaattctcacaacaaccctataagacaacaactagtattatccatatgtaatacatgaggaaattgaggttcacaggtgaaataacttgtctaatgtcacatatctagaaagaaggagaacaaaaattgaaatataagtyagcgattctagagaccatgctgatattctgttctgtcatatggcaacctttgtgctggacagrtgtgggagaatgctctctgcaattgactggcattggttattctaacagtcttaccctctttgtatgtgaataaactggcattctcacttacattgactgcatgggccagtctccgttatctttttttccatgttttaaaaatgtttttcttgtggtaaaatagaccaaaacaaattaccaacttaaatattttaagtgtacagttcggtggtactaaatacattcataatgttcttgagccatctctcctttccatctccataattcttttcatcatgtaaaactccagctctatactcattaacctgtaagtccccatttccccctcccccagctccaggaaaccactattctactttctgtctccatgattttgactattctaagtatctcacataaacagaaaaatcatatattatctgtctttttggactggcttttttcattgagwataatgtctcaagattcatccatgttgtagcaagtcagaatttccttttaaaggctgaataatactttattgtatgtatatataacagttttgttatccattcattcactgaaggacacttgagttgcttgcatgttttagctatggtgagtaatgttactgtgaacatggaagtacaaatatttctttgacaccaagctttaagttattttgggtatacctagaagcggaattgctggatcatatggtaattctatgtatgatttttttaggaacttccatactgttttccatagcagctgtaccgttttacattcccaccaacagggcacaactgctccaatttttccacatccttgttaacacttattattttctgttttttgatagtagccatcctagtggatatgaggtgatgtctcattgtagatttgataggcatttccttaatgattaatggcattaagcatctttttatgtgtttattggccatttcaatatcttctttgaagaaatagatattcwagtcctttgtccattttgaatcaagttgtttggttgtgtgtgtgtgtgtcattgaattttagaagttctctctatattctgaatatctcttatcagataaactctttgcaaatattttctaccattccgtgagttgcacttttaytctgtttgcattgtcttttgatatacaaacatttaaaatattcatgaagtccaatttgtgcattgtattcttttgttgtctgtgatttaggtgtcatatccaacaaatcattggaagtccaatgttatgaactgtttgccctatgttttcttctaagaattttatacttttacatcttacatttaggccattgatctattttgagttaattttgcctatgatgttagaaaatggcccaaaaacatcaatggggccagatgtggtggctcatgcttrtaactccagtgctttgagaggccaaggtgggcagatttcttgagctcaggagtttgagaccagcttgggcaacatggcaaaaccctgttcctataaaaaatacaaaaaaattagccaggcatggtggcacatgactgtggtcccagstaatcaggaggctgaggtgggaggattgctcgagcccaggaagtcaaggatgcagtgagctatgatcatgccactgcactcgagcctgggtgacagagtgagaccctgtctcaaaaaacaatgacaacaaagaaaacatcactgggatttcgatagggatwgcattgaatctgtacatcatttgggtagtatagacattttaacaatattgagtcttccaactcatgaacatggggcatgtttccatttattcatattttctttatttgaacagcakgctatagttttcattgtacaagtctttcacttcattaagttaatttctaagtattttattctttttgatgctattgtaaatgaaattatttttataatttttctttttttattctctttgttagtttataaaaatgcaattgatttttgtgttgactttgtaacctgttattttgctgaattcattttttagctctgacaaaatttttggtgtggaatctttagggtttttcctatataagaccacatctgcagggacaattttacyacttccttcccaaattggatgccttttatgtcttatttttgcccaaatgttctggttaagactatgttgaatagaagtggcaaaagaagcattcttatcttgttgctgatcttagaagaaaagctttcagtctttcaccattgagtatgatatttgctgtgggtttttcaaacatagcttttattatattgaggtagtttgcttctatttctagtttgtttttattatgasagggtattaacttttrgcaaatactttttctgcatcaattgagatgattatgccatttttttcttcattcttttaatgtggtgtattacattcattggttttcataagttaaatcatttcttgcattcaatgaataaatccctcgtgaacacagtatataatcccttaacatcctgttaaattcagtttaatagtattttgttgaggatttttgcatcagtgtttataagggattttggtctgtagtttacctgtatgtttatctggctttgatattacagtaatgctggacatatagaatgagtcagaaagtgttttctcctcttcatttttttggaaaagtttgaaaagaattggtgttcatttgtcactaatgtttggtggattaacctctcaagtcatctggtctacagcttttctttgttggaaacttattgcattttatgatttttctgagacaggatctcactctgtcacccaggctggaatgcagtggcacaatcacagctcactgcagcctcaacttcccaggctcaagtgattctcctacctgggcctcccaaagtgctgggattacaggcatgagccatcatgcccagtgtaagatttttggttactaattaaatctccttagtggttataagtctattctaattttctatcttttcatgatttagctttgttaggtttcttgtttctagaaatttgttcatttcatttggattatctaatttattggcatacaattgttcataaaagcctcataatccaaccactgagaattaggcaagatggccaaagaggaacagctcccgtctgcagctcccagtgtgatcaacgcagaagacaggtgatttctgcattttcagctgaggtaccgggttcatctcattgggactggttagaagacaggtgatttctgcattttcagctgaggtaccgggttcatctcattgggactggttggacagtgggtgcagcccacggagggtgagccaaagcagggtggggcatcacctcacccaggaagtgcaaggcactggaggatttccctttcctagccaagggaagccatggcagactgtacctggaaaatcgggacactcccacccaaatactgtgcttttccaaaggtattagcaaatggtagaccaggagattatatcccgcacctggctcagtgggtcccatgctcatggagccttgctcactgctagcgcagcagtctgagattgacctgtgaggcagcagcctggcaggaggaggggcatccaccattgctgaggcttcagtaggtatacaaagaggctgggaagctcaaacatgacggagcccatcacagctcagcaaggctggctgcctctatagactccacctctgggggcagggcatagctgaacaaaaggcagcagaaacttccgcagacttaaacattcctgtctgacagctctgaagagagcagtggatctcccagcacagtgtttgagcactgagaatgaacagactgcctcctcaagtgggtccctgacccctgtgtagcctaactcggagacacatcccagtaggggctgactgacacctcatacaggtgggacgaagcttccagaggaaggatcaggcagcaatatttgctgttctataatatttgctgttccgcagcctccactggtgatacccaggcaaacagggtctggagtggacctccagcaaactccaacagacctgcagctgagggacctgactgttagaaggaaaactaacaaacaaaaggaatagcttccacatcaacaaaaagggaatccacaccaaaaccccatctgtaggtcaccaacatcaaagaccaaaggtagataaaaccacaaagatggggataaaacagagcagaaaagctgaaaattctaaaatccagagcacctcttatcctccaaaggatcgcatctacttgccagcaacggaacaaagctggacggagaatatgtttgatgagttgacagaagtaggcttcagaaggtcgataataacaaacttatccaagctaaatgagcatgtttgaacccatcacaaggaagctaacaattttgaaaaaaggttagacgaatggctaaccagaataaacagtgtagagaagaacttaaatgaactgacagarcggaaaaccatggcacgagaacttcgtgatgcatgcacaagcttcagtagctgatttgatcaaatggaagaaagggtatccgtgattgaagatcaaattaatgaaataaacctagaagagaagtttacagaaaaaagagtaaaatgaaacaaacaaagcctccaagaaatatgggaccatgtgaaaagaccaaatctacatttgattggtgtacctgaaagtgacagggagaatggaaccatgttggaaaacactctgcaggatattatccaggagaacttccgcaacctagcaaggtaggccaacattcaaattcaggaaatacagagaacaccacaaagatcctcctagagaagagcaatcccaagacgcataatagtcagattcaccaaggttgaaatgaaggaaaaaatgttaagggcagccagagagaaaggtcgggttacccacaaaggaaaacccattggactaacagcggatctctctgcagaaactctacaagccagaagagagtgagggctaatattcaacattcttaaataaaagaattttcaacccagaatttcatatccagtcaaactaagcttcataagtgaaggagaaataaaatccttyacagacaagcaaatgctgagagattttgtcaccaccaggcctgccttacaagagctcctgaaggaagcactaaacatagaaaggaacaactggtaccagccactacaaaaacatgcccaattgtaaagaccattgatgctatgaagaaactgcatcaattaacggacaaaataaccagctaacatcgtaatgacagcatcaaattcacacataacatactaacattaaatgtaaatgggctaactgccccaattaaaagacacagactggcaaattggataaagagtcaaggtccatcagtgtgctgtaatcaggagacccatctcatgtacaaagacayacataggctcaaaataaagagatggaggaagatctaccaagcaaatggaaagcaaaaaaaaaaaaaaaaaaaaacaagcaggggttgtaatcctagtctctgatgaaacagactttaaaccagcaaaaatcraaagagacaaagaaggccattacataatggtaaagggatcaattcaacaggaagagctaactatcctaaatatatatgcacccaatacagaagcactcagattcataaagcaagtccttagagacctacaaggagacttagactcccacacaataataatgggagactttaacaacccactgccaatattagacatatcaatgagacagaaggttaacaaggatatccaggacttgaactcagctctgcrctaagcagacctaatagacatctgcagaactctccaccccaaatcaacagaatatacattcttctcagcaccacatcacacttattccaaaattgaccacatagttggaagaaaagcactcctcagcaaatgtaaaagaacagaaatcacaacaaactgtctctaagaccacagcgcaatcaaattagaactcaggattaagaaactcactcaaaaccgcaccactacatggaragtgaacaacctgctcctgaatgactactgggtaaataacgagatgaaggcagatataaagatgttctttgaaaccagtaagaacagagacacaacgtgccagaatctccagttaaagcagtgtgtagagggaaatttatagcactaaatgcccacaagagaaagcaggaaagatctaaaatcaacaccctaacatcacaattaaaagaactagagaagcaagagaaaacgcattcaaaagctagcagaaggtgagaaataactaagatcagagcagmactgaaagagacagagacacaaaaaacccctcaaaaaatcartgaatccargagatgcttttttgaaaagatcaacaaaattgatagactgctagcaagacttacaaagaagaaaagaaagaagaatcaaatagatgcaataaaaaatgataaaggggatatcaccaccgatcccacagaaatacaaactaccatcagagaatattataaacacctctacacaaataaactagaaaatctagaataaatggataaattcctggacacatacatcctcccaagactaaaccaggaagaagtggaatctctgaatagatcaataacaggctctgaagttgaggcaataattaagagcctaccaaccagaaaaaggccaagaccagatggattcacagccgaattctaccagatgtacaaagagtagctggtaccattccttctgaaaccattccaatcaatagaaaaagagggaatcctccctaactcattttatggggccaacatcatcctgataccaaagcctggcagacacaccacaaaaaaagagaattttagaccaatatccctgatgaccatygatgcaaaaatcctcaataaaatactggcaaaccaaatctggcagcatatcaaaaagcttatccaccacgatcaagttggcttcatccctgggatgcaaggctggttaaacatatgcaaatcagtaaacataatccatcccataaacagaaccaatgacaaaaaccatatgattatctcaatagatgcagaaaaggccttccacaaaattcaacagcccttcatgctaaaaactctcaataaactaggtattgatggaatgtatctcaaaataataagaactatttatgacaaacccacagccaatatcacactgaatgggcaaaaactggaagcattccctttgaaaactggcataagacagggatgccctctctcactactcctattcaacatagtgtttgaagttctggccagggcaatcaggcaagagaaagaaataaagggtattcaattaggaagtcaaattgtccctgtttgcaaatgacatgattgtatatttagaaaaccccgtcatctcagcccaaaatctccttaagctgacgatcaacttcaacaaagtctcaggatacaaaatcaatgtgcaaaaatcacaagcattcctatacaccaataacagacaaacagagagccaaatcatgagtgaactcctatgtacaatcactacaaagagaataaaatacctaggaactcaacttacaagagatgtgaaggacctcttcaaggagaactacaaaccactgctcaacaaaattaaagaggacacaaacaaatggaagaacattccatgctcatggataggaagaattaatatcgtgaaaatggccatactacccaaggtaatttatagattcaatgccatccccatcaagctaccaatgactttctttacagaattggaaaaaactactttaaagttcatatggaaccaaaaaagagcccacattgccaagacaatcctaaggaaaaagaagaaagctggaggcatcatgctacttgacttmaaactatactacaaggctacagtaaccaaaacagcatsgtactgttaccaaaacagatatatagaccaatggaacagaatagaggcctcagaaataacaccacacatctacaaccatctgatctttgacaaacckgacaaaaacaagaaatggtgaaaggattccctatttaaaaaatggtgctgggataactggctagccatatgtaggaagctgaacctggatcccttccttacaccttacacaaaaatttattcaagacagatkaaagacgtaaatattagacttaaaaccataaaaaccctagaggaaaacctaggcaataccattcaggacataggcatgggcaaggacttcatgactaaaacaccaaaggaatgccaacaaaagccaaaatagaccaatgggatctaattaaactaaagagcttctgcacggcaaaagaaactactatcagagtgaaagggcaacctacagaatgggaggaaatttttgcaatctacccatctgacaaagggctaataccagaatctacaaagaacttaaacaaatttacaagaaaaaaacaaacaaccccatcaaaaagtgggcaaaggatatgaacagacacttctcaaaagaagacatttatgcagccaacagacatgtgaaaaaatgctcatcatcactagtcatcagagaaatgcaaaccaaaacacactgagatactatctcatgccagttagaatggagatcattaaaaagtcaggaaacaacagatgctggagaggacatggagaagtaggaacacttttacactgttggtggaagtgtaaattagttcaaccattgtggaagacagtatggtaattcctcaaggatctagaactagaaataccatttgacccagcgatcccattactgggtatatacccaaaggattataaatcatgctagtataaagatacatgcacacatatgtttattgcggcactattcacaatagcaaagacttggaatcaacccaaatgtccatcaatgatagactgaataaagaaaatatggcacatatacaccatgaaatgctatgcagccataaaaaaggatgagttgggccgggtgcggtggctcacacctgtaatcacagcactttgggaggccgaggtgggcagatcacgaggtcaggagatcaagaccatcctggctaacacagtgaaaccccgtctctacttaaaatacaaaaaaaaattagccaggcgtggtggcaggcacctatagtcccagctactcgggaggctgaggccagggaatggcatgaacctgggaggcagagcttgcagtgagccgagatagtgccactgcactccagcagcctgggcaacaaagcaagactctctctccaaaaaaaaaaaaaaaaaaaaagatgagttcctgtcctttgcagggacatggatgaagctgaagctggaaaccatcattctcagcaaactatcacaaggacagaaaaccatataccgcatgttcttactcataggtgtaaattgaacaatgaaaacacttggacgtagggcagggaatatcacacaccagggcctgttgcggggtgggggattgggggagggatagcatcaggagaaatacctaatgtaaatgacaagttattgggtgcagcmaaccaacatggcatatgtatasctatgtaacaaacctgcacgttgtgcacatgtaccctagaacttaaagtaaaatttaaaaaaaagcctcataatcctttttattttttatagtcagtagtaatgtccccatttttatttctgattttagtaatttgagtctcctctcttttttcttagtttatctagctaaaagtttgttgaaatgttttatcttctcaaagaactttttattttattgattttctctattgttttactattctctatttcatttatctgagcgccagtctttattatttccttctttctgctacctttgggtttaatttgtgtttctttttctagctccttaggtgtaattagattgtcaatttgacatttttcttgtttttcagtgtgaatatttagagttataaagttctcacttagtagtgccttcacagtatcccataagttttgctatgttatgtttttattttyattcatttctaagtatttttaaatttcccttatgactacttctttaatctattattaagagtgtgttgtttagtttccacaaattggtggcttctacagtttcacttctattatcaatttctaacttcacgtcctttgtggttggagaagatactttgyatgatctctatatttttaaatctgttgagacttaatttgtgacctaatatatagtctatactgaaaaatgtcccgtgtgcgcttgggaagaatgtaaatgctgtttttgttaggtagagtattctgtatatatctcttacatctagttggtttattatgttgtttaggtcctctatttcctcacttatcttccgtgtggttgttgtattcattactgagaacgggctattgaagtttccaactatcatttattgtcgaactatctatttcttcctttaattctgtcagtttttgcttcatatatttttatagtgtgtcattaggtacataaatgtttgtaattgttcgattcttgctgtattaaaccttgtattaatatataatgtcctgctttgtctcttgtacattttttaatttataatctattttgtctgttactaatatagcaactcctgctctcgtttggttactatttgcatggaatacctgtctccatcctttctctttcaaactatttatgtctttaaatctaaaatgagtctcttgtagacagcgtatggttggatcatgtgttttaattgattctgccaatctcagtattttgattgaagcattaatatatttatatttagagtaattactgataaagagggaattatttmtgtcattttaattatttgtttcctatatgccttttagcttttttgtcactcatttctggcattattgtctttctttgtggttagttgattgttcgtagtgaaatgtttacatttctttctcgtttccttatacacacacacacatatacatctatacacatgtatacacacatatacatatatacatacacacatatatatacacacacatatgaatacacacacatatatagctattttcttccccattggttacaatggggattacatttaatatcctaaggttataacattctaatttgaatttacacaggtttaactgcaataacttaaaaaaactctgctcttttacagccccattccctacccctttcagttgttgatggcataaaataccatctttatacattgtgtgttccaaaatgtagactaatgattctttgaaatgcatttgtctcttaaattatgtggagaacaaaaagtggagttacaagccattgttacaataatacgagcttttataattgcccatgtgtttacttttactgagaactttgtttattcatatggcagcaagttgctgtctagtgtctgtttatttcatcctataggactcccttgagtatttcctgcaggacaggtctattggtaacaaactacatcagcttttgtttatctagaaatgtctcatgttatcccytgttttgaaggatagttttgccagaaaaaagatttttggttgacactttttttcttttagaactttgaatctatctgccaactgccttctggcctctaaagtttctgatgagagatctgctgataattttattgaagatcccttgtatgtggccagttgcttctcttttgatgatttcaagactctctttgcctttgtcytttaaaatttgattatattgtgtcttgcgtggatttctttgagttcatcttacttggagttcgctgagttcttggatgtctatatacatgtctttcatcaaatttgggaagtgttaggccattatcttttaaaatattctgtctgctcctttctttctcttttatttttcttgaattcccacaatgtatatgttggtccacttgatggcttttcacatgtcctttaggctctcttcagtgttcttcaatttgttttctttctgttcctcaaacttaataattttcactctcctatcttcatgtttaccaattctttctcctgtcagtgcaaatctgcccttgaacctttctagtaagttttccatttcagttatattactttttagctccagaatttattttctgtttttgtccaaatttttwaaaatcttattattgaaatttacattttgttcatacatcattttcttcattctctacatcctttttttagagcatattcaagacagttgttctaaagtctttgcctagcatatttgccatcaggtctttttcagagacatttctgttgatttatttttttcgtttgaatgagctatactttcttgttcctttgtatgccttgtgatttttggttaaaaactggacatttgaatctaataatgtggtatctctgaaaagcagattctcccctttccccagaatttgctgggggttttttgttactgttttggtttcttgtcttttttgtattttttattttttagagatgtgatctttctgtgttgctcaggctggcctcaaactactgagttcaaatctcctcccagctcagcctccacagtagctgggattacaggtcactgcacttggctttggtttggggttttgttttgttgtttttgttgtaaggtatctctgtgctgagaataagcctgaaatataaacttaagatcttcacaggtcttttctgagcctttccttgggcatatgcagtgactttctaattctcccagtatatacagttgttttttaatgtcctagtgtttgatgtctggcttccaaatgttggaaagagaaaaataaaggaaagataagaatggtgccaaccctttacatcgcccaaatgttacttcatccagaggggaagtagcttgcaacaatggggggaggtgcaagaacaatgactgcctacctctttgtctgcacctttgtaatcagaagcagcaatcagtgataagagcacagatctctgatagttgaaggacatagtccttttttgcccaccctggctcccacaagctctgtataagctgctcctggaacacatgcacagctgcctgccttggggcttagtggtgggggaagaatatctgctactgtgctaagaactgaaattgactaaaattaacttcaatttacctacgaagctttcttctgaagttgcaagcctttaatagactctagagttccaaagtagttgcatcagacaaattctgccagtaaaatttttgtctaggaagggagacagattcctggtgctttctactttgccatcttctcagaattcgttcctcattttccttttatgtgattctcctttaagctaagcatattggaaaagaagaaagaaagctgccattattctcagatgacatagaaaccaaaaaatgcgtagaaaagtatttaagctaataatcatgtttagtgatattgctggaattaaagtttttatataaagattaattgcatttatagaaacaagtaataaatagaagatgcagtttaaaatggtaccatctataacagagacaaaatatataaaagatctgtaatttcttaagatgtgaaagactactatggagaaagttatgaaactttattaacagacactttcaaagatgtaaataacttgacaggcaacccattttcatggaaaaccttaaaatcatgaagattttcattttttccaatgttattccatgtaattccaatcaaaattccaatggggtttcttatgggatttttatgataaaactaaaatgaaagcgtaaaaggccaagaaaactaaggcattcctgaagatgataaacagtgtgtgtgagttggagggtgggataccattasctatgacaggtctgaggagtggtagaaatggcatttcaaattagcgtggaaaagatgggttattaaaattatgctggggcaagtagttacccacatggaaaaaatgaaattggatcaagtctatgcactacacacaaaagataaatttgataaattaagagctcaaatttaaaggtgacatttaaaattttagaagaaaatataaaggatatttacattctcagagtagggagaaatttttcaaataagattccaaaaaatcaaactataaagaacaagtggtgtgcatttgactttattaaaattaagaatttattttcattataaggcaccataaagagagtgaaaaaataacccataaagttggaaaagatatgttcaatgcacgtaactgaaaaataattacaatccagaatatrtaaagcatggctataaaaattaataaacttgtgggcagcacaatagaaaaatgggcaaaagatacaagcaggcatttcacagaaaaggaaacaaaaacagccaataaatgtcaaaaatgctcaaccacatcagtaatttgatagatataaactaaaactactcaccttaatgacacaaattttagtctgatgattaagttttggcaattttagtctgatgattcagttttggcaaagatgtggagtgataggaattctcatacgttgctgttggtagtgtaaattgatataactactttggaagaaactttctagctaaatagtaaattttaatatgcatgtgttatttcactgggcaattccattcctaggtgtaaacactggaaaaactgttgtaaatgagtaccaagagacatgtgtacaggaacgcttatatagcagcatgtagaagaaaaatactgaaaataaagcatatgttgttacacataaaaaggataagtaaatcacagcatatttgtataatggaataccatagagctatgaaaataagtgaacagctgctacttgtaccaagtggataaatctcaaaaacaatgctgagctaaaaatgcaagaaatagaagaatgcatatggtattatttcatttctataaagtcaagactaatgaatatgttgaaactaatataataaagtgattataataagtgaatataaaactaatgaatgtatcatttggggaaacagacatatgtgataatactataaatgaagtaagaaaatagttcaaaactcagaatagtggttactccaggggaatgaggagcatttaactggggagaagtatgtagggtaatagtcaaagttaatgttattttttaagttaggtgatggagaaaaggttttcatttttactttttttttttttttcttgagatggattctcgctgtcgtcacctgagctggagtgcaatggcactatctcagctcactgcaacctccgcctcccgggttccagcaattctcctgccttagcctcccaagtagctgagattacaggcacctgccaccacacccagctaatttttgtatttttagtagagayggggtttcaccatgttgacccagctggtctcaaactcctgacctcaggtgatccacccgccttggcctcccaaagtgctgggattacaggtgtgagccaccaggcttggccatatttttcttaaaatgtatacctaaactcatgtgtatggtagattttacaattaaagaaactaaaaataatacaaggttattgaaaacaataatgtaaaaggatacacatggtcacagtttaaaactattcattctatgactcataaacrcagtaattctttccaataaccaagtgctcagatgggatgcaagtttgctggggctcttaaggagctattaaaaagaaatgtttaatctgtaggtcatgtcatttatttagaactggggatgccaaattcaatagaaaatacctcactagctataaatggtagctacaccctatagtcctgaatacgataaacctggagctactggctttgctgtttgtttttgcaaatccttgactttgatttgacattctctttggctcaactgtattctcttgactaccttgggaaaatgcctcactcagtttaacttgggccaaaagcttgcgtacttaacacagggatctggatctggtgtttaatagctgattaattttctcatcagcaaaattggtgtgatagtaataatcctctttatagggtaaaagaaacaataaagtcaagccctctgatgatagtyattttttttagtcactcagctttactttttattcttttagaatttcattttgtgaccagtccttgtgaaaatgtaaatccaagtgccctgccctttccctaattgagggtctggtgtcatacaacaatatgctttttccccaggatttaattcttgtcattcatagatggaaaataaaattggagtttatttctcctaagccttcctcccacacccctccccatagaaagacttggtttctattgtattagaggcaggttctgtattctttttgattctgtgagtttcttcatgtctttcaaatatattgatttgtgcttcttagagttggttttgattgcttacaaaattaaagcctaagtgatataagcaccaaatacagtctctggcacatagtaggcacttgtagtgtttgttgatatgattattttcacaattgaaatgttccctgaacaacacacactagggcctgtcagtgggggtggcacgagggaaagcatcaggaaaaatagctaacgcatgctgggcttaatatttaggtgatgggttaatagggacagcaaaccaccatggcacatgtttacctatgtaacaaacctgcacaccttgcacatgcaccctggaactaaaataaaataaaaatttttcctggcagcacttctattagactttctctggttctgagagtagaacaaaacacttaacctaccaatcacaggaagaatggatacaatttagtttccaaatgtgataaatggataaacctgtctggactcacaagaactctgctaaggtgctgaaatcccataatgatcacccatattcccgccaactgcattcctggtattgtcacaagacagcatcatataagcaatacagaaaatatgtgctagagtacataaagtaaatcaaaagaaggagagagcattaagatagaaaagatctgagttggactttgaagaactgctaagattgggataggcagtgaggataaggagacactgcaggcaagacattacaggcaaggagtggagggataccttgagcaaagacatgcaaggcatgtttgagggcaaagaatagtcctttggccaaaagagaaatgtattatagaacaatggtagtgaattatgtttggaaggggtagattggagttaatttaaatacaaagttccagaaacggtcaagttgcaaatatttctatgaagagactcatttcaatatcatctatattatttctatccattagcaacgcagtttttaggggatgtaatttgaaactacagaacactagagagttcttggtgacctttagaggggacattttgagatccaaacattcttagataaaattatcatttagtcatgacttgaagccattccaaagaacatgtgtgagtagaatattgagagagtagcacctaaagarggaagatttcttaggcactgattgtacaaattacatatgaataattccatgaggaaaaaaaggtttaagaacagctaataacttccaaagtttctttttatttatttttccataaagacttgctttgatgccagacacaaaatgtccacaatagaaaatctgaccacagtatctaaacagttgcttatcagyccttggaactgccaaaaaagctattaaactgrtgttttccatggtgatggtctccaccaccctgttagragccatgacattgttctgtccttgttgggcagagaaggtggtgatgctggtggtgggagggtgtaggttgaaggtcttgggagggtgtttgtagaagagaaggtccgttgatttactgattaactacatacacatctgggtcaaattgttctctatttagaagcctttgtgataaccacagaatcagaacatataaaaagctctgcgggactggtgctgactgcaaccatgacaaagcttattctcctcacaggtgggtttgtaatcagagattgacccttcatcttatctagtttctttttctctcacaggctctgaaaatcatgaagtggtcttcatactacatccctatacttttccattcttctttcatcatttcaaatttcaaatgaatcttgttatatacaaatcagtctgcctcttgttctcttaacttcaactgactctggtaacatttctgcttttgttaatcccatggacctggtcctaaaggaaaagcatactttctcctagtgctagtcttactctttcatcttttgttcagccattcatttttctttactcttcttcctacgccatctcattttaattggaataatgtttatttatttgcttgtgtccttggactagcttttctggggaagaaaatcagtaggaactgagatagagttatgcaagttgtctttgttctgctgttttcagaattatttctctatttaytcccctattatcctactgagttgatgatgtaccataaacatgttagaaattaaattattcaaagaggttgattcagtaagttgtttagagacaagtcataccaagaatttattagttgctctagagctgggatttgcaaactgtttaagcttcagaaccttttccaaatgaaacctcaagctcaatttataaaacaatcagagtagaagaattgctttgtagaagtcagggaaaggtatctggagtctcacccmatagttcctagctcttctctcctcatataaggcctcctgaaagtcattccaaaaaaccactaaaggccagaagatactgaattctctgatttagcagatgccttatctgttggaaggctgtgttctatcactcaggtaggggaagaacgaatggatgtgtcatcattgagtacagtgatcagttggtgatttcagtaagtacatcttccatagatagtaaacttcggactcagcattcaggaacatttatttgtgacaaggaaggtgtgagacgaaggtaccacggtcatttttgataaaggtggggaaaggtagatctactgttgtattcactgaaaagcctttggaatcaccaccaaatctcactgaggytgtaacaatttatggyaaattggaaggcaatcaatccttcagaattagattctacggggtacagacaatcggttcaaagtacatgctttttctttctatccaggtcttgtccttatactgaatttgcagctcggtaagtcatggactccatgttttatcattgaatgtatatatacgagataaaccatactatggaaagagagccgctgtttgcttcacagacagatgggtttgatttgggagtaatctagtgttttggattggctgtcactgctatcctcttcagcatgaccatctgaattataaactggtactcactgggcttcataggactatgggcatcttttcttagaaggctgctagctaggcttatccaaaatcccaaaatgagtctgtgaaagttaaaaataaacaactccaagttagtgaccagttctgagttagaatcttaggatgcatttgcaagagtgttcatactaattacctccacacagagatcaggcatctgaggcacagggagggaaacagaggcarggccaaaactcacmgcacacttcagtggatcctaaaccaggccattgtccctcctgctgactacacacaggctctgcctaccagctgacatgctacttcaccaactgggcccagtacyggccaggcctggggcgcttcatgcctgacracatcracccctgcctctgtacccacctsatctacgcctttgctgggakgcagaacaacgagatcaccaccatcgaatggaatgatgtgactctctaccaagctttcaatggcctgaaaaataagtaggatgagggagatatttaatttggcatcccctttttcagtacttcccaaacattaatgcttcttaaaatgtagttcagatccatggatctgagatggggaccaagactctgcatttcatttttcttttataactgacaaaaattgtatgtgtttactatggacaatgtaatgttttgaaatatgtatacggtgcggaatggctcaatcgaactatcaacatatgcatttccacaaatacttaatgttttttgtggtgagaacacttaaaatgtactgtttgcaattttcaaaatacaatatattgttactaacaatagtaaccatgttgtacaatagacctctgcaacttattcctcatttctaactgaaattttgtatcctttgaccaacatgccccccaacccccatccccacaccacccccagcctctgctaacgaccattctactatatacttctatgagttcaacttcttttagattccacttataagtgagatcatgtggtatatgtctttctgtgcctggtttatctcacttaacataatatcctccaggtttatccatattgctgcaaatgacaggatttctgcctcttttttaagacttaatagtattcattgtatataaagaccacattttctttgtccattcatccattgaggggcacttagattgattccacatcttagctactgtgaatagtgctgcaatgaacatggaaattcagatatctcttcaacacactgatttcatttcctttggatgtaaacccagtagtgtaactgctggatcatatggtagttatttctttgattttttgaggaacatctatactattttccataatgggtatactaatgttcattcccaccaacagtgggcaagagttccttttttttccatgtcttttccaacacttacctttcatctttttgataacagccattctaagcggattgagtggtatctcatttgattttgatatgtatttctctgatgattagtgatgttgagcattttttatacacttgttgaccattggtatgtcttcttttgagaaatgtcttttsaagtccttggcccattttttaatcaggttatttggtttcttactactgagttgtataaatttcctatatatttttgatactaactaactccttacttgacatatggtttccaactattttctcccattccataggtagtctcttcactctgtttcctttgtcatgcaaaagctttttagcctgatgtaatcccatttgtctatttttgcttttgttgctgcactttccagtcatatccaaaaaattcttgctgtagctcttggagcttttttttaaggttttctttcagtagttttacaatttgaggtcataaatttagatctttaatccattctgagttgactttgttcagtttagtcatatttaagagaaggaaagctacaggtgattgctactatcagtaatggyattatcgtgaatacagctactagaatttaagttacaatgactaagagtaaataaactcctttacggcagtgtttcttgaagtgtgstccattgactacttgcctcaaaatcatgtgaggtacctgagtaagtgttagtccctactgcaatccaaccgaattggaatctcaggggaaggggcgataaacccagatttttmatgttgtcctcccacaacccttgcacttaattattatgtatgttaatgtttgggaatctctattcaagagaatgtgtataatttcaagccaattaatttattttaacattacagaggctaaaaatgtaattaagctcaagcaacatttaccattttatctgatagaatagaatattatattagctattcatgytttttaaacttacacaatcaaagatactgccaacacacaatattttttaaagcccagtttcaaaatttagatttccctagggaaccctgagtgcattcatgacaggaacaacacaaagaatttttataaaggaagttttcagtaggggaggaaaattgttctacaaaaggcaaaacaaaaatatctgaccagatccaayactaaagcaatgtattttaratggagggagtcmtgacttttgaagtttatctgtttctatcctttgytttacaggaacagccagctgaaaactctcctggccattggaggctggaacttcrggactgccccrtaagtcttctatggagagcatgttgttcgtttgctatggaaaacaagttagccccaygtgatcactgtccctttagacttcacaatctaagacagggtattgaggatgtacataaacaaatatatgaattaaatatattgctacaccagaacctcattattaagtggaacacaatttatttcatacatttaatttggtggacatttgggggccctatccacagaggtttacttactgaggttcccaaacaacctcttcttaaagtatttcaagagtacaaaccctgaggacagtgttataatgcttccctctatttatcttctggtggggggaggaatgagaaaatcacacaaataaacaagaggacttcttggagggtacatgtttggggagggaacacagtgtgctgggtttgccaggtatccaaagaaacaagggcaacttgggagaaagagcagagttggggggataacagaataaagggaatgttaagataccatggctgggaagagtagtgattacaaaggaaggagaggagaaaaccaagaacatgctttactctgggctgtgggtcctgatgaagggctctgaggcaggaattgagagcttgattttactccaaggtgttgggaccaccaaggtctcaccctgccttctttgggtctccctcagtttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctggtgcaggtggggaaggaagtcccagtctttagcccaaaaagattcaaagtctttctttccgaggagaattgggtggctctagggtaaaacaaaacttgaatttaaactgatagaatattagcattgcaaagagtcttatatatcgtgcgttcattaaacaaacatttaatggcaacaacaaagcaacatgtgagctctgtgccaggcactgctctacatgttgttttaagaaccataacccatttcatcttcatatttactctatggcatacatactataagtgttataatctttattttacagatgaggaaactaaagtacagagaggatttaagcaacttgcccaagatcacacaactagtaggaatcataacttcctctgcagtttggctacagagtccattgcttctaagcattacactaggctgcccgttattactgagtacgtattctgtggcagacattgtcaggctctgaagaacttcttctgaggtggaagactgaaakaatatgaacaatgtcaatgcattgtgataaatgccatgttagaggtctgcagagtacaaaagtaacaaggaaagagggtaactaattctgctctgggkcaggatcagaaagtgtttcctagagaaagtgatgcttgggctcagtcttgaaagaaactggtgttaaccaattaagtgaggatgggaatggcacaaatgatatacagataagtgtgagcaagtgggtgataatggctgtgaagttgcatgaagaaccagataatgtgagaacttttatattatgttcaggaatttgcactttacctttgacacaatgggactgttttgaagaattttaaatagtagagagctggcttttaccatagaggataaattagaaggagatgagaagtcatggatagaattaggaggttattgcagtaaatcaagcaagaaatgatcagggccccaacaaaggctctaacactgagggaagaagaggatgtatataagagatatcaagaggatagaatcaataggatttggagatcaactggaaataggaaatggagaggacctccaattttctgactttgaggatgggtttgattttaatgctattaactaagatggtaaatacaggaagaagtgtagatttgaaagaagaagaattgaccttgaacttgatgagtatgaggtatctgtagagcatcctaacrgagtgcccagtagscatcagataaatatcaatctggagttcaggacaaaaaagcttgatatacttggtttttagacttactgtctcccaagacagattgtttgctattccattctatgtaacagatcgtcacycagcctctgaatagtttcaatgttaagtaataggtgaaaagtcaatttacttacttgttgaattgccctaatgatcataaaggaatatctctttcttggctggaacatgcctctagtcataatttataacttctggtcattgtttctagttcttcctgctgaagcaacagagaataagactgcatcttttgcaatatatgggcttaatgtcttaagacagctgtaaataccttgcctataatttctcttattccagttaaatatcttaatgccttcaatcaataaccgcatgacaattttcagagccagccttcactggaacatactctggcgcaccctaatagtgcaattataagaactaaacccagtactccaaatgagattacagtcgcacagatacaggtggattaatctctagkattgaatgggaacctatcatctagctgttaccaccttccttattggccaatacaccattttatttgatgggatktcagtcctataaagtagttcatctactttatgaaacaaatttctatactgctggatgtagggtatcactgcaactagagcttcaaagtatagagatacaatggagccctgatggtcatctgggacctgggttttggtcatgacctacctactaactcagtgtgggactttggtgaagtgtcctaactcttatgcatattagatagccagaaaattcaataatattatctatccgatctactttatttggttgttgagagactaaagtaaaataaaatatgtgaaagcaatttaagagagagaagcattatacagacatatgtttattagtattatttaaggagctaaaatcagcatcatagatgtcctattatgccttattattctgtaggaaatgcgtgaagcttttgagcaggaggccaagcagatcaacaagcccaggctgatggtcactgctgcagtagctgctggcatctccaatatccagtctggctatgagatcccccaactgtcacagtgagtgatgtgccttatcttcaaactcctggaggtgtcactcgggcacactagacttgtccttggtctggcttgctattcagggaccttgtttaggagactttagaagtggtgtcctgtgcctgcataggtgtgggaaatgaccatcagaatgattttaaatcctccaccccacctcaggtacctggactacatccatgtcatgacctacgacctccatggctcctgggagggctacactggagagaacagccccctctacaaatacccgactgacaccggcagcaacgcctacctcaatgtggtgagtccctgtacagatgcaagagcagaccagagatgatgatgaaaatcacatagagattcaggcacaaaaggcatcataagtttagtggttttctcaaatgggaaattaggctgccataattaattaaatattctcatttaatttcacacagagactgggacacaaagtaaacataaattctgcaagtgtctcacttaaacaactgtcctcaagttgatcgtatttcattaactacaacttcaccaaaatgttttgaaaaaaatactaatccatctggaattaacagcatagagttttacctgtcggaataggggactaatataactaagtactgggtcctcagctggttgggccatgtaactaacccactgacattgcaggattatgtcatgaactactggaaggacaatggagcaccagctgagaagctcatcgttggattccctacctatggacacaacttcatcctgagcaacccctccaacactggaattggtgcccccacctctggtgytggtcctgckgggccctatgccaaggagtctgggatctgggcttactacgaggtatgtagattggactgaaaagtgctctgtgaattccgtgcactgtgccttagggctagaatctgctgaaatcttgaatgttcattctgtctcctacctaaatgctttaaacacagctgcttaaagtgtttaaatagcattcatttacataatccaaatgaatagcatttaacaatgcataatatcccttcacacaacagactacctyttaaatgtaatttatattagcacacaggtaataaaataaatatacctctcatattactgtgggttcccaaaatcatttgacaagcaacttgatcctctttactacaaataaaaacctgtaactagaaattgagcaaaaccccaactggagacatgaaagaagaaaaatttgaaacatgtttttctttaatgggagtaacatttaawagatttgaatctcttgacttttgaaagatctgtaccttcctgaaaaatggagccactcagggatgggatgcccctcaggaagtgccttatgcctatcagggcaatgtrtgggttggctatgacaacrtcaagagcttcgatattaaggtaagatcagtcccttaaatgtgctgaggtcccagccctgagtcccaggaaagcaagtgattcctgttatcctctttctttaaacaggctcaatggcttaagcacaacaaatytggaggcgccatggtctgggccattgatctggatgacttcactggcactttctgcaaccagggcaagyttcccctaatctccaccctgaagaaggccctyggcytgcagagtgcaagtaagtgactgagggggaatgcccaggtgtataaataycccttctccaactcaaaaagcaaccctgatgtcttcccacctcccccttgcccagggatcctctttccacttcacctcaccgctcttgcccagatgagagacaggttttacccttgaacggccatgtcaggaacattgtgcacttatgggaagccaggcctaactgggtgggtgttctaagtctgctaagtcttaagggtgtggaagagcctcaagaaattatactaacatcaatataagtatctgcttctctatgaatcccttattcaaaatctttctcagcccacctggggagatttaagaaaccctcaccaatgctcacatatctctaatcagtgattcaggggatgtatcaattctctaaattttttccrgatttttcctagaatttatttgttcaccatttatgcccagattctagaaaagtgttttgcatacatttggtggttagtaaatttttttttgaatgatttagatgttataaggaaagagcaacctttttttacaattaaaagccaggctggcttgacacaatagctttatttatctcctgaatatggagctactttctcttctcagttgcagggatccagagccaactgcaccccacctccacacttccactcccacagttctcttcacctctaggtgaagcttagagcctctcccaagcccactagtctgctcttactgctgtatgtttcaggttgcacggctccagctcagcccattgagccaataactgctgctcccagtggcagcgggaacgggagcgggagtagcagctctggaggcagctcrggaggcagtggattctgtgctgkcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaacatgactgtccttgcttttaagtgatttgggtggaaacctcttccagatatgaaaataggggctatgcatgggggtggagtggtggagtagagtgtgagaggaagtggtggagctaacagcgccacagtcttctatctgcctgtgttcatctgcatgaaggttggaagctgtaaggaggaaatgtctgaatgtttggtgcatgggagggatgaggatatgaagaggataggtctgtcaccaggcaattttcctcaggaaggagctgaagtgcttctgtaagactgggggacataagcagtgctgcctggcttgctcaaggagtggaagactgggacatcctctccacttctactgaagtggactggcagcttcgggaagatatgtgcagtagactccatttagggtttctgcctagcccatgggccagccaggctccctttctcaggagatgacacctaccattggaatcgtagtggtggccaccagctgctgtgcttgtatgcataccccctcccatggcttggctgatagactgggatagacatcaggctcaagagggccaataagattatcacacctcagaatttgcagctcggaacaaggaattgcctgtcatcactcgtgtgggtgggtctgcaatatgtaagctcaggagctgtagcgagggactagggggaaggaaaagttgtcctacatgcagagctgagctacagacaaaagccaggatgtgagatgagagagaacatttactgatagacggctttcttcttcttcttcttcttcttcttttttttttttttttattgagatgaagtctcgctctatcagcaggctgcagtgcagtggcatgatctcggctcactgcaacctcggcctcccgggttcaagtgattctcctgcctcagccttccaagtatctgggattacaggcacgtgccaccatgtccagctaatttttgtatttttagtagagacgaggtttcaccatgttggtcaggctggtctcaaactcctgacctcaagtgatccacccaccttggcctcccaaagtgctggggttataggcatgagacaccacgcctggccagataaatagctttctagctcttgattatagttccttcctgaggcccagatgcacttttgcctatggattttgtgaaatatccctataattacataataaattcctctttgctgcttaagctgactaaagtttgcttcttttacatgcaaatgaaagaaacctaaataatgtaatgagaatataagggctcatttctttttttctggcattcttactatgtgtcaaactgttctaagtgttttacatgtattttcctatttagttttcctagcaactttatgaggtggataacgttaactccaggaaactgaagtagagatgaattaattaacctgccccaaatcacacagctaggtagttgcagagccagatacatagccaggtggactggccccagagctcacagtcttatctactatgttttacttgcctcccttgacacacaccacattgttctcatgggagatgacaacactggtggcagtgatgaggtgcacaccactctctgggcaacatcattcattcataaactcacaccatttattgattattatgtgtcaggtgatattctaggtactgaagacatagtggtaaataagacatactctactctcatggggattatattttgctagtggaagtgttagatgataaataagcaaatgaacaaatgagaaaaataaaacagtgatagaaagtgaccaaaagaggagactactttatttggagcaatcccagaaggcttctctgaggaggtcctatacaagatggccttgacagtcaaaaagagttgtctgttttgggatctgggaaaagtgtgttttgggcagagggactaagtacaaagtccttgaggtggaaatgaacatggagtgttagatacaagaagcccagtatggccatgagatggtgggcacagggaagaaataggcaggggtcagatcattcaagggcttgaaacatggttagaagtttgtattttattgtaagtgggctgtgaagccattggaaagtgataatagggatggggttgatgacaggatctaaattcaacattgatgagatgaggctggaataggattaaagaatataggaaaatggcactcatggcgatggtagccaatggattgactgagcacctttgtgacatgccttgaagattgaagacagaagtgggggacttgtgtcttcaatgagcagaggaaggcaagagacagtaaaagtgggtatcactagtaatgtcgttatatttctagtcaaagaatgatgaaatctggagtaaaatagagcatagaaattttgggggtggcttttgaaaggagtttcctatttaggtcactactaaagtaaatagcactgaggggggacatggggatgtggggctctggagttaatgaaaaaatgacatgacatcagctgttggctttgaggaagagcatctttgaacaacttagtgtccagtggctaaatcaaagtggttttcaaaactagcacctttttcaatgccactattttcccacaaagatgaattctgccaccatttctagaacagggaaattattgcagccaaaacaagtagtgtcccctccatttttcttcctatttttacatattaattggtcattcaaatgcatgtttactgtgcacctactatgtgcaaaaagacggtgagcatgagctagctcccctgaccactctgacctcacctccaacaattctcactcactccattccaactatgtcatcttcttgctgtttctcaagtattccaggcatgtgttgcctcagggccttcatacaagctagaacacactttccatagatttccatttgactctttccctcactttcttcaggcttttcctggaagtcaccttctcagtgaggtctttcctggccactcaacctgattttgaaaccccctttctctgcctctgcctgctgtgcttcttttgccctttcttgacacttgtcactacctgacctaccattcatttaacgtatttaccttttttatcgtctacctccctcactagtattaacctccatgaggaaaggcatttctgttcactgcaacattctcactgcctagaacaaggcctggcatattataagagaataaatacttggtgaattaataaatgaatgtggtaaaggaagtgagataggaattaacaagctgacccctcacgtcaggtggtgtgtggtccatggcagacttctctcagcagacacaaagggttgggtaggcctgcagtttcatgcaggtcagtcctgggtgcctaccactcacaggaggatgaattctctcttcttgttacctgcctgcaatttcccatccccaggcatagaagataacatgttatgccccgactgtgctaagaggaataagaagatgataaaaagattaataacaatagagaagtagcagcaacccgtttgaatacaatgtaagagaccagaatatgccacctcaaaataagtattattttgatttgaaggcaactgaaaagagtcacatgcaagagaaattctctgccttcccactatagtctaaaaaacaggacataaatttataaaagtctcttgtccattctctaccaggaaggacaaatggtggtgagcctgtagatgacttgcatcccaatcattgctgtgcggtgtcctgaccatatttggtgtctcctgatgccttctgtactgatttattaaacatttagctgtacgggaaaagaaaaacaagctgaatatttcaagcatcaggcaatgtactttatataggttatctcctacttagtgagtattgtccccaggtttcagggtgaggaaatcaagaccttgtgaggataagcaacttgccaaggatcacagagctggtaattagtggacctcattctcaaaaattaggcctctctggctctctttaaaccacaatgctgccttgcacaaatcaatgtcacaatgacttgaagagggacttccagagtggggctgttgcttagcagccagtcttagttacacccttcattttcttggttaaagtccccatgtgagagtggcaactcatggaaataatacatgagagatccaggcttactggaagttcccctgaggacctgttcttgcccagaacgactgaggaatccagaaggtccatgctatcttctctacctgggagcttgagaggcaacaaaaccatatcatggatcagacagccatacatctggaactttggtaatggtaatcatgttcttggactctagtagatgtatgaaaactcatccttttagcattggagtctaactggaaagaagtagaatattcacaaggtctctgattacacaagttctctgattctggatggaggcagagagagtgttccactcaccaaattatttgtttcagcaagggccagctcccatcttaataaacctgcactgtttcttcatttgcacaaagataccattggagccagctgcagccctgggcatggaggtggtaaagtggaagtgccttaatatttgttaaataccaaatataggttagtccctcactgtatacgatttgtccttgtgttagctctgaaattcttatggcatccttaggaggaaagaaatgattcatgccattttatagataaaccaaggcttaggaagtttaagtaacttccacaaggtcacatagttagtcaatgacagactaatacttattgaaagccagtgctgagaaatttcaaagcctttattcattcctctaccatcagatggtagatgtaggttttaagaaagtctggaagatagtatgtagaaattatattttcctcctctctttctctcttctccagaatagagatctctattctcttggacagggattctcaatcctgctttgagtggtagattattttataacactctatttattatcctaaaattagaattaattcatggataacataacctactacatataatttcacaaacaacttggtataatgccctaactataaagtaaaggagaaaaaataatttctaacaaaataatatggatttcagtacataaatgtttagatgtaactactttagagacaaagaagtagtcagattcttgcaccatatgttgtataatgaattagtccagaattaagagatcagaagtcctttcatacaagcagtttaggaaaataaaagaatagagttataagtggacaccagaacaaaaaccagtattaggagaactaataacactccagatttaccaatttctgatagcagaaaaaggtaaatagctttagttgaaataggaataatacctagacaaattacaagccattgaaatgaaaagaggaagagagtgtaaacatgctgtttttttactgatgcattatattttacctatttatggggtacatgtgatattgttacttgcatagaatgtgtaatgaccaagtcagggtatttgaggtgtccagtactttgagtatttgtcacttctatatattaggaacaattcaagtcctctcttccagttactttgaaatatacaatttgctatcaataaccatagtcactctgctgttgaatgacagaacttacaccttgtatctaagtgtatgtttgtacccgttaacctatctctcttcatcccccaccacccactcactctttccagcctctagtatctaccattctactctctattctctacctttatgagatcgacttttttagctcctacatataagtgacattgtctttctgtgtctgggttatttcacttaacataatgacctcgggttctatccatgttgctacaagtgacgtgatttcactctttttttataaccaaatagtatttcattgggtatatatactacattttctctatccattcatctgtttgttttata

SEQ ID NO: 17997 - DNA, 13194 bp, Homo sapiens
aaagtgctgggattacaggcgtgagtcaccacgcccagcctataaacacatttttaaatagaacagtgtcaaatatttcatgggcactttgaacaaaagtataccaacagtacttttaaagatattggacaaagatttgtaatactatcccatcaattacacttctccagtgaaaggaaataataggaaaaaaggtacttttggttcttaatataatcacaacgaaaaggtgagcaccaaaatcaaatgacataaagggtgaaagtagagggagagggctttaaaccttgaatttacccattacgattctctgattaaaataaaaatcaggacttccacaatttctaagttgtagaataacattaattagttgcctctgaattaatcatagactggaggtaagagcccaagacgctgatatttggagttttttgttttgttttgttttcttaaatagacagggcccctctctgtcccccaggctatagtgcagtggcacaatcataactcactgtagcctcaacctcctgggctcagcaatcctcccacgtcagcctcccatctaactgaaactacaggtgtgccaccacaactaaatttttatgttttttagagacaaggtctcactatactgcccaggctggtctcaaactccaggtctcaagcaatcctcctgcctcagcctcccaaagcactgggattacaggtgtaactgctaccatgcctggcctaaataacatgatttttatctgcaatctcatttacggcctcggacttttcttgatctcatcacctagcgaaaaagggcaggaactactaagttatttgcccagaaagataaataatcaagaagacaatataacactaaagtctgacattgaaaatctactgatgaaaaacgcttcattttggttacagaattgtaagagtacaaaaaagctaaagaatttaatgattaggtttattctacaaatgagaaagtttaagtatagaaatgcctcatttatctggcacaatcgaaaaatgagaaaaaattctttaagcatttaatttttcatgttactattttcagtagaaatcactcgtgtagaaataatctcaaacagtttaacactgtcttaagtgagaatcatcttgagtacttactaatgtacagttataaaacaatgacattttgcctctctccaacacccccagaagattttcattttttaagcttttttatgacttctatagttgttctgttctttcaacactactagtagatgtaactttctattgggttaagtgtgccactgatgccccccaacatgcattttcaatttgatgcagcaagagaaatttgttagaattgtgaataaagcaaatagattctgaggaagaagggccttgggaggattttcctacagatgactctgtcacattatttttggctaagatcatctttactgtttccttttagacttttcctgttttcttataaaacacagcaaagttactattaatttcttacttggaaaatcagaaaattacagaagtcgttaaaacttttgaaaactctaacagtttagaggtactgagtcaaaatttcacccctttcagaagccagatatttcataattcactattaaacatacatgtaaagataggtccaaacattacttcatttctcaaagaccattacccttcatatgaattcaacctcctctggatttataaccttttctgaaatatttgcttacacttcaaaatgagtatctttgtgtagaaaaaaaaaaatggaagaaaagggttctgttaaggtccaacttaccataaatatgtccagtgtaaatatgagaggtatcataatcaagtactttatttgatgtttctactttaaattcatcactgaaaagggaagtgtccctcttcattcgtaggttgaaatgtctgtaaaatgggatgggaagggggaacaactgaaattaaaaagatccaaattttaaacaattattttttattttaaaaagtctacaaaatgtggactgttatgaaatttgtctatttgtgaaatacgctgaccaagatttttaaagacatattctgctctaaaagtcaacttagtagctgtggtaggactctaaatgagataaaattaaacagtaactgtctaggatgttaaaaataaatgcctatagactgattcttacatggtaaaacaagatattcaaacagcaaataagttacttggagattaaaacaggcttcctgacccaattactattatctaccactgcctgtcttctctctctagtaattctgctattttgctattctcccttactttctacaagttaaataagaaaatacagaagaaagcagcatctatatggggtatttaacatctcttctcagaaagacaagtgtgtatgctctttgttttaccctggggcttctaattcttgcaaattatagaaatcttccttaattcaatttgggaatgccgaaagaccaggataatggctgaaatcagaggaattttagtcctctacacaaaaaagggaaagatcaaaatactaaagtaaaattaattaaagatatgacaaaaatctagagtttagaatcgaattggaatcaaatcttaagcctagaatttactagctcaggttcctgtctgtgaaataaaggtaatataaattctatacaccttgtaaaattactttaaatattagagattttataacgtatataaagtcataacagtacctggcacattggagatatatgataaaatggcaacaaattagctaacattactcaactctgttaaaagtatatcaagtcttttataattgtgaacataatagaatttctacttaatttttttgacaattacaacaaagtattacgtctttttttttacatatacatgttttgcagagtactataagaaccttgttttttaaattacttaataaaaatttgtaacataaagttgtatggggaaacatacagtcacttcacacatttgtgacatgaataagttggtacaatctctatggtgggaaaactggtttaaaaaatccaaattacaaatgtacatagcctttgatacaagaattccatttctagaaatgtatcttacatatacttgcatgtaagtgaaattacttccatactacaaagaatgtggcataataagaaatataaagttaagccaggtgcagtggctcatgcctgtaatcccagaactttgggaggctgaggcaggtggatcatctgaggtcaggagttcaagaccagcctggccaacacagcaaaaccgtctctactaaaaatacaaaaactagccaggcatggtggcttgcacctctagtcccagctactggggaggctgaggtaagagaactgcttgaatctgggaggtggaggctacagtgagccaagatcatgccactgcactccagcctgggtgacaaagtgaggctccatctcaaaaaaaaaaaaaaaaaaaaaaaagagaaggaaatataaagtcatccctcagtatccacgggggattggttacaggacccccaaggataccaaaatctaaaaatgctcaagtcccttatacaaaatggtacagtatttgtatataacaaatgtatttgtagagtatttgtatatatacatcctcctgtacactttaaatcatctcaaaattacttataatacctcacacagtataaattctatgtaaatagttcttatactgtattgtttagggaataatgacaaggaagaaagtgtacatgttcagtacagatgcaaccatgcgaattattttcaatccaaggctgactgaatccacagatatagagggccaaatctatttgacctttgtccccagttcctggcacagtgctcctaaaacccttggaatatcctcagtgataggtgtctcttcactcattcataatgagtctgtttcactcacatctgagtttatgctaatgaggtgacttagagtggggcccctagatgaccttggaatagagctggtcaccagaaagatcaaataataagagcaatggaatttcagccctagccactgactccaccccagaaagtgaggtgggagagacaggagattaagctctatagaaactcttgaacaatgagatctgatcagcttccagggttgaacacactgagttgattggagggtagtgaacccagagagcgcacagaaactctgtgctgcctcccacattcctacgcatctcttccacttaggtgatcatgagttgtatcctttataataaaccagcaagagtaagtaaactgttttcctgagttctgtcagccaggttaacaaattatctaaccttaggaggaggttgagggaacccccaatttatagcaggtggtccgaagtacaggtggcgcaggacttacaaatggtgtctgaagtggaaagcagtgttgtaggaatgggcccttaagctgtggggtctgcactagctccagatatttactgtgagaactgaattacgctgaattgttgaacacccacttggtgtctggagaatcaagagaattggttgctggtgttggaaaatagcccagaaagattattcaccttagcactatttgaaatagtacatgattagtaacaacagaactagttaatttgcttatggtacataatcgtatttatgggtatacccatataactgtatactacaaagctgaaaaaaatatataaaatatttacatgtaatcaaatcatagacctctaagttatattaagtaaaaaaaaaaaaaaaaaaagaccaagtgcagtggctcacgcctgtaatcccagcatttggggaggccgacgcaggcagatcatgaggtcaggagatcgagaccatcctggctaacacagtgaaaccccatctctactaaaaatacaaaaaattagccgggcgtggtgacgggtgcctgtagtcccagctacttgggaggctaaggcaggagaatggcgtgaacccgggggaggcagagcttgcagtgagccgagatcacgccactgcactgcagcctaggtgacagaacaacactccatctccaataaataaataaataaataaataagatacaaaaaagaatatagtacgttacctttttttaaaaacaagaatatgaaggagaatatatatatatatatatatatatatatatatatatatgtatatatacatatctccacatttctgtgtagagaatttctgagtaagatacacattataagaatgtgcatcaaatttcttgacagatacacaataaactagtaacaatggttgtccccaagaatggaaagtgggtgactgggaaataagggagggaaggatacctcattgtatatcttttgtggcatttaaattttaaaacatacgagcatatttcttattcaaaaaataaaatgtaagttaaaataacatcttaagacacaaaacaaaaactactgctctttggacagatgaatcaattttgactttcaaattactaacttagaaataaacaaaaagttttgttgccacaatggtggagaaaccattactggacttgcctacccacctcaaaaatacagtttttcagttacataaatgaaacaactgctttcagacaatagacaacaagcagtgaaggactatgatttaagaaaaaaggaaggtgcaacaatgagaaagaactccagaaatctgcacaggcgttcacctgtagtctgtggctcaatactatcgtggatgcataaagagagactccacaaaggtgggcccaaaaacaactattaaggagctgttagttgaccaattactggatcttacaagagacagggatacatcgaagttgtgatcaagcacagaagacagactttgttgtcatttaatagagaacccagaaaagccactccttggaaataggaacaaactattcctagaataaaggctacttcaaacctatcctaataaagcttaaaaacaaggctgggccctcggagcccagcrccgccaccaygtcctctggggctagcgcgagcgccctgcagtgcctggtggagcagctcaagttggaggctggcgtggagaggatcaatgtctctcaggcagccgcagagcttcaacagtactgtatgcagaatgcctgcaaggatgccctgctggtgggtgttctagctggaagtaaccccttctgggaacccagatcctgtgctttactctgaagactctaagagagaagtttgctgaggaatgccttcaagcacaaagtgatgaatgactgccttcaagtctcaagaaaacacttttccctaacttttagagatatttcagccctttcctgtggccccgtcctatagccaaaatcacagaaattcatgagtttctacttgagtgaggaaactgggtgaaggaatagagttttaaatagtaatagcttgtttttttgtgcaagtacttttatacataagataaacaaaaaccttaccaccaaacataccaaaatgcacctctttcataagtgagttactaagatttctatacctggaatatcatgtatgtttcatttactggatgtttacattttaggaaggaaaatagttttgtttatttaaacaatcgaatacttgtaaactgttgttcctggaagatatttataccataaaaaatttgttcttttctcatgaatttacaattcctaaatgaagaccagaaagtacaaattgctgggaggaagaataggctttactaatcaactgatgtcttgatttttctaaatgggaagattgttttatttttaacactaattatgggagcagattcttagcaaacttgtttggaaaagttaatgttatgatgtgcattaggctgccccatcgtgtatataaatgaagcagatttggtctttgtattcttacgttcctctactttgtagctgtggctgtacttaaagaaatacagaatttcatatatttaaaaatgtttaaaatgtgacccacagaacattgtaaatgattaaaaactaacataaaaacattacaacctaaaagaattcttaacttcacaagggttttactttgatgatgtgaatctgatttaatttgggacacttttttagaaggatacattatttgtgtttgtaacagtctttgaagagcttggaaataaaatttctgcttaattaatcataaaaaaaaaaaaggctcaaaagggtcaagctgatccacaagttactcaactatctaacaaacaaaactccatactttttaaaaaaaaaatacgaacagttaaactgtggtatatccatacaataggatagaatttagtaataaaaaggaacaaactattgataaacacaacaatttgtacaaacttcaaaaaaattatgctgagtggaaaagtcaatctcaaagatactacttgcataatacgattcatgcgacaatcatgaaataatctaattatggagatggagaaccaattaatggttgtttaggattatagatgggggaggggatgaatgtggccataaagggatagcacaagggagtctggtgatgctaccattgagtatctttgattgtagggataattacacaagactacccatgtgacaaaattgcacagaattatgcacaggcacacacacatgcacgtacatgtaaaactgatgaaacccaaataaactctatgcattgtaccaatatcaatcttggttttgatgttgtaatatagttatataaattgtgaacactgagggagactgggggaaagatgtccaggacttcccagtagaagctcctgtgactctacaattatttttaaattaaaagttttttaaaaatccagacacaggtgggcacagtggctcacacctgtagtcccagtattttgggagggcaaggtgggaagattgcttgagcccaggagttttcaatcagcctgggcaatgtagcaagactccatctctaattttaaaaaaaacaaacaacgacaaaaagacactaaatattaatcaaaatgtgaaatatccaattaaaaaccacaaactattaaaaaaaacaaggggtaaaaaaaccaaaccactaactataaagaaatgtgacaaagaagaagaaaattagtcccccccaaaaaaagtgagaatgaatgataacggaattagcagacaaggatttagtgatttagtgtctatatattgtaaatatgttaaagaattatggggaaaatataagcacaataaggagaaaccaaaaactgtcgaaagaggggagggaaggggagggacagggaagagaggagagagggaaaggaatgagaggggaggaaacttccagaattggaaaatataatttctaaaatgaaaaaaaaaattatatatatatatatatatatctctctctctcactggactgacttaagagcagatgagatactgcaagaaagaatatcagcgaacttgaagacagggtaacaaaaactatctaacttgatgtacagagagataaagagtttaaaaaaaaaaaacccagagcctcagtaacctatcaaacagtaaataaataaagaagcgagaggagacagaaaaaaaaatttgataaaatgataaaaaacttccaaactgataaaactataaacacaagtctaagtaactcaacaaacaccaagaaagatacacacaaagaaaaacccacaaaacacaccacagtcactgctgaaaatcagcgttaaagagaaaatcttaaaatccatcaaagagactgattatatgcagagtgactgctgatttaacattagaaataatgcaagcaggccgggcgtggtggctcacgcctgtaatcctagcactttgggaggccaaggtgggcagattgccttagcttaggagttcgagaccagcctgggcaacatggtgaaagcctgtctctactaaaatacaaaaaattagccgggcatggtggtgtgcatctgtagtcccagctactcagtaggatgaggcaggagaattgcttgaacccaggaggcagaggttgcagtgagctgagatcatgccactgcactccaacgtgggccacagagcaagactctgtctccacaaaaataataataataataatgcaagctagaaattattggagtaacttttttaatgctgaaagaaaaacaatgtcaatccaaattctacagccaataaaaaagatcattaaaaaatacattgtcaatgaagaataaaaaagaaaacatcattccagtactgcagacattgagtgataaagtaatattatgagcataatgaaaataaattcaattacttagataaaataaactccttaaaaggtacaaattatgaaaactatcacaaaatatagaaaatctgaataagcccctatctactgaagaaaatgaattcatgatttaaggcctttccacaagaaaaataccagggccagatggttcccctgatgtcctataaaactattttaagaaaacaggagggaagagtactcaactcattttatgtggctcactctgattccaaaaccaaagacagaccccccccaaaaaaaaaaaaaaaagactgatattccttatgaacataaacaaaaaaatccaaccaaaaactagaaaactgaacaaagcaataaataaaaaggacaatacatcataagcaaatgaagtaataagaggctggcttaacattctaaaatcatcaatgtaattcaccgcattcaaaggggagaaaagccacaaaatcatctcattaggtacagaaaaagcatctaacaaatttcagcacctactcatgataaaattctcagcaaactaggaagagacaggaacttccttaacccgataaaatgcaactacaaactccagttaacatcatacttaaagatgaaagactgaatgcttctctcctaagattgggaagaaggtaaagatattcacacttgccacttttatgcaactctgtaacattaagtatgatgttacagataccacaacaagccaagaaaaataatcctcttttagttgctaatccccagaaatggtaatcttttgtgttgttttactgtataaaaacagcatattctttattttacatactttcagaacaaaataaacaacaacaaaaaaacaggatatacaacatccaattctgctgtcaaagtagagagggaatggggcttgatgcccttgtttcctgccttagacacaaggacagaagagaaaaaatactagatatcagcagagagagccaggtgggacaggaccactcaaagctgcagtgggagccatggggacactatgcaagggcacaaggtttgcaggtataaactcttaatctacttcttccatgtgaaacacatcctcaggaacacatcacatcaggaacagcagcactgagttcctctgttgccacttcatcttcatcaatagctaacctagcttgatcatgtggtagatgcagctggataggtctgaggatcctcaagggagaagccagaagagagcagtgtggtttcaaacagcagcaccaccgggtcactgacagcctcgttgttcttgtctgcctcagccttctgctgtagtgtctccacaatggggtggttggggttgatctccaggtgctttttagccatcatataacccatcatagagttgtcccaaaatgcctgcgctttcatgatccacttcatattggctatctagctgtaggtgctggtcacaatgcggcagggtgaagacacaagcctactggagattgtcacccgctcaaccttcttatctaagatttctttcatgagcctgcagaggttctcaaactttacgttgctctcctccattatcttcttctcctcctcatcctcaggtagctccagaccctccttggtaactgacagcaggctcttcccatcaaattccttgagctgctgcacacagtactcatcaatgggctcactcatatatattacctcgaagcccttcttccactcttgctccacaaaagcagagttggctacctgctctttgcactcaccaatgatgtcacagatggacttctgtgcctccttcatgcaagacacatactctgacagagatgtcatctcatctccagactggaaggtgtgagaccacagcagttcagacaggtgtcgccagttaatagagtcctcatggattccaagccacgagattttagagaatacctcatctaatttcttgttattctccttgtcttctgccagcccagagaagctaagctcaagccacttcttcttctttttttttttttttttttttttttgagacagagccttcttctgtcgcccaggcttagtgcagtggcatgatcttggctcactgcaacttccgcctcccaggttcaagcaattctcctgcctcagcctcccaagtagctgggattacaggcgttgtgcccagctaatttttgtatttttagtagagacgggctttcaccatgttgaccaggctggtcttgaactcctgacctcaggtgatctgcccgcctcagcctcccaaagtgctaggattacaggcgtgagccaccatgcccagccggcatttcttaacaatgtttttgcaaatgacttccaagattttgctctgctggagcatttcccgggagatgtttggggaaagatccttaagagtcaaccataccacggacaaagccgacatactctggcatcaaatcatcaaagctgtccatgatccacacatgatggacacagagttgttcattttcctcttgttctaaaaaaggtcaaagggagcctgatgagggatgaacagcaatgccctgaattccaaatgaccttctacagggaattgcttgactgccaagtggtcttcccaggcactggtgaggctcttgtagaattctccacactcttcctgggtgatgtcatcagggtttctggtccaaatcggcttggtctggtttagttcttcccgatcagtgtatttctccttgatcttctttgttttcttcttattattcttatcagtgtcatcctcctcatcggaacccacatcttcagtcttgggcttttctttatcatctttatcttcctcttctttctcacctttctcttcctcatcatcactgatttccttctctggttccttctccaaataaacggcgataagacagcctatgaactgagggtgcttcttcactacttctttgacccacctctcttctaagtactctgtctgatcttctttaaggtgaaggatcactttggtatccctgtcaatgggctcaccatggtcaacatgtaaagtgaaggaactcccagcagaagatacccaggaatactgttcttcgtcattgtgctttgtgatggctactttctctgccaccaggtaggcagaataaaagccaacaccaaattgcccaatcatggagatttctgcacaagactgaaaagcctccataaatgcttcagtaccagacttggcaatggctcccaaattatttatgagatcagccttggtcatgccaatgcctgtgttgaccaaagtcaggatgcattcccgaggggtggggatgatgtcaattttcagttctttaccaccgtccaacttggaagggtctgtcaggctctcatagcgaatcttgtctaaggcatcagaagcattagagatcaactcctgaaggaaaatctccttgttggaatagaaggtattgattatgagagacatgagttgggcaatttctgcctaaaaggcaaaagtcgccacctccccttctccatggtacacctctgcaggcatcttgaaaggaaaaggcttacaagtactagagagcaaggtgggctgagtgtccaaaatgcacacggcaccaaggctgcacaggggtgactcaagagctaattctttatactaaaatttcattcttcaatttactgtatggattctgcctcgtaaatggaccttgcttagcacatgtaccataaagctacagtaaccaaacagtggcataaaaatatagacagatcaatgaaatgaaagacctaagaatatataaataggtctcaacatatatagatcatggcaattcaaagaattgataggtttttcaaaaagtgatgctaaaaaatttatatccatgtgaaaaatattacccttgacccttacctctatcataaagaaa

SEQ ID NO: 17998 - DNA, 13279 bp, Homo sapiens
gtgctcccgggtaaaggtatgaatggcatccacaaaactggcatcatctggagaaagacgattgctgggggcacttccctcaaacaaaggtcccgcggcatccagccctaatgggaaagcaggggtaagggttacgcgggagcaaggagaggggaagagagatgtgctttttagcttttggatattattatacatcagtgaactagcaggaagaagaaacacgtagggctgatccttccctagaaaacctcgccgtaaccttttctcagtaaaaccacagtagttcatggtgctaacaatgacacacaggctgggcattagctagcggggaaagaggtttgcggaaactctccagtggtagacacaaggttatgatgcctgaggccaggaggcctgggcagcatagtgaaaccccatctctaaaataaaaaagaatacaaaaattatgtggatgtggtggcctgtgcctgtagtttcagccactcaggaggctgtggcaggagggttgcttgagcccaggagtttgaggtagcagcgaatcatgactgcaccactgtgacccagtctaggcaacagagggagatcctgtctcaaaaagaaaaaaaaaaaggaataaggttatgagggaatgcttgatttacttgagcaaatcagttttgagtacctctcaagctactttcaagaccatctgtttgcatacaaaaaaagccaatatgctcattataagtagttccaacctacctatcaaagaatgaaatttatttgcctgtatgttgtcaataatttccctaaacaagctgatttttctcctaagatgtcatttcattagaacgtccagaacagccgcgggacatttcactgtatgtgaaaatgttgtgtgcaagtaggggagctcaaagctctgggcctcaagtgacagatgtctgtgcatgaagtaaggtggcacctcctggctgactgtggttggggagtatttatgcgctccaagttttttttccctgtctttcttcctctgccttctctggaggaccctctggtgtcccaccccagccctggtttccttccctacttggggggcgaaggaattgagagtgagccgtgagatcacccgttctccagccctacccacagtgacaaatgaaaaatgtccttggccgggtgcggtggctcacgcctggtaatcccagcactttgggaggctgagtctggcagatcacctgaggtcaggagttcgagaccaacctgggcaacatgacaaaaccccgtttctactaaaaatacaaaaattagccgggcgtggtggtggacacctgtagtcccagctacttgggaagctgaggcaggagaatcacttgaaccagggaggtggaggctgcagtgagccaagatcatgccactgccctgtagcctgggcaacagaatgagactctgtctcaaaaaaaaaaaaaaaaaaaagaaagagaaaaagaaaaatgtcctgatatgatttctgttcctttctttatcaggctgatgacaagacggcaagagggtgttgagctttcctgctgtctctgaggtgggtgggcccagctgatacgcctaatgtgacccacagcaccagttggatggagagggttctgggccttgggcctgaggctgcctcgctgggtgtggactctgacctctggccctgcttcttcagtgggagggctgctcatccccaggctattgtgggttaaatccatgggggccacacgccggtctgtgaccaggcttccccagtgaccagcaagatgaacaaaaaagcatgaggaaatgagctgtcataatcacaagtgtattctgttgaaacgtctgccattatccccattctttctcaagttaaaagaaattcttttataaaggaatggtaatagcagatagtagttgtttgtaaaaatgtcctcatggccggccgtggtggctcacgtctgtaatcccagcactttgggaggccgagatggtggatcacctgaggttgggagttcgagaccagcctgaccaatatggtgaaaccccgtatctactaaaaatacaaaaaaattagctgggtgtggcttagctactcgggaggctaaggcaggagaatcgcttgaacccgggaggcagaggttgcggtgagttaacatcatgccattgcacaccagcctgggcaacaagagcgaaactccgtctcaaaagaaaaaaaaatgtcctcacttgataaaatataaattcgcaacaactttgttattcatgtaaaatgctctttgttttggcctgtgaaatattgtttgagcctgctgggtcttgaaggatgaggaggagtttgagtggctgagtggtgggcaaagcaaacagtgcatgcaaaggcccagaggcacaagaggccatggtgtgtttgtgaagtagagaaaaaccttgtgtcgttgaagcctagagctatgggaagggatcagcaggaggagaggctggggcactctggggcttccacaccgagaaaggccttgcctgtgcctcccgggttttatacctgtggtatcagtgggcctcagacttggactggggaacaatctcaccagctgtgtgtttttggatccaatgcctggcagtgtgaagggtggggttggtgtcacggaagcctgggaggaaggccttcctcgcacatgtgcagaccttcctggatatcttgggccatttctgagtgtgtatggagtttggggtgaagttttggatgcagagctccctccctcaacccaaatgggtcccagactaaaacatacacgtttcacaaatgtggaaacggaggcactaacgtggctgatgaattacagcaaattaaggctgtgattcttcactccttaactcgcccaaattggactttgtaaattatagattaaaaaataagactctttcttgctagaaaagtccatcttttagtcccatttggcacaccaacatgaggtattcgtttgagggcaggcaataggaattgaggctataatttgctctgaattctctggaacagcaatccatgacattggtcatgtttgaaagaatgtcacaagtcctctcatgagcgctgatccctcacaataagtgttggggtgttttaatgatgagcctgttggaaaagcaggtccttgttggatgcccctatggagtggagatcagtgtgtgagttattaggcatggttacctgtgattctcccaatcttgtgcgttccaccgatggaactgccggcaaatcctgacacgtgtgcacccaggctgtacccaattaggtgaacatggcttcgagagagttgcacagattcctggaagacagcagcgggatgggggcaggagaagagctgcctggatgaaagccttttgcggtccagtgtgttgtggcgcccaccctgttcttcgtgcctgctcagaaatgaggtgccttattcacactccaaactgaaactaatctctcaactggctgactctcctgggactcaggtacctgtgacctcgcctggtagctgcagcctcctgcctgcctgtcttcccctggacactaatgccctacagaagtgatcccactcatttgtgtgggggcttgatagcttacagggtgtgtttgtatcccttagcatgtctaagggggtgagcataagaggaatagtggatgaggagaggggagaaggtggttctgtgaaacaggggttcaagggaggcgtctgagagagccctggggtctggtgtcagtcctgtgccttctcattcctgtgagctgagcattagtgcttctcctgcctgggctgctgttggagaccagcttaattcattcactctcagaggaagggaaaggagggaagggaggtgaaggaaggatggggcaggtcggtacctccagccaccggagaagagccgcgacctccttgcccacaaggcgggtgttgcggacggcgatggtgtagtggtcgtgggccagggtgatccagtccaccagccccacgttcactggctgggccggctgagacttcagcgcggccaccatctgccagatccagttttctagcacgccgtccacctgaggaggggacagagggagggtcgcactagtttcctttctccccgctcacccttcttccttctccagctcctggataatgctggaggaagggcttgctatgacgtttctcagccatgcacagttgacattttgggccagagaattccttgttgtgggggctgtcttgggcattgtacgatgtttagcagcattcctggccttcaccaactagatgccagcaacacccacccactgccccaggttttgaaaaccaaaaatgtctccagatttttccaaacgttcccccccgccccctcccgagaacaattatcttaatgtttttcctcttagggactttctaaaccttaaaacagtggagaaatatgtgtaaatcaggtcctggaagctgacctgtcccttagggccatttgtacgcctccttctgcgtgcagctgccccacctcacccctaaacccatagcactggctctgccctgcagactgcgttatgctggacttagcgggatgggcactgtgagcctgacatagtaggaggtaaaaaatgtttacagagaattgttctgtgtgtgtgccttgtttgagaaccaatttgcagggcactcctaatggatttacagagcaaagacacttgtgctgggccttaaaggatcaataggagtccagtaagacgaatatgggtgggggctgggcgcggtggctcatgcttgtactcctagcactttgggaggccaaggcagggggattgcttgagcctaggagtttaagaccagcctggggaacatggtgaaaccccatctccacaaaaaatacaaaagttagccaggtgtgatggtgcatgcctctagccccagctactccagagtctgaggtgggaggatggcttgagcctaggaggtcgagtctgcagtgagctgagatcacactgccctccagcctgggcgatagagtgagaccctatcgcaacaaaacaaaacaaagaaacaaaaagaatacaggtgggcaggtgaatgtggtagtggtgaggtctagggcatcccaggcagaaggaacagtgcgtgcagagtcacagaatcatgaaagggcagtgtggtatgtcaggggagaggaggaaagttggtgaggtgaaggctagacaataggaggtgaaggcttgacaatagcgggtgaagctggagagctcccctgagggcctgtcatgccattccagggtaagatgcattcctttactagatatttaccaagtgccttctatgtgcatggagcatcttgggttcaaatctaggctctcctagtttctagctgagtaaccttgggcaagttatttttctctgtgcttcagttttctcacctggaaaatggggttaataatgctctccttccaggattgttatgaaggagaaatacgttaatagatctaaagcgcttagagcagtgtctggaacatagtaaggactcaacaaatgttcgttactgcagttgttgttgttattaatattagcagtaataggaggaggagacatatactaggttggacagaattttgataatgaagagtgcattttggtaaaagcatcctggtaagaggctcctgtggtcctcatgttgcatttataaacaagactcattcatttgatctttaattcagttaacaaacattttggagcactgattacataatggatagtggcccacagtagtctattagatgagaataggacagaatccttcccagggagaagcttacggcctagcagagcagagaaacacagacaattagaaagccgagctgcagagcagtggtggagagtgctcagggccacacgggaactcccggtgacactgaatgccctgtgggagtgctgggatgaaggcagcaatggcttgcaggaggacctgtttgggactgtgtcttacaggaaaagtgggagttaatcaggaaaagaggaggagaaagaacactctaggcagagggcacagactaagccaagaccaagaagagagaaggcaggtgcatggggtgtggaggaagctattaatacaagcagttagatgttgctggaacgtcatgtgggaggcagggagaggtgaggggaggcaggtgatggaagggttcattttcctctccaggataggatagatgggggtttcaagagtacttttcaactagatggcagggaaaggtttctaagtcatgaagtagacaccaaaatctctggagggttcaaattgtgaactatgcttgaaatcatgggtgggctagacactggggaggcaggatttcctcytggagacaagttctcacatggtttgacttcatctattgccaataatatcctttctctccttcttccatagtaatagaatttttagcatcactaaaaggctacattttctttaacagcctatacttctcagccacctttccacttagatatggtcaatggatgtaactgggagaatttcacagaggctctgggacacctaaaaaacactcttttataccaaaagccattgaattgtgtaaacttgaaatggataakttgtacgctttgtaaattatatctcaatraagctcttgtaaaaaccttgcttttgactcctttgtgtacatcttttacwacattgtgcttcctggaataaagatgtgatggctagtcctctagctgccatcttggactatgaggatgagggtcacaccccaagatggcagagcagtgaactggaaggagctggggcctggaggacytcactgaccaaagctgtctagccggtttttgggttacatatatctttggaatattttgcgaaatgaaaacaaatttctgttttctttgaaccactgctaatttgagtctctgttatttgctgctgaacttaaaccttgctgatacaacatttcattgggagtccattcttctggcttcctatgtccccctgtgtgtaacatgcagattcaggaaggaggcttcttcctgcacggactgcaatcccttgtgggccccaatgggctgtgtgrcctctttgagccacattctatctgaaacatggagataattatattttctcacgctgcttactcatggaatcgagataatcaatgagctaatgcgtggggaagcacttggaaaattagaacgtgcttcataaacattatgcatggagttgttatcaccagctccctatctttttatgaacatgaacacgctagaaagaaaaaaagaaaatgtgaaatcggagagaaaaacggcatgtcagcatttcctaccgaccacccgtggattatcatcaccagaggcagggaggagttgaagccgcactcctgtaacgtgtccggatgattgattcgaatctgacagccctgattggtttctccaaagagcaggaatctggtcttcatctcatgcagcgttttgtttgtttcaacagcttgagctcttcttccaaatggctctgcaatataagattggggacggtgcttagcctggcatctgcttcatctgaagccctccgtcttctcaaaggctgcttctacaagcacaagccaaagaggttactgggagatgctggagatcagaatgagccacaactgtggggagccccaaagactgtttccagtggaatggccaagtgatggagggtggcctaggaggttgagatcaccagatcctctagcctgttatcccagtgaccagccaatcaagcactagagtcaccctctaggtcataaggaatataggcaaggcagttttggaggctcggtggataagcacctcaccccaaatcacactgccaaaaactgatagagacaggatttgaacccaggtgtcgctgtctccaatttcatccctacatccctacctagagagacagtgaatagagcatcttagctgggtgacactatgtattagctcctgaggctcaacttgtcctcacgtgcagacagattatatcaggtaagccttgcagggacaaggtacaggggtgagtgtggggcagggttgggggaatcacagagggagtagtggatgccgcttgagggagggtgtggcattcagggagggcttttcagggaatgtgatgttgaccctggccttgcaggatgattgagtgtgtgtgtgtgttttgttgcgggggtcaggggtggctgagggagcaacatgagtcgaggctcacaggcatgcaaccttgcatacataaagaggcaggagacaaggccaggcaggccagagcatggagggccctgggatgctgaagagtctgggcttcatgctccagatgccaggctgctgctaaagagtttgcaacagaaaagagtagaggaatgtccattcggaggctttccaaggccgtgggaggtggaaaaggagaggaagattgtttttaacatatcaccttctgttgtttgaccgaagggccttccagcctctcttctgggggagcctcactatgaccatgagccactttggaggggtgggtgagtggccatccaactctgccaggcagcccgacagctgtcctgtctgtggtgctgcaccagagacggacacctctgccaagaggcctggtagagcctggcaaggtggcgcgtttccatggcgtggcatgtcaagatgggcgcatcttttctgccaagattagggatcaggccaagagctgggagaggaagctctcatcccttccttctggtagaaggtgggctcccctgcggctgaggagcagacacaaggccgctctgacctttttggtcagtgaactcaattcagcccatttaataaggaccctgatcattctttctgagaataaaatcattcaggcttctcaaataatatgtcttgggcttttggtttcaggggacagcaggaccaagagatgatgaacctacaaagtgcaaggggaggtgttaatgaaaccaattttcctacccaaagggtattaactcaaaaggttattaattctcagcaaagggcaatgatttttcactatgaagacagaatgaaatgcatcatattttattaaaaggaggtgtgagcaagaatttgaataacttttctgagataatgaagaaaatttctgccgctctctttggcttttctgagcttatagagagtctcagcttgccctcactcctggaagcctgcttccaacctagcctgctgatttcactggctgccctcctgtctaagtcagaagccggggtgtcaccttgcactgctatgccagcttctcgatcagtccaaagcttcaggtttcctaaatatccctagaatcctgtgccttagttcccgtgcacactgtgtcttgcttggtttattacagcagcctcctaactggtctctctctgcttggtctctctgtcctcctgcacacagctgctcaaagagtctaaaacagaaatgacaatacctgttagtgactttcagcttcatggtattgcagccaaggccaccacctgagtgatgatccctcatcccccacctcctcctctcttttcgttctcctgctaccaacagttcccaaatgcccttttggatgccggtacctttgcacctcacctcctgctctgtctctgctgctccattcattaaaatggaactgagacttcacagcctccaggaagccttctcatctagtcagagataattactccttcttgctctcagcaccgtactgcctccctgatcctaatacacttgccctgcagcggggtgatttatttatccaggtgtgtgcttcctccacctgtcagcgaactcatggagggtagccctgggcacaatggtgggtgctcaataaatgttagtgagcggtgaggtgtcctgccagatccagatcttggatcaaaggctggcactcaatcttcagccatttatacattggacctaatgtagctcattttcttttattcagagactgaaacactacacctttcttcattttaggatagctgcctcaaatgttaagagggtcatatgaaaataaaatggggataaaaatagtgcctatcttatgaggttgttaggaggattaaataagatatttgtaaagagctcagaacaatgcctgacatgtaattagaacctagagaagagagcgttgttagaataagtaccaattggagcatctagcatcttacatttctgatcagtgaaatcctttctttctgtggaaattcaccccagttgtcctcataggaccaattctgtcttgtgtatatttactctggatttagctgtgagatacgctccagcccaggtggctgaggcttcgaggctgttcaggagagaccatggaaaacagttgtcagatggaaagccccacaaacaactggactgaacagggccctctcttttctcccttcccggaggctttagctctctttaacatgtgtatgagcgaggaagctgtatactgtatacaggtatgtgctcattcatttattcacttcctcaacaaacacttattaagcatgtattatgccccaggccccctggctaggtactagttggaggcaaagacagcatgtggctcctttcaggagtccccagccccatggtggggtgggggatgcaagcttgaaaagcaactattaaaagtggttgctgtgttgcagcggaggaatgccctgcgtaggggctttagggaagaggtcgagagaagataaagcatcagtcaagtctagatggaggaaagactctttaagagctcatatccacgagcaattgttaaagaaagtggggctctggtgcctataaaaataagattgggaggatgacatgagagttgaagggctgttgtggagaaggtagactagacttattttgtgtaacttcaagaggtagaaacaaacagaatcactgggtgggcatgacatggaagaacatttttaacttgaagtagttggcaaaaattcatagttgaagaacttgggacaaagagaaaataagggcagtaaaacaataaagataggaatgtcaatattaacacccaaaaatgtacactatgtgatcttataaggctgctgaagatgggccacagatttttttctgagcttctttttggccacatcaaagagggaagcgggatcagttatagcattcctggtggccaggcactcacacttttttggtcctgaaacccaagatggtttccctatgtgttattgaaaaaggaggttacaaatatatagcagcaagttttatgtggttaactctgagagccctgtaatcttcagtgaaatagcagccacagcaccaaatagcgtttaagtcaccgtgagtctataagagattcttcactgtaattgagcagcagcctctaggactgagggaggcaggggccacttcaggtcacatttaggggtggaaggaatagagccctgaagcccaggggtctgagcctccatgagatcagagtctgtcgcttattcctagaacacttaggacacttgggcatcctaagggaagcccgtggcttcaaggactcactgctgtgcccaccctcatacctttactgcagtttcttcctacaagttttagctttgcacatcaccagctctcgactgggcatctttgcctgggtactctttgggcactacagactcagcaaggccaaactaaatgtattttccttcctcccaacccattcttcttcctttcttcctacgtttcctattgtggttcataacaccgtcattcatctctatgcccaaggtggaaagcttagagcttatgccctctcttgcctctctactgggtcaccaaatactgaggactcaggctcagaatgatctcctttgtctgcccagtggcctactgtaggtccttagccttttttttccccttcaaattatagtgttgcaatagacttttaactgtttcatattttattttgctttttgtagaattaagggatgctcattgtatgtatgctgaaaatatatttcagtataatttgaaaagtgctgaaaaaataaagaatattattatttagaaaaaaacacaaataacatttggagtatatcttcataatgttttcttatggagatatttgttccatagattcttatttacagtgtgtataattgagatcatgttacataaatggttttaaatccttcttcacttatcattatcattttctcatagcatcaaaaattcttcaaaacatacttggaaaaagtgccgtaatttatttacttactccactattgttgaaaatgtatgctgtttcaaggttttatttgccctattacaaacaattctctgatgatgttctttatgtataaatatttatcggaatctattagtattttcttagtgtagtttcctaaaagtagaatcagttccttacgtgtgatcctatttatatctctttatatatacatatatattcaaattgatcttcagcatttttaaaagctgatatatattgaatgctttctctgtgccaggcacttttccagcagtcttatttgtattgactcatttaaacctggccactctatgataagctgtgaggaaaggatatgctttagctatgagtgaagaaattggttccatattggataagctagaagcagcacattctccaagcataccttctgaaactggagcttttctcatgtcttcagaagaggtagtcacaccagtgataagaatctggggatgatactgtggttttaggaggaggaatattaaattgaggtaagtgatcaaatccatcaagggattcagcccctgtatccaggaaaaggggttgatggactagggaggcttggggttgtcctctgtatgacagtaagttcctagagcagcaaaacaatccttaaaattagttagaaggagaagctgggtccagccattacatttctaatattatttcttacagcaagtgatttttctattcctagttaactcctaggtttgagggttcctgatatttcatacaagaagaaattatttcattttcttttgggtaaggacatcagcagatgggtgactgcaggcaattgaggtggggcaccttccatgggagagaaccagggattctaccataggaggcctgattggagtcaggatctgcctcccgcccatgatgcctgggctagaagctgttgctcagttcagtgtttgttgagccctttccatgtattggctggtactgggcacacaagtgcataagaaagaagcctcgggtattgctatgcccctca

SEQ ID NO: 17999 - DNA, 41203 bp, Homo sapiens
ccacatagagaaggattttatcgctttctgctcttccacaccaggtaacaggtttctacacaggacatctttgttggggctatcaatagaaaaagtgacaataacccactagaggtggtgattaacaactcaagaccaactcaagctttgttccaagttatacacagaattccctttatccaagagagcaattttgcatatctgttcaatgcattactaattaaagaattcatctatgtttcaaaatatttttggaactttgagcgatagcagagaattaaatggaagacggtatgtgctgtagtacattagaatctgactctgcatagaaaattctgccatgttgagatcattcattagtccaatttgcccagacatcaaatatttataggagaagagtaagagcaagattctgaaaagcagaacagcaagcgagacactttggggccctaaattaaagtgggttttacctagaagcatgaagtgtgtgagacagaatatatttgaatttttctaaacgtatgctttggagtaagaatcttgctattattgactgacccagacatttagtattttgtaaaacagttccactagttcctcctcgggctttccttgaattgctgactaatatgtgaatataaatattatttttctaaggatttaataaattaatatatttgaaatattgggcacgacacaaaataaagcacacattaaaaaactgctattatttaaaatgtatatatttgataacttaattcagttacttttctaagcaaggtttaaataaaaattatttaaatcctttcattcaccacctttggcagtttcctgagaggacttgcattctcttggtcacctctggcccaaaggccctgtctctgctcaaatagttaagttttctaaaatattttctaaaatgagatatcttctttcagaagaagcttggttctacattgggttgaacatgccctgatgtagaactcaataatttttttttcccaatgatcagaaacaatgacactacccaaaaacaccatatattttcagcctgagtacgtatagcagagtttaatattagacagaactgttcgttagtatcctttgatcccagccttccacatgacattcaccgctctctaagtagctctttgtaggcctctggcttctcattatcaatctggctgatttatgtgtctttcttttctttcactttccttactcctaccttctagatgactgtcagaaactccaattcagttatctataacttccatgttaaacctatctccacattctgctgtgccaatcccaaccacatcatagtgatctcctgaagaaaaataattatctacttccttaatttcacaaaacatttgcagagatatctgtctccacgatatctttcacttacttccttttactagaacaagtctcagttaaaggcttcatttagctgagatagctgggtttctaaatagaattttattattaatatatactttatgacctttataactggctaaaatgtgtcattaaagaatgtgtctgtcattacatacagagctattgctgctgcttttctcttatgacttcctttgcataattttatgccttcattacttctgtgtctactatgtaataaattaatatttttctttaatatttctcttcttcataagaacttttttcctccaatatactgtgcttatttccttatctactcctcctagatttctacttttgttctgttttatgatttttatagttaactttttgtgtgtaaatatcttactgtcaatgttatttaatttcgattaatcttttatgaagtacataaattgagaatttgataatataattaccccatgtagactgagtattgcatatcctgggttatctcaaacacttgcgtgacctcagatacctcttgtgtatggagttattaccatcccctgtatagctagctgagtctattaaatatcagaatgcataattaacttaaatcacagtcagtaataccactttgggaatgcacatttagatatttcatttccaaatcccaatcactcccctctaccccattccgccttttccttatttgctactaaatttatgatttcaaacatccctcagctggagtataaatactagggtttcttctctttcttcaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcataactcaagaaattcttgaaaaaaaaaactcagcaaaaaaaagggctacagactttccttactcttttaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggctgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaacttgtccttatttttctcccacactgaagaaacagggactggaacttagagtgactaaggaatttagagtgtttgacttaatctgtcagacccaaactggctattggcacctttctttcccagaacttaaagtaaaataaaatataaaaatttaaaaaagaaaatcagacttacaaacatagcaatgttattaattactttcttgaacaaaaatttattttgtgccatttttaaaaaaagaaaaatcgtttgctgggctttctgctttggggatgtgatataagttacagcaggtatctgacttcaaataatttagagctcagcaggagagacgggggaagacagctagttatgacagcgacagtgtagtgtgataaagaacttttcccaaatcccacagtttgctactgacaaatccatgaacttgcatgtttctaccctttgcaaaagtatttaagacaaagtaagttttgaatcaaccctcagtagttcacagacttcttgaaaagataagacagccatccaaaatgaagcgcttggcagatggtgcctgacaccctgaagaaactctaggatgcatggtgtgcacagtgaagtcctggcatggtgcagagaaaacgagtttggggtgaaatcatgcactcagggatgttaagatttagggaggattcgaagaactaccccttacttgcaaatatgtttttttctaatatttaacagattaaatgagagttaatttctgacttcttaaacaccttcatagttgaacacattacagtctctctctctctctctttttttttttttttttaccttttattaactgtttctctgggcatatctcttctgtgttatcatgcatactctactacaacctgagactacatctgtgatcagtctttgctcagagaatatcaaaaaggagaagtgaattgccaccctaagtaaaaattaactgttaaagcagttttagtcagttgaagaacagcattccaggaagtagataagaggattccttcagaactgtctccaatcaaagcgtaagatgacagggagatggggaggagaagactccatcatgattcctcagcacagtttaaacaagaaatacatttattgaataaacaatcctttccttgtttctttttgctgttgttgttgactttgttgagtatcagttggttataggtgtgtggctttattttggggttctctattctgttccattgggctatgtgtctgttttttttgtacgaataccttgctgttgtggttactgtagacttctagcatagcttgaagtccagtaatgtgatgcatccatctttttgaaaagcagtttggagatttaccaaataactaaaaaaagaactatcatttgtccaagcatcccattactgactgaatcctcaaaggaaaatgtactgttctatcaaaaagacatgtgctttcaaatgtttgtcgcagcactattcactgtagccaaaataatagaatcaacccaggtgtccatcaatggtggattggatttaaaaaaatgtggtacacacctactatggaatgttacacagccataaaaatgaaaccctgccctttgcagcaacatggatgcaactggaggccattattctaagcaaattaatgcagaaacagaaaaccaaatatcacataatctcacttgtaagttctagctaaatattgtgtacacatggacataaagacgggaataacagacacagggaaataccagagggaggaatgaaggaagaaggcaagagccgaaaaactatgtactgggtgctattctcactacctaggtaataggttaaattgtactacaaacctctgcatcacctaatatactcttgtaacaaacctgcatatgtacccctgaaactcaaataaaaattgaaatgaaaaataaagaaacccaagatatacaaaatatttggttaattcttatgggaagatgcaaggaaactagttagattttactcattcaggacatgtgtttttagacgagcagaggtagaaaaactgacagatcagaagagagggatgaataaaagaagatgtggggctatggagagagaaaaggaaaaagaaaaccaggctgaggtttcaacccacaaaacaatgttttgtcatttgcattttttttccccagggaagaatctagagttcaagaatagaaagccaatttgcttactacagggcacttcccaatgatgaaactataggttcccagaagcaacttcccataatctgtaatcacttgtccccactccctgcaataaggaagtacctagtgtattttatctctgagtctgaggcactttccagtgctgtacaaagagacagaggctgttagctatggctggtgagtctgggcccttttctgactagcagctgggtactcaggtcttagaaaaatcttgatttattgctatgtgacaggcagaaataccaaaagggaaatcaaccaatagtgtgcatgctgaatctttctcttattggtggtatgtagtttgaatcctgagactctgtgtagagacactgaaggagagtatgttctctagatgttttcaagccagaaaaaggttaattcctttctttcagcttctggtaatcaaagagagagtaaggaaagacagagtaagttatttgtgtgagaaaactccrgaaatttctaaatgcactctgaaatcttctctgcttcctcttgattccaaattaatcctccagactatgaaccttctccccacaatcagatctgagagcctctgtgttctcaacgtgttgtcatctcttatcttgaattatcttattggtctgtttaaagtgattgcatttttccacctttctatgtagtcctggtactaactcttataatgtaatatatcttaggttgctatcatagacttttaactgtcttcccactcccaaaaacttaacccttcagtccatactgcacactactttcaggccaactgtcttatacacagaagctaaaaaagcctatgagttggagtcctgggctacttaagcagctcgtattccagcaggtcatattgcgtctttggyttcattctcctcactggaaaaaggaagaaactggaatagatcagtgctttctaaaccttataacatatatgaataatctgcagtctttttttttctttaatttatttatttattattattatactttaagttttagggtacatgtgcacaatgtgcargttagttacatatgtatacatgtgacatgctggtgggctgcacccactaactcgtcatctagcattaggtatatctcccaatgctatccctcccccctccccccaccccacaacaggctccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgaactcatcattttttatggctgcataatattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaaagggatggctgggtcaaatggtatttctagttctagatccctgtggaatcgccacactgacttccacaatggttgaactagtttacagtcccaccaacagtgtaaaagtgttcctatttttccacatcctctccagcacctgttgtttcctgactttttaatgattgccattctaactcgtgtgagatggtatctcattgtggttttgatttgcatttctctgatggccagtgatggtgagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacgagtaggttgcgaaaattttctcccattttgtaggttgcctgttcactctgacggtagtttcttttgctgtgtagaagctctttagtttaattagatcccatttgtcaattttggcttttgttgccattgcttttggtgttttagacatgaagtccttgcccatgcctatgtcctgaatggtaatgtctaggttttcttctagggtttttatggttttaggtctaacttttaagtctttaatccatcttgaattaatttttgtataaggtgtaaggaagggatccagtttcagctttctacatatggctagccagttttcccagcaccatttattaaatagggaatcctttccgcattgcttgtttgtctcaggtttgtcaaagatcagatagttgtagatatgcggcattatttctgagggctctgttctgttccattgatctatatctctgtgttggtaccagtaccatgctgttttggttactgtagctttgtagtatagtttgaagtcaggtagtgtgatgcctccagctttgttcttttggctcaggattgacgtggcaatgcgggctcttttttggttccatatgaactgtaaagtagttttttccaattctgtgaagaaagtcattggtagcttgatggcgatggcattgaatctgtaaattatcttgggcagtatggccatttttcacgatattgattcttcctacccatgagcatggaatgttcttccatttgtttgtaccctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttattttcttctcctgcctgatcgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaagaacttttctgcatctattgagataatcacgtggtttttgtctttggttctgtttatatgctggattatatttattgatttgcgtatattgaaccagccttgcatcccagggatgaagcccccttgatcatggtggataagctttttgatgtgctgctagattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttagttggtaagcttttgattattgccacaatttcagatcctgttattggtccattcagagattcaacttcttcctggtttagtcttgggagagtgtatgtgtccagaaacttatccatttcttctagattttctagtttatttgcgtagaggtgtttgtagtattctctgatggtagtttgtatttctgtgggatcggtggtgatatccccattatcattttttattgcgtctatttgattcttctctctttttttctttattagtcttgctagcggtctatgaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattttggatctttcctgctttctcttgtgggcatttagtgctataaatttccctctacacactgctttgaatgcatcccagagattctggtatgttgtatctttgttctcgttggtttcaaagaacatctttatttctgccttcatttcattatgtacccagtagtcattcaggagcaggttgttcagtttccatgtagttgagtggttttgagtgagattcttaatcctgagttctcgtttgattgcactgtggtctgagagatagtttgttataatttctgttcttttacatttgctgaggagtgctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgctgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggactgcaacccctgcctttttttgttttccatttgcttggcagatcttcctccatccttttattttgagcctatgtgtgtctctgcatgtgagatgggtttcctgaatacagcacactggtgggtcttgactctatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgttgagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggccctcattctcttctggcttgtagagtttctgccgagagatctgctgttagtctgatgagcttctctttgagggtaacctgacctttctctctggctgcccttaacatttttccttcatttcaactttggtgaatctgacaattatgtgtcttggagttgctcttctcgaggagtatctttgtggcattctctgtatttcctgaatctgaatgttggcctgccttgctatattggggaagttctcctggataatatcctgcagtgttttccaacttggttccattctccccgtcactttcaggtacaccaatcagacgtagatttggtcttttcmcatagtcccatatttcttggaggctttgctcatttctttttattcttttttctctaaacttcccttcttgcttcatttcattcacttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaggttttcaacttctttgcctttggttgaatgtcctcccgtagctcggagtaatttgatcatctgaagccttcttctctcagcttgtcaaagtcattctccatccagctttgttccgttgctggcgaggaactgcgttcctttggaggaggagagkcrctctgctttttagagtttccagtttttctgctctgttttttccccatctttgtggttttttctacttttggtctttgatgatggtgatgtacagatgggtttttggtgtggatgtcctttctgtttgttagttttccttctaacagacaggaccctcagctgcaggtctgttggagtacccggccgtgtgaggtgtcagtctgcccctgctggggggtgcctcccagttaggctgctcggggggtcaggagtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagactccgtgggcgtaggaccctccgagccaggtgcaggatataatctgatgcgccattttttaagccggttggaaaagcgcagtattcgggtggaagtgacccgattttccaggtgccgtgtgtcacccctttctttgactaggaaagggaactccctgaccccttgcgcttcccgagtgaggcaatgcctcgccctgcttcggcttgcacacggtgcacgcacccactgacctgcgcccactgtctggcactccttagtgagatgaacccggtacctcagatggaaatgcagaaatcacccgtcttctgctcgctcacgctgggagctgtagactgtagctgttcctattcggccatcttggcgcctccccctgcagtcatatttaaaaatcagattaccactgcattcccaaccctgaatagctcaatctttaacagactgtaggcatttattaacctttaaagatctgcagacaattcttatgaagctagcctggcacaggttcttctgcaggttagcatcattagcaaaggtggtcagttagttaactctcacctctcacatgctagggatctattaatgtaattttcttactcagcaacatacattggctccctattgcctttttaaaaatatctaaactttcagatagtgttttagatggtgtttctgtctttcaaaatatacttattcatttttccattaatcactctaaggcacgatttttacgttcataagaaaaagaagcaaatgtttactgtattttacttcacttgtacttccttgctgttgagtttctttattcgattctcccactagcttaattatctccaaggtttacatctcacctcacaacatttaactgaaactcctaaaatgcaggaattgcttgcttttaaattttttttttttttgtctattttatgatactaaaaagcatttggccagggaggagtaagtcaaattcatagccatggctgcctctttggccgggcaggctgactttactggtcgtagactggagtcaggagaatcattagataatagataggagaaattgaagagcactaatcaaaaataagttaagtgggttaataattataaacaaccatgtgtagttggtctttgttaaataaaactagtgaaaaacagtatcctatataaaatgtgtaagaacatcacatcactttgcctaggaccaaaactgctcttgatgaatttggcctctaaattattccattcgtttttattatcactgcatcttcaattcattgattactaaaataacaaaaagtaatcaataaaaactgttttttaaaaataatactgtgtgatcggtatctcttgcactctctgtgactgaatatttaaaaccagtcagttaagtttgtgctattattgccattttatagttgaggaaggtgtctagaaaaggactacgaaattttcttttggtctaatgtctgttgagaagagtgaatctaggttggcctgactcttaaactcaacactctaatgttctgtcaattttctgcaaacaaacatcttcaaatgrtggccctatctcatcacgcccacttcagtcctggctgcacacttcaatactttctaaagcccagctagcccagcttcctgattactttagacaccctaaaatctttgtgtttcttcccacactgctctctgttaggggaccagccctcacttgtccaaggggcaaattcctcctagtctttcaggtctcagtgccaagccctcccttctctggacagctatcttctacctgaaacacagtgtgctcatgcttttttttgagcatctgctcgttatttaaattcttacaatgttttttatttgaygtatttgcatatctatctttccacttgactgtaagcttgaacatgtaagaacatttcctcaaaatggtaccctcacaactagcagagtatttttcacaaacttttgctcaccaaattttcyagaatgaatatgccttccttctgcttaaaacttccagtgtgtgcttattgtctattaaataamatcaaacttacttaccttttattaaatattcttcaagakttgggccatacctaaaatttattcatttgtttctacattcactcaactagtgattcagtagataattattagacttcccttgagtgccagaagtagtgcaggcctagtttatggccacctatcctcacagagcataaaatctaatggtggatgctgagaattagrctggaaatcacaattaaaggtaaaaaactatgctaccctaaagagaaacaaggtgccctaggggcatgtacctctgayattgtctcccctcagagaatcagaggattgcctgaaaaaaaaaaatgccatctggtcttagacttggagaatgaacagaaagtataggagaataggaagcaaggagaaggtgggagactggactagacattaaatgaagagcagaatattttaattgtaatgagcaaggtggggacagtatcagaagatgaggctgaatgagaaggcctaggttagaataagctgagasgtttcatggtcaaatctagatataggaacactctttattgtgaagaatagaatagaaaggacaaamagaaggtttataaggttcttggtgtaattcagaaagaaagggtgttggcctgaatagaagtaatgaacaattaaaattaagagtagtggtcagattctgaaaatgtttagtaaataaaatcaatgcagtgtgaattgagttggggaataagacatacagaaggcagaagaagtttaatatcaccaggttttgctgccttcccgcacttggaagttaggtattaktttttactatatggaggagsaaatgaaggatggaaatagaagaaaattagcagttcaattttaaaagttcaattgaatgaggttgtgggagtattttaagtgacgtctcatttttggacgtatgggtttccatacgggatccacatctgggctgatccataaatttgagtcatttatttattattttaaacttataattgatgctatgagaatttatagattatgaaaagaggctctcaagccaaatgtcttgaattgttttttataaatattattttatttatttaattggcaaataaatattttatrtacttatgtacaaaatgatgtttgaaatatatattgtagaatgcctaaagagctaaataacatatgcattacctcatatgctcatctttttttgtgattacagcacttaaaatttacactgtcaaacaattttcaagaattcatcattgactatagtcactatgtggtgcaatagatttcttaaacttacttctccgatctaattgaaatgttgtttcctttgatcaacatctccccaaacttcctgcctcctcctaatcaccaccattctaccctctgcttttatgtgtttaacttttgtgagtctacacatcagtgagatcatatagtatttgttttttggtgcccagcttggcttattttatttaatgtaatgttatccwtgttaatcaatgttgtcacaaatgacaagatttctttcttttttctaaagctgaatactgttgcattatgatactttctccatccattcatccatctacagatacttaggttgattttatatcttgcctattgtgaataatgctgcaatcacaatggaagtgtatatgtcttttcaacacactgacttaatgtttaaaatayatactaaatatttgggctgctacatcatttttaacatttttaattcattttaatttttaactttttgaggagtttcctattgtttttcattatgactgtactaatttatattttcaccaacagtatacaagagttcctttttctctacatcctttccaacacttgttatcttttttttttataatacccattctaatcattctaacaggtgtgaggcattatctcattgtggttttaatgtccctggtgatcagagatgttgagcattttgtatagacctgttgtccatttatgcatcttcctttgaaaaatgtctattttggtccttggctcattttgtaatatttgttttcttcctattgaattgtgtttctcatatattttgaatattaatatcttatcagacatatggattcaaatatttactcctattctgttggttatctcttcacactgttgtttccttggctttgcaaaagctttttagtttgatgtaatctcatatcttaattttgctttcttttcccatatttttagtgttatatccaaaaatcattgtctataccagtgtcattaagcttttccacgtttttgtgtagtagtttcaaagtttcagttattaggcttatgtttttaatccattttgagttgatttttgtatatggtgrcagataagggcccgttttcattcttctgctcttggatatttaattttcccaacatcatttatcgaagaaagtgtccttagcctattgtctgttcttgaaactttgtcaaaaataaatttactgtaaataactgggtttatttctggcctttttgttttattccattgatctctgtgtttgcttttatgccagtactatgtttgattattataactttgcagtatgttttaaagtcaggttgtgtgctgcctccagttttgttctttactcaaggatgctttggctatttgaatttttaaataattccatatgaattttaaggttgattttcctatttctgtaaaaaatgccattggaggcttaataggaattgtattgaattcatagatttcttgggtagtatagacataataatgtaatattttccaattcatgaacacgggatatcttttgatttttgtgaatctcaggcattttcttctgtcaatgttttatagttatgagtatatacatctttaactttttggttacatttattccttattatttcatgaaatttttttatagccattataaatgagatttttatcatccaattttttagtttgttgttataaaaatgatactaatttttgcatgttgtttttgtatccttcaactttactgcatttgtgtattagttccaacagatttttcatggagcatttagggttttcttaatatatgtaagatcatgtcattcataaacaggacacattaacttcttcctctcctattttgatgcctttaaattctttctgttgtctaattcctctggttaggatttctagaatagaagcggtgaaagtgggtgtgtttgtcctcttcctaatctttgaagaaaagcttttatcttttcaccattgagtatgatgttaactgtgtgttttctataagtggcatttattgtgttgtaaacctctttaggttaattgcttttcacatgtctccacatattcattcagtcaaaactatattcatttactaagcaygcaagtaagttaaatagaacttcagaactcargcagagtagacattccattaactaatctgtgtactctttgcaaatcttcacattcyctgttccaacatctacattgcatttaaaaccaacgtttttgtcttgtcttctaagaagcctctgtaaactctcctcctggaattttctcatcttttctgagttccttaagcatcttatctgtgttctcttaagaagctcttcawcaactatcatgtaatgtagtttcatgacttaagagttggggctctggattctgatcacttgtacttctattcctgctccggagttactgtatacttcattttcttttcacaggattacactcaatttcttaagtaacttatctgtatatgtttccttttccatataaaagaggttaatatacattttgcatggagtttttgtgaaatttcagtaaagcacttgacctcatgggggttcaacatatattattattactgaaagcctgtcatggttaactctatggaatgtggtgtaaaaataggatttgaaccctaattcatgtgatttagggcarcctattatttaaatgacttataaaattgataaaataataaatattctactggtttattgtgagagtccagtatactactatttgtaaagtacttagaagagagacttgtaaataataatgattattactgatatgatataataataataatgataattactgatttattatatcagtataataatgataattactgatttattatatgagtataataatgataattactgattaaatcattataataatgataattactgatattgttaataataatgataattactcatgatataatgatgattgtcattgctttatgtgaattcattttttaatcacaaaaaatacataggagatgttacatttattaaatgtaactttttgtcctgttttgtaacttccatgtgtctttctaataatggttggttcattattggcatatgaactcaagataacctggaaaatgagtctggtgcttctaggccaaaattttgttcaatgtcctgacatgttttctttagaaaatgtattttgtgtgaaagctatccttatatttagataaactagataatgatctttatagagwtaacagaagagaggagatatctggcttttccacatacaacctgcttaaatcatatctcttgtattgaaataagtgatttattactttgatatatatatgtgtgtgtgtgtgtgtatgtgtgtatatatatatgtgtatatatatgtatatatgtgtatatatatgtgtgtatatatatgtatatatatgtgtatatatatgtgtatatatatatgtgtatatatatatgtgtgtgtatatatatatacgtgtgtgtatatatatatatatacgtgtgtgtgtrtatatatatatatatatatatatatatatatatatatatgtgtgtgtatatatatatctcctggtaaaaatctgaattataccaaggagtaatacattaactcagtattatattaatctaccataatatttgttaaatattttcaattctaaattttrgtttgagaaaaggcgctgaagaattaggtatctagatgcatttatccacttaatgattaagttggatgtttacttatgtattcagcaagcagattaagcacttttaagcattttgagcagaaaattgttaattagcacaattgggtatagcttgtgtgttaaaaaacacaaattcaaagatatagttaattcaccaaggaagctaaatacagagaaaaggaaagatcctgcagtctagtaggaataatttacagtctagacaagagaatggactgtcctgggtgcacacayttcaggtaggtcatcatgagtttgagcaagagagagaaatctgaatacmatggatgaccaggaatttagcattaggcccaatgctgcagaaaggaaaaagacaagctataaaaaacaaacttaagtggcaatgaattgttaaacacagcctggtaggaatttgatgggtgagagaatgctacaggtacaaagaaataatgagtatttgttgaagacatggtaagacagaatgtattttcaagggtgtttcacattacagagctttgtctaaagcaagggcaaaactctttaagctgtgcccagagttgaaggagtctttatatttctgatagaagacagtggcaaaaaaaaaaggcgtaagaattttgaagctatgttcaaaggtatccttcagagtggatkggataacttcgtgataaaccacatgctaaagaacaacgtggctggacaaacatctatccagaccctagtacctaayacggatcaaaagtcgaccagtgtaaaaagtaagactggatattttacaatggatatttccaattttttagaatctgttcaattataagtcccatgcagtgacttctgtgatccccctatcctccttcctttatgaaactatcattttcaccaaacctataatttttccttcagggactaccttgtcttttgtggggtgggatccagtttccaatcggctaaaaggctgagtccttgggttcagattgtgcatggaaataattaatagtagaggcttgtagtaagacatattcaaacctaaatctagattctgttaytaataatctgtgtggcttcctgcatgtatcttaacctctcttgctccctaatcatcagtcttaccatctatgaaatggggacaatttcagtactttctcacaagactgtggaaggttagaaacattgtgttggctggcatcaacatgccaataactcccaagatattagctgtcatccagaactctctcctctgagctccagactcatttagctctagatgtattttcaacaattctgctccagtgtttcattggcttcattaaactaatgattacctaaaaattaaacactttttcttctaaacaaatttgttccaactttaacccctttccattttagtaaaagaaactaatatatatcaaatttctcccaccagaatgcaactggttgctttaccaatgactggcagtaattagaagagggccaggcaaaaaaatttatcactttgatatctatattttccaataaaaattcaaattatgctaaggtgtagtgattaacctgatgtcacataaattcaccatgctagagtagttatgatattattttcaatttcaaatkttgattgaggaaaagatgctaaaaaattaggactctgggtgcagtcatccatttgttcattaagtcatgtatttagcaagcatgctaagtacttttaagcattttgggcacaaagatgttaatgagcacaaagatgtgggtataggatgtgtgctaaaaatgcaaattcaaagatatagtgctttccccaaggaaactaaatacagcaaagaggcaagattgtatagtctagtagtatttacagtctagacaagagcatggactgtcctgggagtgtccatttcaggtaaattatcwtcatcatgagctgtgagcaagagaaagagaaatrtgaaarcagcaggtgaccaggaaattagcattattcccaatgccacagaaggaagaagaaaagctataaaaacaaatttaagaggaaatgaattgctaagcacagtctggtatgaatttgataggtgagagaattctgcagttgcaaaaaaagatgtgtgttattcgctggagacatggtaaaatagaatgtatttttagaggagtttcatattacagagttatgtcttaggtgaaggcagaactctttaagctgtgcccatagttaaaggagtctttctatttctgacagaagacaaccacaaaaaaaaaacagttaagatgttggaatacctgggcaaagatgttcttcatggtgtttttaattatttggcaaaacacgatgttctgacattgaaggaagaggaaaagaaaaaatattatgatrccaaaattgaagacaaggccctgatcttggtagactctttgcgaaagaatcgcgtggctcatcaaatgtttacccaaacacttctcaatatggaccaaaagatcaccagtgtaaaacgtaaggytgcatctaacacgataaatatgttaaattttccagaatatattcaactccaaggcccatgcagtgttatctgtgatctacctacastttcatttctaaactctcattttcagtaaacatgtcatcatcctgttagagaccaccttgtcttttatgggacgggatcaaatttccaattagccaaaaagctgtgtccttgtgtttagactgtgcacagaaatagttaataagggagattttttagtaggagatacctaaaccyaaacttagattctgtcacatgtgaactatgcagcttcatgcaagtttcttgaccttccattctccctagtcatcagtcttaccacctgtgaaatgtgggcaattccagcactttctcacaagactgtctacagccagaaacattgtaatgccaggcaccacatgccaacaacttccaagataccagctctcattcaggactctctcatctgagctccagactcatttagctctagcggcatataaaacaattctgctccagtgtttcactggcatcacaaaatgaatacagctaaaattaaaygctttgttttccagaataaacgtgctccacttttaacccttttccgcttcagtaaaaagaagtaacatgcaccaagtttctgctaccagaatgtaactggtttcttcaccaattaataagagtaattaatggagatcctggcacatagcagatacctaattaatgtgtgatgaataaacaaatgaagtataygcatgcaataaagagtgctttcttaattattatttgggcgctacaaattggaattttccaatgcttactcatttctgtgagttacaaaattatgatcagggaactactataaaatgtttaaattttataacatttcaaaacttttgacacggattgaattatcagtattattagagcctaaatgttctcagatccatgttttccagggaaggactcaatttgccatagactttaaactgaaatcttcagccctgaactactacagcttaccaataatcacatacgatcatgaacataaagcaacataaattgttcaaacctcwctatacaaaataaactccccttctctgtggggaaagtttcccctcaacagaaaccacatgctagtatagttgtccaagattttaggcaaggatgcattcttattaatatttaaactggtcttttgcaagtattttccttttcctcaaacctggaatggcatgaggaaaaaatatcggtttttaaaaatcagagataatgcaacaaataggaatcatatttgtagcaatacgggcttcaaaatgattttagcaatcccagatatcatatatgatgagcactaaactctaaactgaattagcctatctgatcagcagaggctgtggcaagaaggaggcagctgcagatccctgcaggaggggtccagtggctctctgcactctatctgcatttgtattctccagaatgatcgatcccagaatactttgagtacactggcacagcagaccaggaagctgggtgggctgggctattagaagaggtacaggccttggctaggcctttggatatggttataattatgagggtttccaacaaagcattggattctggagtgcaggataagaagaatcctagctattcatttgttatttaactgtttacacacacacacacacacacacacacacacacacacatatatatatacacactatataccgatgatctgatttagtcaggagataaccacctaagtccctatgtgctgtgggaaattgctttactgatcctgtaccactccactactccctttcttgttgtgtcaatgttaagagattcctgagcagattcctgagagattcctgtttcattagataatagataagactcaaattgaaatttttatctaaactcctgatttccacattacttcctgttgcactgccaggctaatagaaactctctttggaaggagactgcactataatatttattattttgtaataaaataatatttttgtactaattctactactggatataagatagaatttctgtctaatttctaattttactggaaaacacctgttctacacacagacacataaaagtcttaggagatgactgttaagttggaagttctccaaacctttaaacaggaaaacataccctcagaccagtaatatcccaggaccctagatgtcttcacattggcagacttttctgaaatgagaagaaaaagcatctgtcactgtttaatctatgaaaaaagagatgcttagaaggtatggtttccttacacacttagaacttattgcattcccagaactcacgcttttatcatactctttagcaagacatttactttaaaatattattaaaaatgaagagaaacaaatgattgatatataaaaaatacatgaaatatttaaaaacaatataaattttatacagaacaatattactttactcatgattcctatgtcttggttgggtcacgtaaccaaacataaaagtatrcttgtccatttctttcatgaaaagaaatcttgttattrgatcttactaaattcttctttgaatttgtatacataaattcctttttcttttccagaaggagggctcaataatctcccagttttttgcacaatatcggtcaaaagagatcaatattacatttcacaaggggatagatcagaattactcagaagcaaacttatccaaaacagatgtattatttcctcacattataaaatatgagttggacagtrttggctgtccagcagtttagagacaagatgttcagagttacgtcagaatctcatacaaatatttgtccctttgaccttggacacagtactattgtgtactgtgttgtcactagacaacctttcttcataaataggtgatttcacaatttgttgaaagataactgaagcttatttcttctagaataattattaattcacataaaagttgcttaaaaaataccaggatggtacaggattcaatattctatcaaacgtttgttgtatacatgtatctgtatgtggtgtgaactaggaggggactatcaatccaaaatgggatgttgtcccatccacttttgtagccaccagacataacttgtggctagtgacatatgttgaaataataatattttgaatatattatgttaaataaatatattattacaattatttttaccttttgtaaatgtgatattagaaaatttaatattgcatatggaactcacattgtatttcaaatagcactctgacaagtatttacttagcacastcttgcccagacacagcagaaagtccaaataaatgaatgagtaccctagygtaaaaccactggaaaaatcaaactgtttttctgaatatagaaaagccaaatttaactttaaatcatcaagattttttctccagaataatcggaatctatagttgcatcttcttcttggtggggttgtgggagtctgctttctctatcagggaattctcacaacacatttccttaagctggaaattaggtacagctataacccctaaatataaagagtctttttcctaggatttctctctctctctctctyaaagttcttaggtgataaattgggtcacagaggcagaaaccataatttatattttgtgatatcccacagctcttctgcaaatcgaggctggaccacctgagtcagcagaatctacaaatatactcaaactttgtcctcgtgaagaattcctgagactgtgtaaaaaaaatcatgatgaggtgctgtgctctctgtatgaaatggggaagaagagagaaacaattgctttcattaaatgcaatgcacatttttaaaaatggggtcttgctctgttgcccagcctggagtgctgtggtgtgatcatagctgactgctatcttgaacacatgggctcaagagattctccagcctcagcctcccaagtagttagcactacaaatgcacactaccttgccaggctgatttttttttttaatttttgtagagatatagtctccctatgttgtccagtctgttctccaaatcctatcttcatgagatccacagccttggcctcccaaagcactgggattacaggcgggaaccacagtgccagccataaatgcacaaatacttaaagcactaaatgatgagggggtggtgacagtggtaacctttatgatagatgctttcagcaggcaagggttcatatggcttcaaacaaataccagtgctcattcaatccatgataaaatgtagctttctctttttyatcatttattgatttttgtatcaatttgggatttattacaatttcagataaagccacaaaataaaatgtttataacatggctgagtagtaattgtttatacccagttgaaaagcctagacataaaatatatttgaaaagtataattaaatcttgaaaatcattgtaagtttatgtttttaaaatagtaccaaaataatcataatacggaaggcaaagaaaatttgctatatttatttttactggagccgatgacaacacctcttggtttatatgaaatttgatttgaacctaaatataagaaatgtttgagtaggtggagaagaaaaaggagaaggaagggggtaggaattattctagtttcctcaagattctagagtgatcattccagatatgtcctggttcttgctctgggctcttgagagagaggaaggcagtgtcttctgatagaggttagggaaggtggcagctgcatgaggtcttaaaaaagcaaaattgtgaggcatatggrggttgaaaagagactcgggtaatcaaagttgcttcatctccatctcctgcagatctatccaataaaaaagagagaggaccgcagacgcctggctctcatcatatgcaatacaaagtttgatcacctgcctgcaaggaatggggctcactatgacatcstggggatgaaaaggctgcttcaaggcctgggctacactgtggttgacgaaaagaatctcacagccagggtaagaacccctaagccatctcacactcatccataggcaacacagattcttctaataattagttagctttatagaagttcaacaaggtttaacaacctctgggttcgtgtgcgtgtgtgtgtgtgtgtgtacatgcgcacatgcactagcaaatgaaattattgaacacataaatcagtgtctcttttgagcctcaaataccctcaactccataaaactagacaaaatatgattggcatgtattttcgcaattgttactgagttccaataagatcaggtgattgggatgtagccccaagattccacataaaatcacagagtaatgtgttttaggcaggagggcactctatttttatttttatttattttttgagaccaagtctcactctgtcgcccaggctggagtgtagtggcgtgatcttggctcactgcaacattcaccttccacaagcgattctcctgccctaccgagtagctggggctacaggagcgtgccaccacgcccggctaattttctctatttttaacagagatgaggtttcaccttgttagccaggatggtctcgatctcctgacctcgtgatctgcccgccttggcctcccaaagtgctggaattacaggcgtgagccaccgcacccggcccaggaatgyactcttaaaacaaatattaaatccaaactttggggccaagagcttttcctgatactgtggataagtctgtaaatgataccagaagtttcaaattgcaaggatctaggttagagtggaggtaaaatctcacaatataaacgaaaccggacaatttcagataatgagtgtgtgtatgtgtctatataagaataacaagagaatccaaagtaagcaaaaaggaaacatgagagagaatgttggatggggtgcgatgtttttgggttggtccagaaaagcctctgtggggagagaacacrggagttggacggcactaccggaaggaatggaatggctctgggaagatgagaatgcagcgccttcccagtagggggcgctacctgtgaaagagctgagctgaaaatgaaactggcacatgtgaggcacaacagatcagtgtgactagagattgaagcagaacagacatagtataaggatgagtatggtcaggccagaagattgattttattctaagcaacgtatgttgggttttacaaggacagtggtgtgatgcgtttataacacatgactcttgttaggaaaggagagaaaagattgagataaaaaaaagtaatataagtaacatataaaaatatacaatatattaagaagacagtgtatggtgtgtcagcagggagaaaaagtaggaacccacagccccattacaaaggaaaaaaaaaacaaaacaaaaaaacataaaactgctgtcatgactgagtaagcgctatgtgaagcaccacgacccggatgttacatatgtttcttgtttcgctcatggtaaatctaggaggtcctattaattgtgatgcttctctgactgaagttagacattgctcttttataggatatggagtcagtgctgagggcatttgcygccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtggtgagtgctgaggctgaacatctaacagttttgaaggtgtatrcagaggattgtgatgtttggtttatatttaggggaaacaatgttagaccccatccagtgcaaataaagtacattgaattatgaagaaactctacctaaggggctgatataatgagaaattgtctcatcagtggagaaatttctgtacaattttatccacggtgatagtggtgaaggaagtggtgaaggagatcatcagaatccctaaatcaaagttaaacagaaatattcaaactttgaaatggaatcatttacatgatagcttgatttgtaaatgatttacagacatgttgacattatgtggtttctgaagaatttgcacttgaaactgaagttattatgtgatacaagcaccctatttattcacaattattgaagggaaaatgagttgggagttaaggaaacttgaggggatttaagtcaatcttctctctccctctttttattcctgacttccaattacctcatgactattgggatgtatattttgttttgtttctttaagaaagcagcaataatttaactgaaaactggtaatgacatgataaattcactattaatttacacattgttgaatgacactagagacaaagcaaaatgtgtgtgtgtgtttgcatgtgtgtgggtctgtatgtatgtatgaaattagttagaaagaacactgaaaaataacaaggtgggcaattgtgatagccatgctaagtgaggcacatcagtgtataaaaagttgatgtctcttgatccaacccaaatgtycatcaatgatagatagactggacaaagaaaatgtggtacacatatcccatggaatactgtgtagccctaaaaggaatgagatcatgtcctttgcagggacatgaatgaagctggaagctatcatcctcagcaaattaacacaggaatagaaaaccaaacaccacttgttctcacttataagtgagggttgaacaatgagaatacatggacacagggaggggaatatcacacaccggggccagtcggggggtgggcgacaaggggaaggagagccttaagacaaatacttaatgcatgtgggcttaaaacctatatgataggtgcagcaaaccacaatggtacatgcgtaactatgtaacaaacctacacgttctgcatttctattctggaacttaaagtaacataaaaaaaaaagaaagttgatgtctctacagaaaaacatggggaactctgggtcagagactctccagcatccttggcastcatctcttcacagtcatctgagaacctggaggcagattctgtttgcaagatccacgaggagaaggacttcattgctttctgttcttcaacaccacgtatgtgtcttttagtaacagtcaaaaatktgggggtgctgaggccacctttgaatgattctatgaaatcaagataggccctatgcaacaatgagctgagagaatggtgtgtgctctctatatattttgcatgatcttatgtgtgctgtgagaatagattccttccccctcccacacayacattttaaaaaactgtacttttattataagtgttacactttacagtcaaaggcataccaaatattaaagcaatacaatacaaggaaccccattcgccacacaccatgtaaacatagatgatggatgctgtttttttaataaatccatttaacattttgaatagaagttttayggatcccagtactggctgtctttccaaaygatcaacttcaagccctcttctacatatatcccacttgatcctacaaagagcaatgttattaagtgtccagataaaaatgtgaatgagctttaaaaaaggtaagaaatgttagggtggagctaattaggtstaattacaggaaacagtcgtttgtatttcacctctaggtaatcatcctaaagggctttctattttactctttccaagttgtaaattttcaagtcttatttttaaaccactttatggaggcatagctgacatatgaaaactgtacatatttaatgtatgcaactcaataagtttggagattagtacacacccctaaaatcatcacccaaatctatgctgtaaacatctctcctccaaaagattcctccagctctctatttattattatcatcattctgcaagggtgtgataaggataayttacataagatctactctctgcaaatttttaagtatataagacagtattatttactattggcaccatattatacagtatttttctatattttaatcttctataactgaaactttggatgtgttcatctattttgtttattwtatggtgaaagacatcatggtgcaatctgtaaacaatcttggagcccgacggtagttttttgttgcttcctcactgaacctaaaagtttattcatccttctgagcttctattctttcctttgtaaagtgaaagaattccagttatttctcaagtccccttttctaagcaaagtgaatgaacatgaggtccataataaaaagttagttccaagaatcaaaatacaatcactatgcaatctcttgcaatacttacaagctgtcttttttgttcaacctttgccagcttttctgtttcctctgtgtgaaacctaagtaaatgtttggttataagggatttccataaatctatcaagtaaattctcaagctatgcaaaaacaaaaatataaacaaaaacatagtgaaagtcgtagcccaaggcataccaggctgtatcatcatagataacgtgtcctggagagaccgcacaaggggctccatcttcattacggaactcatcacatgcttccagaaatattcttgctgctgccacctaatggaaatatttcggaaggtaagcttccatttccttttctagtcatttacttatttgctcagaaagaatttatcattattcactaatcgaataaaaatgacacagtttttcaggcaagcaaaagtagtatggcacctgatttctgtcattcaggtgtttaaaatctgctttagagaaagaaaatgtcaatatatcccagaagaagagcaaagtaaaacaaaataatatcagctataagcttcctattttgggttataacttattaaaattcagagaatagaaaatattttgaaataatttttgttaatttactaaatgaataaaaactggatggagrtgaggggcttcatcctgatgacaaaggggtaaatgaggcttgcatggcttaagactatctaggactcacacttttgtgagagatatggatactgaaaatatgggttaacaaaaaaatgtgcaattacagattgtggtagaattcataaaggcatgtaacagggaataaaaaagaaatcactctttccatgggaaagggcagaagggaaggtttgctactccttgcccaacttgggacattccttattccccatccttcctactttattttctccacagttcttacctcctcccattaagcatatattaatagtttatttaygtgtctgttttttacctgtatttactcactaatatgcaaacttcaggatggcggggatttgctcagcacctcaatatgcctgacatatagcagacattcaattaatatatattgaataaatagatgcatgaatgaatagataaatgttccttctctttttaagggaaaataggattggtattaacacaggaaagtgtggttgtttctaaattaaaaattatagagaacagtaaaactcttgtgggaaaaggaagatataccactggtgtttaaagaagattgtaccataaattgagatggggtttctgtgaatagagaactgggaagttaaatccttttggatgattaggaattagacattgtacttttgagggtattcctgggaaaagaactagaaatattggatttacggtaagcaggatctcattgatcagtccatgcataagatttcagaggtcagcatggtggtgtgggcatgaaagttgttcagtgttcaggccttaaagcaagattctgggatttarttctccttaaattgaagaatcagcgttggtgggggttgaaagtactaaatcttccatatccagttctcatgagcatatcccaaaggatatttaattgatttccacatccgtaggtcaaaaatggaaaatagagaaaatggaggttgaaaagccttgactaggcatgcagtgtttattttgatgtaaagtgtacagtatgacatggggtgtcaattctaagaggtagagtagcagtgttaaggagttggaatatccatgggcttggtcctatcaaccctggaagctctcttcattcaggcatttcctggttcatggtgtaagatgcattctgagaacccaaaatccctcatatctcatctactgttttttcttttaggtacagaaatcatttgaagttccacaggctaaagcccagatgcccaccatagaacgagcaaccttgacaagagatttctacctctttcctggcaattgaaaatgtaagaattgagagttgttggagggtgaaataaatgaaagagctatatcggtggtgaagttcaatgaccaatgacagctgactgcttatatggtcaagttagtgttctttattgatgtagtctggtgagtatttatttgctcttttttattctacttatatgcatttagtttccctcaactatataatcaatcaaagggtaaggaaaattgcagcaaaatgtaatacacaatgaaagtcctaggttagtaattattaaaataataatgtacaaatattaccattattaattatgttcatttatctctcatacactccctctctttgtctctctctctgtttctctcccacctgccacacttagttaccaaacagtgcatcagaccttgaacaaaacagagtaaacacaggagctatctatagggaaagcagggctttggtcctctgagtgcacatatcacattactgttgttgactttctccttagttcagctaaagatggggtccttgtcacacgaccatgagaaattagactcacagacaatctgaaaggtgaggagggcagggtttattgtgtgaaaaggaaaaaaatgggaaacagacccttcacagagccagagtcctgctaatgcccttcctgcctcgcagattgaataccaggtaccacccaggaagaggaggggccaggcttctccctgctgcaaatggcatgaacttcccaaggctccaccccagtgtgcattcttcccagtgcacagtctggtgggaggttctgccagggagccctttttacttggctgtctcattactgacattcagccacagttatgggactgtagaaaatacatgctcaactataggtactttattcaggaaaacctgccttgaaataatgaaattggaataaagaatgcacagagttggagagtgaatcatgtggttcttatgcaggagaggtgttccagcacagaatacaagtgcaaatgccctggggcagaaatatgctgaacaggtttaaaaagaactacaatgagatagtgtgaccaaaagagaatgcaagtgagggaactgacagagacaaattaggagaaacagtgaggagcctcatcacaatgtgcttgaacatcacatggtaaatctttaaaaaaatattatctgagtagataggaaacccttccagtgctttggaaaagagaagtgacataatttaacttaggttttacaaagatattcctgagtacttttcactaaatagacacagaggtcacagatggaagtcgagggaaatggcaaaagcatatggcagaagatggaagaagaatcataatgaaggatgggatgaaggcagtgaggggtaaccatcttgaccttctgtcctttctctcttctgcaggaaaccacaggcagcccagccctcctctgtcaacatcaaagagcacatttaccagtatagcttgcatagtcaatatttggtatttcaataaaagtaaagactgtatctttttagattgtatgaactgtatctttttagattctctaatagacaatataatttcaatgaaaatggtggacgagtgaaaatgaagtggaagaaactaactagattttcgagttttatggctcatgtaacatctatacttggctgatgaagacgactggctgtgacttaccgccaacaatagaatgaaagaagatggtgttaaaagtataagataccacctcatacccattagaatgactcccatcaaaacatacaaacaaacacaaaataacaggtgtttgcagggatgtagaataatcggaaccctgtgctctgttggtgacaatgtcaaatggcaccactgtggaaaacagtatggaagttcctcacaaaattaaagctagaattatcataggatccagaaactccacctttgggtacatccctaaaataattgaaagcagggtctcaaagatacacttatacacccatattcatggcaacgttgttcatgatatctaaaatgtggaagcaacgaaagtatccatggactgaaaaatggataagtaaaatattgtatatagatataataaaatataatttagcatagaaaggagggaagttctgacatatgctaaaatatagaggaactttgaggacattatgccaggtaaaataagccattcacacacacaaaaatacaatatgatcacacttatatgaggtacctagattatcagattcacagagacagaaagtagaatggtgattgccaggtgctagggcaggagaaaatgaagtgtcatttaatggttataaagtttcagatttacaagatagaaagaattctggaggtagatgggtgattgttgtgcaaaattatgaatgtattttaatactatttggctgtacacttaaaattgttaagcttgtaattttgttatggcattttactacgataaaaattgcaaaaatataatgatataattgaaagtgagaaggtatgagggcaacattaatcaacttacatagagaaaatttaactactgagcaacattgatgaaagaagaaattaggattaaatatattatttattgttccacaattaatcaataaaaagtatgaacatcatgacatcatcaaatattaggtagaatagaccagatatgtggctatgtaagtgagctgcatctcatttttcatatcaggtagtcaatggcattgtttatgttctatatttcgggaaacacagaggtataatagtcattattgagaattccaaatgttactgccaaacaaaacaaaacaaaaataattgaaggaaattacctctagtatgtgggactaaaggtggggagagttgtactgggaaatatgatttttattgtattcttttctgtactatggactgtctcatgaatgtattactttgacaaaatatttaaaattatattgaattgacacttttaataatttatagatttctaaaaatcaggtagtattgaattttaatgtgttgaatttttaaagggtttgtcctatgttgtgaagcaaagattaaacaaatggagcaaattgttgataatatatgatactggtgctataaggaaaaaaggtataggtaaatatgtgtctgccagttatttatttatgggtatcaaaacacccaaaacctcagtagtttaacacaataagcatttgctattgttcacaaggttaccagttagctaggtaggtcttgactctgctgagattatccatgtgtctgagatcacctctgcatggggtaggcatctttactgaaaggctgggatctctcatatgtttggaaagcacatggctggtctagaatgaccttggctggctggggcagctgggctcttttccacatgatgtgtcttattagccagcaatgtggctcaggctcgtcctcatttaggttcaggtgtccacgaggaagaagagcaccaggcttcataaagcctgagctgggaattgcacgagatccttctactgcattatgttggccaaaaccaagtcataagactgttacagggttgaagcaaaggtcaaggatactaggaagccaatgattaaggaaatcaataaaatcggtaatatattaagtgttttacaaaagcatagaaaaaattcagaaagatgcaagctaaacatataattggggttaccttgtgtcaaattaaagagtgtggataatccttttccactttacaaacttttctattgtttaattttagtggcaaacctatatttattattaaaaaatgatttaagtatcagtcttttgtatatttaacaaacaaaaaaacccaagtgagtgtgatagataaacaataccccaattgacacatgaacagaattggagagagaagaaaagagatcacttatgcgactttttgaaatagtgaagggagtatcactggcagccttaagtcagcctctgtcccctcaccttccaaatttatacttccagggttgtgcaggcaacagtggagtgagaactcccagcaatttagagactagtggtggtacaatgaaaaataggagtttaatttgagttattaacggtgttaaaaattgacaggaaaacagaacacagagacttatgtttgcatgtaagtgtgcatgcttttattatgataaatttgttatatcaaaaagagaattttataagggggaggaaaaatcacgcaccaaaattgagagtgcaaaacgataagacaaatttgggaattaaaaaaattgtatggttgcaatgtaaaagttgaagtatggtttgaaaagattagatgtactgatgaaatatataggagtaattatttgtcctggggacagtgtaaattattttagaatattattaaacaggggcgttatttatagtcagatttataattaagaaagatggcttgcagaatggacagcaggttgaatggcatacaggaagccaaaattgcctgtgttacaattctttgccaagactcttaaaactaaggttggatagaattagaattcgtaactaggaatcaaagtaaaaatgaattgggttcaaataatatgagttctttttctgttagtctttcatttccaaacgacttctctttccctccattcatatatgtagctatcttccattggagataataataatcagtaatgtcacccaaagagaaaagaagaatttgacttaaaaggggaaaattagacttaaaatatattaaaaaaatactctcttatctgccttgaagggcaggcattttctgaaataaagacaagaatttagtgaaactattttcctttacccagaaggatccaccccgttccttttttccctaacatccagtgaaagaagtaaatagtgttgacatatactcacattagcaagtatttacacatattttgaaagttttaattttaaagacatggtccctgtaatcttttgccttgtaatcttttgatccataatcccaccatcatttttagttggagaatatgtataacaacagagaaaagtatgagatgctttttaacttttaattttggtgttatcacaaataatgaatgcacttacgagatacatgggatatattgatacagacattcaatgtataataatcacatcatgaaaaaatagaatatttataccctcaagcatttatcctttgtgttataatcaaattatccccttttagttattttttaatgcacaattaaattattttgactatagtcacctggggtgctgtcaattactaggtcttattcattcattctaataaattttgtacctattaaccattcccacctcctcctgcaaccctccactacccttccagcttctggtaatcaactttctactctctatactcataagttcaattgtttttatttttagattccacaaatacatgaaaacatgtgatgtttgtctttctgtggctggcttgttttgcttaatgcaatgatctcccattccatccatgttgttgcaaatgacagaatctcagtctttcttatggctgaatagtactgcattgtgtatatgtaccatattttttttatccattcatctgttgatggacacttagactgcttccaaatcttagctgatgtaaacagtgctgcaaaaaaatatgggagtgcagatgtctcttcaatatactgattttctttcttctggctacataccccgaagtggaattgctggattatatggtagctttatctttagttttttttgagaaggctccaaactcttcttcatagtggttgtactaatttacattcccaacagtgtatgaatgtttccttttctctgcatcctcaccagcactgtttattgcctatcatttggataaaagtcattttaactggggtgagatgatgtatcattggagttttgatttgcatttctctgatcatcaatggtgctgaatatcttttcataagcctgtttgttgtttttatgttttcttttgagaaatatctatccaaatcttctacccatttttatttttttcttttacccatttttaaatcagatcattagatttttttcttatagagttgtttcagctccttataaattttggttattaatcccttttcatttggagagtttgcaaatattttctcccatgctgttggttgtctttcaccttgattattttctttattccacagatgctttttaacatgatatgattctatttgtccatttttgcttttgtttcttgtgcttgtggggtattactcaaaaaatttttgcccacaccaatgttctaatagtttccctaatgttttattttagtagtttcataatttgaggtcttagatttaaatctttcatcagttttgattttgtttttgtatgtggcaagagataaggttatagtttcattcttctgcaaatggatatcctgttttcccagcaccatttattgaaaaggctatcttttccccagggtatattcttgacacctttgtcaaaaacgagctcactgtaggtgtgtaaatttgtttctgtgttctctattttgttccattggtctatgcatctgtttttatgccagtaccatgctgttttaattattatagttctgtagtataatttggaattatgtaatgtgattcctctagttttgttccttttgctcaggatagctttggctattctgggtcttttgcagttcaatataaattttagactcatttcacctatttctgtaaagaatgttgttgggcattctttttattggacagagatggcatttggacagagatggcattcagtctgtaggttgctttgggtagtttgtacattttaacaatattagatctttccattcatgagcatggaatatcattttatttttgcgtcctcttcaatttctttcatcagtgtattatagttttcattgtagaggtctttcccttgtttggtgaagttaaatcctaggcatttatttaaggctgctataaatgggattactttttaaatttcttttttgaattgtttagtgttggcatgtagaaatgctacagatttttgtatattgattttatctcctgtaactttatcaaatttgtttatctgttctaatagttttctggtggagtctttacgatttccaaataagaagaaaatatgatctgcaaacaaagataatttgacttctttctttttaatttaaatgtcttttattttattactcctgccattttgttatttgttgtctgcttgttttatgatcttatcttccttttttccttttcttctgtcttgcttttagcaaaggtgattttctcttgtagtatgattcaattttttgctttttactttttgagtatccattgtatggatgccatgaggtctgcaaatactatcttataactcattattttaaactgataacagctaaatactgattgcataaacaaacaaccatggaaaaagaaaactaataaaaactgtatactttagttgcatcatctcaatttttaactttttgttgtttctcttgatgtcttcatgtactgtctgcatcttgaaaagtagtcgtagttattatttttgattggtttagtctttctaattaagagatgtttacacatcacaattacagcgttataatattctgtgtttttctgtgctcttactattaccagtgagttttgtatcttcaaatgattctttcttgctcatttaagtcctttttttcagattgaagaacttggtttagcatttcttgtagaacatgtctggcattgataaaagccctcatcttttttttgtttgtctgggaaagtttt

SEQ ID NO: 18000 - DNA, 21936 bp, Homo sapiens
  misc_feature (1)...(21936): n = A,T,C or G, or insertion/deletion polymorphism (see Tables 1-2)
caggacagcgagaaggcgctttcgcagcgccctctgctaagagtcgggacgggctctgcccgagtgtagccacaccgcccccagcctcaactcgccttttccttatttcatgggcatccgttctctctggctgtcccacatttgctctgcactagtcagtcctttctgacgctgtcaaaaccagtttccccagcactctgtctcgggaaaggcgtcccttcctacctgcagctcgtgtagcctcgacagcccccccttgcagaaaagttcggccagaaagctgggcgtagaggggcctgggatgtctgccaagctccggcgtgctgagtggtactctcggtagcctagggaggcgcccaactcgggcgcccagcggacgcgatggaacactctggaggcgtacttgagggtctgggtcatggtctggttcagggtgctcgcgaaagaaagcgcttctcctgagcatcatatctcaacccctatttaacctttgggtgaggtgatgacgccccctctccaagctcctcagccaatccctcctcctgagtggtctgtgctggggattagcacccaggaacagtaggcggggctggggctgacttcacaactcccttgggtctcatgttgcaatgaccctcatgggagggagggcctaagattttcctcctgggagagtgcctttgtctaggagcctcaaagtctcatcctaggaaaggctataaggctttttagtagggactaggtgaccaagctacactagtcagtctctgatattcccacttctaccagtgagcccagcccctttaggcccatcctcaggaattccccatctttcagctcctccaggaagggaagcaggggaggcacagctgtaactgtccccacattcttggcttagtgggttgtatcttctctgcattattttcctgcactagccacacctccccctcctcctgtacctaacatatactgggcagatggcaggtgggttaatgggctaaaatggctcctagaacctccatctttctttcttgaggataagggggtctcttgggtatacaagccccctccttccagacatgggaatttggggcttgagaagcagaaatgaaactttttgtacattagttaagttcagagattgtctgtggggtgttagaggagctaaatggatgtggatgttctaattccccagctgactcggtctcctctggggggctttctggttagcagctcctttctacttttagcctcagaatcctgtggtggctcatgcctataatcccagcactttgggaggctgaggcaggaggatggcatgaggccaggaggttgagacaagcttgagcaacatagcaagactgtctctacagaagaagtttaaaaattaggctgggcacggcagctcatgactgtaatcccaacactttgggaggctaaggtgggcagactgcttgagctcaggagtctgagaccagcctgggcaacatagtggaactgtctctacaaaaaatacaaaaattagccaggcatggtggcgtatgcctgtagtgccttgagaggctgaggtggattacatgagcccgggaggtcaaggctgcagtgagttatgattgtaccactgcactccagcctaggcaacagagagagggcctgtctctaaaaaaaattaaaataaaagaatctcccacagtttacctctctgctccttactccctcattccccactgcaactctatcaggctctgtgccagtcagctagctctgaagttctggaattgaaggtcaatgtgaaaaaggagagggtctccacccccacaccttcccaaggactctccagagacaacacttagggaacacagattccccaggtcaagtcttacgcagggagaggacaggaggatggtagaaggcatatgatacatactccaccctttcctgagaaatggcagaataggcatgtgtacacatatacatgttatcccaggatccacaaagcaaacagaagtggtaattgagcctagcaagcagtttagatggactacattcctcattccagctgaggagagatctcacaaggagaaaggagtgctaaggaagagcaagaccccacagccttccaaagatcccctatggtccaaagtcctttgaccatctcagtcagctgctttgttttctgttggcagtggagggacaaggtgagaggagccaggggtagtcatgaacaccagtgggttctgccctgggcagctccccaccttctttaagagagtactgtgtctcagctccagcagtctcaactgggaagacccaggactcctgctcttttctctaatccctgggagacgaggtccagctaaggtagagtaagcagtcagtgaccaggcaggctggtttgggaggtcactgcctggaggacgggatcttgtattcttcggaagatggctgggaaattcttccctccattacgtagaactttcttcccctcctcagttgaggtgcctagatgtcccacaacggggtcttcactctgggagaaggaagggtccaataagtccttgcccactgttcagactgcccctggcccttagacacctatcccatcctcctggcactgagttaagtccaaatacagaaccactctggaaagggcctccacctcctctaggtcccctactcaccaggtcctccagaggcacacgctcaaacagtgggtgctcttcgaaatgagtgcacatccagtcgtgtagctccagcacatcggttatggtatacaccagcccctgcataggcaaaatcaccctagacaggaggctgcatgcaacgtcagcagccagatgaaggaagtggtggtgtgagtccctaaatgcacccccactgaattcttagtgaagggcccctgagtaggccactcaccccatcatccctccgatcccaactcaccccaactcttagcacgtaggcatattctgctagcagggtgggactgatgattcgccacttgtgctttgtccgcttgaaatgtgggtcggggaagaggaagaacatctttgtcagctgtgagacagacacacaccaacagggttgtgagagcctggcctccatgcccccacctgcctaccagcctaacccaccagggcccctccccacctggcccttgtagaagaagttaggaaggtgcttcatggcattgctacggagacaggcgatgttctggaagccacctgcaggagctgcgcgtagggcccgaatccggtcttgtacatagtctgagaccttcacccggatctccagacccagaataagtgtgtctgggaacagcggtgacagttccactgcacacagaaatagcaatggaatcatcaaccatatacttgtaggaagtgcaaaggggtcaacacaggaaaggaagcctcaacctgcaactaccaaagtccagaacggcaagagaggacagagatacatatatggatagttttatgctcaagaggcggggggagaaatgaaaattgtcaccaggaccagaatgggagggctgaggatacatgtatatttgccattgctttagagttttccacagtgttttcacacattgtgttatttcatccttataacactctgtggtaaattgtgaagataaggaaactgagggtcagatatgccgaagatcatagagttaagaaggggcagaactggaacttatttatttgagatggagtcttgctctgtcacccaggctggagtgcagtggcacaatcttggctcactgcaatctctgcctcccaggttcaagtaattctcctgcctcagcctcctgagtagctggtcttgaactcctggcctcaagtggtccacctgcctcagcctcccaaagtgttgggattacaggtgtgagccactgtgcccaggcagaactggaccttaaaccaaggttttctgcctctatgtaccatgctcttcttctctatcaggctgttatctgtttgggaagatctaaaaatagggagtggcttggcatgcatgggtgggacaatacagacaatacaagaggaacccaaaaaacaggagagtggggcagaaggaatgagatctggcgagggaggggcaaaggggaggggagatggtagaatctctgagaaaagacagttcaggatcactggccacaacggctaatctctgatgcttgtgctgaccagctcactgacccggaacctggcagatgaaatggctcatgtagggattgacgccagaaaggacaacccaggttttaagaagcatttgaggcagccccctccactctccagggcaaaggtcacagacccagagtagagggtaggtggagcctctccatgctgatgtcaccagtgtctggacgaaaggggaaaggccaattatgaccccccacaaaagttgctgaggcagcagaagctactaggcctcttctcaccccaaaaagagggcctgagtgttacctaacaggccaccatagccacagcctatgtctgcaaactccacttgggcctgagctctcttttctttcttatcctttgggtcatcgtggctctgattttgagtgagtggagcgaagaactctgggtatagctcagaccagtccatctcctctggcttcacagggctattggaaagaagacataagaagcatgagaaggttggtcacaccattgcagaagtggtactgtgagagtgtgtgggtgggtgagggtgggaggtaaaagggaggagggtttctcaaaaattctgtaacactgggccctgtggcctctaagagggacaatggaaaccacccttaactcccagtgtgaatcataggaccatcatgaggcccataaacgctgacctgcccaactccacttctggcggttgatgtgaccctggccgggtaactgccctttctggggcacaagttccccttctcccgagactggctgcctaatgcactgggatcctactttgtgtttgtgctctgcggggagggaaggtaaggtaaggtgcgggcaggattgtgtatatgtttgcctttttattaaatccaacaaacaaaagcaaaagatggaaacgacattctgcctctatcacttcagtctcagtaacaatttatttctcttcccaaacttagcaccgctacccagacttaggcccgaacgccacgcccactctcaacccgccaactcctctctcggtcgaatctcccggtcccacccccaaaaactgacgtcacccatctgatcctcccgggtctaccccaaatcctcccagcagttgcagcacaactgctctcccggctgctttgagaatcccgccctcctctctctccctctgcccactcctcactagcgcagcgtgtggtccgccatggggttggagtgagcacgttgccggtagtagcgcttctggggcggtggggcctctgctccggccacgttccgagtctcggctgccatgatcccagtccggggtttctctaccaaatccacgtggaggcgcaggccagaggcgcaagttaatgacgcagccatgcgcgttggtggcagttcccgccccttaaagacccaagagcaaattcagctgggctgggctgggctgggctgggctaggtggggagggctgtaaggagcgagtgctggagggaacctccgcaccgttagcctccaactgggagggcgaggccaggcccagggacccaacgttttctcttagcttgcttctgcctggtctgggttaccatcctggttgcaggcacctgtgcaccccacaggtgagaggggtctagagacctcgccttctacagtggcatcagtcctcgctcctgtccccttactcctggtctcggaccagtccgcccggtctgactcttgtggtcccgtgtgggtttcgtcgagtgtgcgctcggggccggggcgggaggggcagctcctcattccacctccaggaaatcgaactggaggaaggagggcaaactcagggaggcggggctcgttccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactyggagaagagccagttctgtttctgtgggcatgtgctgaccatcacgcagaactttgggtcccgcctcggggtggcggcgcgcgtgtgggacgcggtgaggaatgggctgcgccgggtgagggtccgtgggaggtccagatcccggactccgcctctcccatatggagccatcctcacgactgtctttttctctgtcttttctcccgtaggccctgagcctgtgcaattatttcgagagtcaaaatgtggatttccgaggcaagaaggtgatcgaactgggtgcggggacaggcatcgtggggatcttggcagcgctgcagggtgcgtgagctggctttttacgggagagagtggggacccaggggcgcggagaaatggtcacttcgtggatctttgggggagaggggagaactttgggcccagtctaaccccttctttttaacaaatttttttttaaaatttgtttttgtttttattttggcgtctgcttctgcgtgccagacagcgcgaattgcctgtcaaagcacctagggtgggtgattggggagggcaggaaataaaactcaggcaggcctataagaaggagttgtttctatcgtgttgctttttttttgtttttaattttttttgtttttttgagacggagtctcactgtgtcgcccaggctggagtgcagtggctgctatccccactaactgcaaccgctgcctcccgggttcaagcaattctcatgcctcagcctccgaagtagctggaattacaggcttgcgctaccatacccggctactttttgtatttttagtagaagacgtttcaccatgttggccaggctggtctcgaactcctgacctcaggtgatccatctgcctcgcgaggcgcctgggattacaggcgtgagccacgacacccagccttgtgttactctttgtgattttatggagaatactgtcacttaaaagcgccttggctttggacatggtcttctgtcaagatgcacatatgggggtactctgtagggagacttgcagacattaaacttcgtgagtgctttataactttattatgaatatatttcagattccttaggtttttattgctaagagaaacaagcttatgagtttccaagggttaggatgtgttttgtaggaagcggggtaggaattagacactgcagacttggaaaaggaaaaggtaaggraaaatttgcttctcttttgtcaagaagcaaaaactacagaggaaacagtttcacaaattataatctaatgggcagaaaaaacctcaaactgaaagcactcgtttaaaaattcttacaatgtcatctccctaggaatgtaaattaacatgtctttgttcatagggacagaactaggtcatattaagggaagcctagccgggcgcrgtggctcacacctgtaatcccagccctttgggaggccaaggtgggtggatcacctgaggtcaggagtttgagaccagcctgaccaacatggtgaaaccccatctctactaaaaatacaaaattagccgagcatgatggcttatgcctgtaatctcagctacttgggaggctgagacaggagaatcgcttgaacccgggaggtgaaggttgcagtgaactgagatcgcaccattgcactccagcctgggcaacaagagtgaaactctgtctcaaaaataaaaaaagggaaatcttcccagaggcaggcattcattcttctattcattcaaccaaaatgtatttcaagtcccctatgtaccaagaatcatgctaggtattggggattcaacaataaataagacagattttctctccccaaggagcttatggtctagtgagggagacagaggacgatgtcatagaacaagaactctggcgaggtatgcgtggagcctgtggacatgctctatccatgtctaccatgactccctgggaatccatcaagggaagctctgtcaggtgaggaggaggtgaacagtgtgaacacagcaggctcagaaacactggagggtgccggccgggctcggtggctcatgcctataatcccggcactttgggaggccgaggcaggcggattacctgaggtcaggagtttgagaccagcctgaccaacatggagaaaccccatctctactaaaaatacaacattagccgggtgtggtggtgcatgcctgtaatcccagctacttggggggctgagaaaggagaattgcttgaacccgggaggcggaggttgcagtgagccaagattgcaccgttgcactccagcctgagcaacaagagtgaaacgccatctcaaaaaaaaaaaaaaaaaaaaaaaaaaagaaacagtggagggtgccaacagcagtttttgcatgaagcatgggtggatgcaggcagttatgctaaaaaggggagaaaaggcatgcggtatggatgggaacacctagcttcacttgctcccagactggcttctccttctttgcctcctatttagctgtcaagtcagaaagctggatgtcatcttgtccctcactttctcccctcacattccagcaatcacccagtcctatgagttaaatgttcttttttttttttttttcctttttgagacagagtctcactctgtcacccaagctgcaatgcagtggcatgatctcggctcaccgcaacatccgcctcctgggttcaaccgattctcctgcctcagcctcccgagtagctgggattacagatgtctgccactatgcctcactaatttttgtgtttttagtagagacagagtttygccatgttggccaggctggtcgtgaactcctggcctcaagtgatctggccacaacttccagttgtctggggaagtattatcttttcagcatctctagttcaggccactggcatctcttgcctggattttcgcaagggccttcaagcttcttctggggaagtgtgacatacccaactagatcttgtgaccttcctccaccaaacacatttctccctcagacttccctatctcagtgaatcaaatcactgtgcacccagtgggaaacctagacatcacctttgacacgaccctctttctcacctacatgtccattattcagtttatctcctaaaaatttcttaaatcttctcatgtttttccatctccattgacagctccccagtccaaaccaccacgatcacttgcctggactactacaacagccacacttgtcttcctgctttgactccttgtcctcacctagacctctgcccttccacctagtggtcagagtgatcttttcaaaataaaactgtaatcatgtattcccaccccaaatctttcagtggcctcttgttgctttcaggatagaaccaacacctatggcatggcccccaaggtcctgcctccctctttctgtgcctctttctctcttgtttttcttgggctgcctattgcctgtccatcagttcctcaaacctactctgatgttcccttccttggggacttcactcaggcttactttctgtctgaaactttttaccatctgcttaatgcatatgcatccctccttcctcagctcaaacatcacttcgaagggaaggcctccttggcactcccactcctaggctaacttagaccctcccagtacatacacaactgtgctaactgggctaattttaactttgttaccattggccttaggtgggtcctaagtgcttcccagctagcctggtacattctctcgtccactttttctgccactctcctgaacaactgtttcttaccttcttattcctcaaacctccacatgcctcttctgccatcttcaccctcacctgatgactttgtttcctatctctttattttattttattttattttattttttgagatggagtctcactctgttgcccaggctggactgcagtagtgcgaccttggttcactgcaacctctgcttcccaggttcaagtgattctcctgtctcagccttccaagtagctgggattacaggcacgcaccaccatgcctggctaatttttgtatttttagtagagatggggtttcaccatgttggccaggctggtcacaaactcctgacctcaggtgatccacctgccttggcctcccaaggtgctgggattacaaatgtgagccaccgcacctgggctgtttcttatctctaatgattgcttctgttttctcagaaaatgtccatatatttttatcacaacatctacttatgtgactgcatctgcatctgtgtgcagtgccttctctcctgttaccatggatgaacacattgtgctagctaaggtcaagccccccacttgtcacaagaccccaaatctttctgcctactcaaagacattgttccagcaacacccacccccatctctcctgcattctcagtttttccttttctttggatcattccatatatagtaatatatggaatataaaatgcatataaatatgctatgatttctcttatttcagaaaaaaactcttgatcctacatctccctccagctatcactccatttctatgctccactttaaaacaaaactcaaaagagttaatattcagtgtctagttcctctcctcctattctttccttcaatccaattgttctagttaaggtcgtgagcttcatttccaactccaggttgttaaacgcaggagtcagttatcagcctacctttgataactttgcatttgatgctgacactccctcctccttggaacaattcctttggtttccaggggaccacacttctggtttctgcttaccggcaggaactccttttccatgctctcttgttggttctttttcatcttcacaactgaaaatgtgagtgccccagggctcaggggcagtcctttgatcccctccttttcttgtctacctcactcctgagcagcccatcacctcatgcctttaaatgtcctgttgaagccggacgcggtggcttacgcctgtaatccgagcactttgggaggctaaggtgggtggatcacctgaggtcaggagtttgagactagcctgaccaacatggtgaaaccccatctctactaaaaatacaaaattagccgggcgtggtggcaggcgcctgtaatcccagctacttgcgaggctgaggcaggagaattgcttaaacctgggaggcggaggttgcaatgagccgagatcatgccattgccctccagcctgggcaacaagtgcgagactccatctcaaaaaaaaaaaaaaaaaaatgccccgttggtgatcatgactctaagactatcccatttctatctccagacttgcttgcataacctagtgcctactcagtatcttcatgtggttgtctgatgtgatatagaagtccatgtcaaacttaacgtgctcagaaaatgaactcatgatcttcctgtccaaattgcgcctcctgcaacctttctcatctaaatgagtggcaatttggtcttctagttggtcaggccaaacacccagaaaccatcctgagctttttttttttttttttttttttttttttttgagacaggttctcactctgttgcccaggctggagtgaaagtagcacaatcatggctcactaaagccctgaactttcaacctcccgaggctcaagcaatcctctgacctcagcctcccgagtagctgggactacaggatgtgccaccacacccagctaatttttgtattttttatagagacgaggttttgctatgttgcccagactggtctcaaactcctggactcaagcagtcatcccgcattggcctcccaaagtgtaatccaaagggattacaggcgtgagccactgtgcctggcccatcccaagcttttctctctctctcatattttatatccaatctattggcaaatcctgttgactctaccttcaaaatatattcaggatctgaccatttcttagccattgctactgccctggtttaaaccatcatcatctctcacctgagtcattgccatcacctcctaactggtctcctagcttctgaccttgccctcctgtactcttctcatcatagcagccagcatgctcctcctaaagcatgccagcgtgtgccattcttttttttttgagacagagtcttgcacttgttgcccaggtcggagtgcaatggcacaatctcggctcattgcaaccttcgcctcccaggttcaagcgattctcctgcctcagcctccctagtagctggcattacaggcgcccgccaccacacccagctaatttttttgtatttttagtagatatggggtttcaccattttggtcaggctggtctgaccactcaatttaaaatttcattctccagccactcaatttaaaattacattcaggctgccaagactttgtcctctatgccctggggtctctggaccttccaggtaggagccgagaacccttggttggtccctctaacttgcatttctccccatccctcaagcaattcttatcccccttccctgcttggggcttcaccatggcatatattaccatctgatgtacagtgtattttattttatttattttgtttgttgttatcatctgtttcttgccactggaccataagctctgtgaggggggattcttatcttcttagttcatcattatgttctcagcacttggcatataggcacataataaatatgaatgaatgaatggattcctagtacttcttgcttctctttctatcatagtcatcatgattatgatgcagtacctagtgtgtctctacctctagaatgaaacaaagaaagctgtgtttttgtcttgctcaccttatatacccagcacttagaaggttctccaaattatatctactgcatgaatgaaggtttctgagatgctaatctgaccatcttcacccgtttctgcccttaaagcytactgccctcagtatcgaacctgaatcttcttagcatgtcataatcactttccctttgtctcatgtcttgacacttttctcccccttccacatcctctaagatgcagcctttcctgaatatgccatgctctttcactcccaggcctttgtactcactgttctcttcttggaaagctccacctgactaactcctacttgtcctttagggctcagctgaggtcacattttctgggaagctttccagacccttaaggcgagcttgtgtcagtgggggtgggtacagaacccatctccagcttagtcctgcccaggcttctgctgacatctgattgttgtgtgttggccagagaggttgaagattagctcagagagaatgttgatgttgtagaatgtagagtaatgagaatagcagtgggtgaaatggaggttgaggcaactaaaagccagtgtgggctctgggctgtcaagacattgtcctctatgctctgaggtctctggaccttccaggcaggagccaagaacccttggttggttcctctgacttgcatttttcctccttcctctctctcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcaygggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaaccyaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttacccacatttcttgtgttgttgttttgtgacgactttatttcttggtttctgttattttacctggggtgggaggtggggggtaattcccgtatgaaatgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacactgtccgctccctaaggtcgcttccctgcccgtgtacccttcaccctctggagtttgctgcttcctgctcctcatccctttcttatctcatctaggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggtgtgtgtgtggaggggtgcagggcggagtactagagctcgacctcagactcttggggcggtcacgctggggagcataaagttagactgctcttcagtgaccataatggcacagtcctaagtggaaatctggcttaaatgacaaccttggccttgactttgtcttatttgaaagcagttgagtatcccaggattaacaaaccagactgttacggtgtttcttgttgcctggagctgaaagggtttgtgtgagctttggagtcagattgttcaggagtcaaattgtggggcccccacactgtctgactttagactttttttttttttttcagacggagtcttgctctgtggcccaggccggcgtgcaatggcacgatgttggctcactgcaacctccgcctcccgggttcaagcgattctcctgcctcagcctcctgagtagttgggattacaggcgtgcgccacgacacccggctattttattttttattttttatttttttttgtatttttagtagagatggggtttcgccgtgtcggccaggctggtctcgaactcctggcctcaggtgatccgcccgcctcggcttcccagagtggtgggattacaggagtgagccaccgcgcccggctgactttagacatcttaatctttcagagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggtaagtattgtgtatctaaacatagaaaaagtacagtaaataggcataaaagataaaaaacgatacatctccatagggaacttatcatgtatggagcttgcaggactggaagttgctctgggtgagtcagtgagtggtgagtgaatatgaaggcctgccttaggacactatggtgcactatagtagacgttaaagcacagtacacataagctacattacatttataagaaatttttttctgtgataataagttaaccttagtttaatgtaacatttttattttataaacttttaacatgttttaaatttttggactcttttgtaataacagcataaaacacatattgtacagctgtaccaaaatatttttctttatgcactttttctgtgagcttttttctgtttttaaaattttaaactttttttggctgggcgtggtggctcatgcctgtaatctcagaactttgggaggctgaggcaagcggatcacctgaggttgcgagttcgagactagcctgacccacacggagaaacctcgtctctactaaaaaaaaataaaattagcctggtgtggtggcaagggcctgtaatcccagctactcgggaggctgaggtaggataatctcttgaacccaaaaggcggaggttgtggtgagccgagatcgtgccattgcactccagcctgggcaataagagtgaaactccatctcaaaaaaaaaaaaaactcactgaaagccctgcttacacctagcagaaatctcataaacttctatgcagatggaggctggataagtcaatcttcccatgtgaatttggtggactctaacagacaggcactaatacagaacaaaaacacaaaatatgatgtcaattcatattgcaatagtggattaaaatgcactaaggccgggcgcggtggctcacgcctgtaatcccagcactttgggaggctgaggcaggcagatcacctgaggtcaggagtttgagaccagcccggcnnnnnnnnnnnnnnnnnnnnctcaaaaaaaaaacaacaactttttttattgaaatatctttttttttttttttttttttttttttggaaacagagtcttactctgtcccccaggctggactgcaggggcacaatcttggctcactgcaagctccacctcccaggttcacaccattctcctgcctcagcctcctgagtagctgggactacaggcgcccgccaccacgcccggctaattttttgtatttttagtagagacagggtttcaccgtgttagccaggatggtctcgatctcctgaccttgtgatccgcccacctcagcctcccaaagtgtcgggattacaggcgtgagccacagcgcctggccaaaactttttttaagttaaaaaattgttttgttaaaaacggagacacaaacacatacattagcctaggcctacacaggagtggcatcatcattaacactgtgttccactttcacatcttgtcctgctggaaggtcttcaggggcagtaacgggcatggacctgtcatctcctatgataacaatgtttttttctggaatacctcttgaaggacctgcctgaagctgttttactgttaaatttttttattttttatttttttgagacggagtctcactttgtcacccaggctggagtgcagtggcgcgatagatcttggttcactgcaacctccgcctcccgggttcaagaaattcagccacccgagtagtttataagttggagtacactctaaaataacaataaagcatatgtattatagtaaatacataagccagtaacatagttgttcattattgtttcaagtatcatgtactatatgtaattgtatgtgctatactttaataggactggcagcacagacgttttctttacactagcattgccacaaacatgtaggtaatatgttgccctacaatgttaggaggactaccgtgtcactagacaataggaatttttcagctccattataatcttagggaccgtcatcatatatgcagtccgtcattgtccaaaatatcgttatgtggtgcgtaactgtataaagaaaatacaactgtgtgccccatagggttgttgtgaagattagattcatccaaggcaccagttataataatacctggtatttggcatttagtggtagactgccagtaaatgatagattactttagtttctgttagagaatttagagaatcaggaaacctgagtatatcttagaactacatttagtgctaaattctgtgactttgttgtctgctctttttcctctcaatttacaggcagagatctggctccacaaggaggcccagaaggagggctggagcaaagctgccaagctccaagggaggaagaccaaagaaggcctgattgggctgttgcaggaaggaaacacaactgtattagtagaggtgagttgttggaaattccagataccaagaacagctgtcccttgggtgtaaagcttgtagtaggccctaaaggggcctgttcttgaagaagagatctgtttaagaaccataaagcgtagttgaagttaaactcatgaaaccctgggtattagttacgaattcgtttaagtatagaaatgtactggtgtgttgatgagaaatggcctgacagtctagaatattactcctgaatgtgagtctggcacaggcttacaccttgtcactgattgtttcctggaacagttagattacaagttaattatattaattgttgctgaatagagagtaggtattttagaggaggtttgggggccataattggtgaagagtcagatgtggattagtttagagtgagagatggggataaacaagataatagcataagtggtttggagttgggatggctggagaatgaggtgatgatggtgtgcagacataggtaagtggtgaacttgtggtgagtccttcaggacattattgaaccatcttctgaatatacaggctattgctaactcactggcccaacataaatcacttcattctgttccaggctaggagaggaagcgtagctttaaaattttggagtcattttttttccgttgagtctgtagcttgttctatcagtatcttgatttattctccagccttaaggcacttttggaaattatcattaaacagcttatacagctatatcaatttgttcccacaggtaaactgtgagacagattttgtttctagaaatttaaaatttcaactgttggtccagcaagtagcccttggaaccatgatgcattgtcagaccctaaaggatcaaccctctgcatacagtaaagtaagtttgggatttgtctccagtgtgctgaatttgctgtcctcattgggtcttttgctgttcctattgtagacattctcatgtctcattctgttacttcacatctctgcttaaatgctatctctttgcatagaattacccttcccccgttgctatatccccgtgtcatgctgcatttaaaattttttattatggtgcttatatattacattttaatttatctgtgtgttgtctatcttccccagcagaatgtaagctttatgaggcagggaatttgtcttttcactgttgtatctctggtgaaagagaattgggcccactacttagttggagctcagtaaatctttgtcagatgaatgaatgaatgattgaatgcatgcatgccagtgaaatggagttagccagatcaagtgaagccatttgaggctttgtgttcagaaatttggaatggtcttaggaaagaatttctaaataaagagattggagccaggtgtggtggctcacccctgtaatcccagcactttgggaggccgaggcaggcagatcacctgaagtcgagagttcaagaccagcctgaccaacatggagaaacccgtctctactaaaaatacaaaattagctgggcgtggtggcgcttgcctgtaatcccagctacttgggaagttgaagcaggagaatcgcttgaacccgggaggtagaggctgcagtgagccgttgtactccccccgggcaataagagcaaaactccgtctcagaaaaaaaaaaagagagagagattggaaaagacatggtttaggaaaataagcatattcttatccatagagggatcaaggaaaggaattatgtcattctgcctttgactcagccttattgccaaggcaaagatgaaccaaccactcacagtaatttttttgagtttattaccaactttttttatcttctttatccttctcttgagatgtcttggtaaatgttaattattattggcattacatagtcatatggaaaacaatgttgagattattttttttaattgtattgagtaggtaagtcacttgaactagaaatt

SEQ ID NO: 18001 - DNA, 31134 bp, Homo sapiens
tgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtggtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttgggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattcaaaaacttgaaatgcaggacgccattaagtgtctgtttatatttttggaatatttgtattacttacaattaattaataaaagtgggtttaaaaaacctttccaggaatgtgagctgccaccaaccttcattggcccttaagtgttcactgggcccatggcaagcaccgcctttcttctcgcaaccccttccatcatgaagcagctgcacccccgggctgagtggggtgttgcacccaccgggaggccagctgcagatgccacacagggcttccgctcaaggttacacaagttctgctgtgatcaaccccattgcagtcaggtgcttagcacgtgtatatgcttgatgtcctattgacttctgggcatgaaccagaagccctaagggaatggattattttttttttttttttttttgaaatggagtcttgctctgttgcccaggctagaggcagtggcatgatctcagctcactgcaacctccacctcccaggttcaagcgattctcctgcctcagtctcctgagtagctgggattacaggcgcctgccagcacgcccggctcatttttgtatttttagtagagatggggtttcaccatcttggccaggctgttttcaaactcctcacattgtgatccacccacctcagcctcccaaagtgctgggattacaggcgtgagccaccaccacacccagccctgggaatggagtcttgattcttctctgcccctcactgattcttccaaactggaaaccctgaagctgagagcccagcatggttcctggcaaacagcaggcactcaaatattgattggtttactgtatgactagtagagaccccaacgagcaaaactgtggcctaataaaattctggctcctctcccagacttcccctccctttgagaaatgccagaagcttcttagggaggctcttgccaacctagacatcacaggcactcatggggcagctccagcctcttcctcctgtcatcaccataatgcatccatatctacaatatggcaaatttcatatccttccaacctctttcctgcattattgatgggctgtgtgcactttttaaaaaatcaattagatcagggcgtggagctggagttcaaagaagcctttaaaagtctgctcttctgttttgctgttttgaataggcacagataaagctttccctctggtttgaataagccaagctcagtgctaggttggctctgattggccaggactaggaaaatgcggttaagatgcaaacacaagcaaatataacccagtatctctgcggccattactaagctaaggcagcaggacctggagcctcctgctttggagtggttcttcaatactgctgctgcttacgcgccgggaaactgggaaggctggtgagcgagaaggcaaggtaaggtctctgatttacgggggcatgccagttaatcctcctgaatgaggaagaaatgaaaggaagaggagcttgagagtcccttggctttgtcttctgagatgaggcttttaaaatgaaccaggagtctggctggccagttttgcaaacttcttgttcagaagaaccccttagaggcagctgaacatatagggcacattttcaaaagctgggaaagacagacccctttcacctatccctagagaaagatggtatggagcaaggcaggaggagttaaaaccagcttcctggcccagagaggtggcttacacctgtaatcccaacactttgggaagccagggcatgaggattgtttgagcccaggagtttgtaacttgtgaccatcctgggcaacatagtgagaccctgtctctacaaaaaaaaaaaaaaaaaaaaaaaaaaaaagccaagcatggtggtgcacacctgtggtctcagcttctcaggaggctgaggcagaaggatcacttgagcccaggaggtggcggttgcagtgagccgtgattgtaccactgcactccagcctgggtgacagagcaagaccctgtctcaaaaacaacaacaacaaaaaacagcttcctctgctcagggtccgtccaaaagggcatctctgagaattacaggccactggcttttaacctgacatttcaaaactgtgccccacacccaaggggtttctgcagtcctctcaaaggatactgaattaggatttagggagaaggagagacccagctttgggagatttgatgtcagaactgtgttttctgtgtgttccagtgtgacaggaagtcccttcctggagcttatcctctcgcattcggggtgcctggcccagggagctccttgattcctaaattcctgctgggaaacgggacaggtttcagcctctgaggctcacagtcctaattgctgccggctggtttggcttttaccagggtgacagttctctgtctccaaggaatgaattcagtggcccttgtccccttcccctagttggctcatggcttttgcctttaatgactgctacgtagggtctgaagaaaacccaaacaccatatttcctggcaattctgagcagcacagggtggggcagcacaagttatcaaattaaattctcaaacactggctgctccgcaccattgccttgctttagtcctgctacagcagtagacaaagcgagtctgctttgagctttatggttttttgccaaagtccatactagatggcgcatgctctccaaacttggctttgtccatcaaggttcaagaaaacaatggtcagacatgttcctcttaacaaacagtatgtccccaaacagcaaaaatgcatacagtcctttctgggtgaatttttaaatcttacataaatccatcaaccccatcctttttcctttgcctcttgggagaaattaatctagctttacattaattatgcatgttatcagatttcaagctccttgagagcaggtattttaattctataaagcctctacgtggccttggacatgggtaggtgcttaattacccaagatgctccttgaatacagatggtacacgacctacacagacttagatctttaccacttcccccctctccccaccctgacttgctcaatcctgaaggaactggagacgtctaagtgtctgaggttcacgcttccacacagaagcttgggtctgtgtgggagggaaaaaggaagccatctgtccgcaggccagaccaggccacaccctgctagcacccagaaccctttgtcccaggcccagccctgccattttactttccttgcatctggaaagcacagggaatatagtagtgacaaaagaaggaagggttgtttgagtttaagaatagtttactctaaaaaaaaaaaaaaaaaaaaaaaaggacaaaagccaaagagaaggtcaaagttgactgtggagaaggccttgcaagcagggaacttgggaagaattggaatgagagtgagagaaggcaactgagtttggaaatattttttctgactagcttttctttccaaatgccactgaacttagattggtttaggaagggttgtagtacatcaaagtggctagaagcacaggtttggggatcagataaggatttcattctagagtgtgatcttgtacaagttattcagcctttgcaaacctcagattcacacaatgtaagatgaagaaactcaccttctgaaaattagagataacatatgcaaagtgaatcaatacagggcttaacatatttatcacccctttggtaaataaccatgacgattaccagagctcttaagggcaatggcaggtgggaagcagaactcatgggtggtaatccccaggccagccaggctcaccatgtgcacttggacaagtccttgcccccatcattgtgaaatggtgcagggatgcaccatgagggtgtggcaggatggctgacaacagactgggaagcagctcggcagaaaaactggattgatgcccactatggcaagagatatcatctcccctcttgttctgtgatgtttcagtcctggaaagacaagcatcatgcctctgaccagtgccttcagggctgtggacaacgaccctgggatcattgtctggagaayagaggtgagctgggctggaggcaccttacttgtgaccactggcatctggaagcagtctggctgcctggggctgctaggcaacagcccgccagcaccccttagcctatggtttgaggagaatgagaggcagcatcaaagtacctatttcccatccttcacctctcctgggtgctcaaagcaggtggttggcaggtggaggaaatgttcagccccgaagaacagggctccagacaaaaacaggcttgtcctttagccagccacctgctcagtgagtctgcacttgcaggaaacaccctggaaagacaggtgggacctactcagcagactcctggcagcttccatcagagaaatggaacatgtcttccacggggcaccctggctcctacaaaatatggggagaggtgagggggcactgcagagatgaggagctgttcagcccgtctcctcttgggcttgggaccctctgtgcggctgtgagctccagcaatccatagctgggaaccaccctggcctgggtagctccacctgccagatacgaggattccccccaacccctgccctgagcccagtcagttgctgctgcctaaaacccagcgatgatgcctcacttcactatcctcaaccaggagggggagtcagctctccagcaagcctcgcagagattgtgagtcccaggtcacttccactgtttgaaggcttccagtttccttaaaaactaacaggtactggcggggtgcggtggctcacgcctgtaatcccagcactctgggaggctgaggcgggtggatcacgaagtcaggagattgagaccatcctggctaacacagtgaaaccccacctctactaaaaatacaaaaaattagctgggcatggtggcaggcgcctatagtcccagctactcaggaggctgaggcaggagaatggcgtgaacccgggaggcggagcytgcagtgagccgagatcgcgccactgcactccagcctgggagacacagggagactccctctcaaaaaaaacaaaaacaaaaacaaaaaacaagtactaaaacacggttaccagatttgcagtatatttaacatttatcacattttacatagaacacacacaagtatggccgcaagtttccctcacttggggagtgtgatgaaaatctacatcaaggctgtgtgaacagtcctccagggccaagccatacatgcagtgataaatcagggccctgacccagactccaaatataagacacttggcacagagccctgctgaccgctggcactctccaaatgttatcctccacctcccacggccccacagaatccaagtgttctttcttacatgggcctgggccagcacccagtggtcagcgttgggaagagcgttggaggtgctggcacaacggctcagagaagggtttgtacttggtcgtttatatccagcaaagggctggaggtggttcacaggtttcccacaatagtgcgagatgagatcgggtgggaagtagagtggagaatagggcaagggaaagcaggatagggaccaaggttcagatccggggtgatgcaagcagagctcacagaagccagagggatggccacgttaaycctgtggctggcagcctcacatcctgtaaggtcattgagaacatctcccctccttctccccaccacctgcaccgaatgacagagaggagagggaggctcatggggaagggaggtgggaggggatgtagcctatacccaccccttgtccttccagaaaatggagctggcgctggtgcctgtgagcgcccacggcaacttctatgagggggactgctacgtcatcctctcggtgagcaccctcctccccactcctgtgagcctctcccctggggccagttcttgggctgtactgggagatgtgctggtgagggaaggtagtcagtccctggtatcggtctcaatggttcctcagtgctatgcagagcagacctccagtctgactatcaaaggccatcattaagcctgggtttttaatgctgcataagaggatgggggtaggaccctcagtctgaacctcagtgagccacccacaagcagcacttctcccgggcctaggccccacattaaagtggtgtggaagaaggcctgataaatgcaaggcctgtctctagcctcaaagtgctattctcatggaggagactcacatgaacggtgctgacagggtcgtgcaggtgtacagatgagcactgtgccagctgtgtgagtgcaagggaccaaggggacctgtgaggtaagcctgcaacccggctgggaaaagatccccgttggtatctatttatttggggaacaacaagctgtcaactttccccaaatgcggggaggaatttgggctgccaaagtttatgccatgatcgcaggtctgctcgggggccagggcagctcccacatccactgcaggagagagggccctcagtctgccaagggcatgcacatgtgctgcattctccccataacaggggccagcagcaaaggggaggtgagctggcctctgacctgatctctctgactacctcccagacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatgtgagtaggggtgcacagagcaaggacagaaacagcagtttacagaggaggaaacccaaaaggccaacatgcattatcaagaaagtaatcagagaaatgcaaatcaaaacaaagctgtcacttccacccactagagcagcagattaaacagctgggaggtgccaagtgttggcaaggctatggggaaataggagcccttgtgccctgctgatggaagtgtggactagcgcagcatcctggagagtagtcagtgccacttgcaaatcccacttctgcatgtgtaactcacagaaatcctcacgtatccaggtccataagggcacatggaccagactgttcatagcagcctcattaatgatgttaggaagctgcaggcaacgtaggtgtccatcactcggagactggacatgcacaccacggagtattatgcagtagccagaagcaacagattagatacacacctaacacaaggacagagctcacaaacatggtgcttagcacacaaagtaagaaacagactaagacatataacagaatgccaatttctgttttaaaaagcacacgcatggccaggcatggtggcttacgcctgtaatcccagcactttgggaggccgaggcaggcggatcacgaggtcaggagttcaagaccagcctgatcaacatggtgaaaccccgtctctactaataatacaaaaattagccgggcatgctggtgcacacctgtaatcccagctactcgggaggctgaggcaggagaatcatttgaacccaggaggcgaaggttgcactgagctgagatcatgccactgccctccagccccgcaacacagcaagacaccatctcaaacaaaacaaaacaaaacaaaaacatgcacacaaaacaacaggatgggttgggcgtggtggctcacacctgtaatcccagcactttgggaggctgaggcaagaggatagcttgagcccaagagttcaagatcagcctaggcaacacagtaagaccctcatctccacaaaaaatattttgtaaaaaagctagccaggcatggcggtgcactcctatagtcctagctactccatgggctgagggtattgagccctcaattatcgagcctgcagtccctgatgaggatcacttgagcccgggaggtcaaggctgcaatgagccatgattgcactattgaactctagcctgagtgacagagtgagaccctgtctttaaaaaaaaaggtgggggacacagtttactagaatgaaaataaaaaggtcaacagttagaatggaagcgtattggggagaggaatgggagtaggacaggcagataaagggaatgcacagacacataacactagagagggagcgaaggctgatgataatgttccatcaactgagaagtttaactcaaaactttgcccctgatattaaaacaaaaagaggaattccaatgagcttgagaattgtgaggctgggccaagatcagcttcttgcaggtcagcagtctccactractgaggcccttctgggcacagaggagcacactgagccactggggaacccaaggacagagcccctctgctccagggctaccttccgcattcccttaaagtgcaggacccctggctcggaggctgggctgggctgagtgcagggcgggtgagctgattcctagggtaggtggtcttaaggccgtggagtcattaatgcttctgctgcagcacaacttgtatccctctcccagtaacacactggcattcagacagttcctggaacaaaacaagccctctgtggtgcaggggtctttgtcactgatgtctcctggacactgttatagtgcctggagcactattcttctgggtattggttcattttccttgtagtatctcagttcaaatgtcatttcttcagagaagactgccccaactcgctaccagaaagtcactcacccagtctacttgtggggcagcagctgccaccatctgtatttaccttgctgatgtactgtcatcacatgagtgaggctgcatctgtgtaattcaccactgtctccccagaacctagcacatagcaggcactcaaataactgaatggatgttcccttagctacaagcaggggggtgtcgcctctgggatgaagcacgtggagaccaatacctacgacgtgaagcggctgctacatgtgaaagggaaaagaaacatcagggctaccgaggttagtcctgcacactctctgccccaggcccggggcttctccacctggcacctaagaattcctcctgaacaatgtttacctctcatcgacaggtggaaatgagctgggacagtttcaaccgaggtgatgtcttcttgctggaccttgggaaagtcatcatccaatggaatggcccagagagcaacagtggggagcgcctgaaggtatggcttcctagccttagcactttctcaagttcctctttcttcttccctccatgctggctcttccccaagaatcaaggtggagccctgcctttgagtagaatctgtcttggagacaggccaagtgtgtgagtttgtgactcaccctggactcctcagcatccaagtaactcctgtgtctgggatctaggctgttctccccaaagacatcaggcagaaaggggtcccagaggagctgagggcttccttgggcttctttgacaggctatgcttctggcaaaggatattcgagacagggagcgagggggccgtgctraaataggagtgatcgagggagacaaggaggcasccagcccagagctgatgaaggtccttcaggacacccttggccgacgctccattatcaagcctacagtccctgatgagatcatagatcagaagcagaaatcaactatcatgttgtatcagtgagtagctcaacctggttttagctggaagctggggttggggggaaggtgtcccctagaacaccagccacctctgcttggctccttgttttgggtgtagccatctggttttcttcttagtccttttcaaatgcagctcctagaaagcttggagatcccccactcaaggaggcagttcttgttagcaactctcctgatctcttgaggagacctttcctttactctagcctacacatgcccagggatgtggaagggataatgtttgggagagagatgaacaaaagtctccaccaaagaaaagagtctgcacattcctgtcctcactcaagtcatggctgtcttaggcagtcacactctacctagaaactccaaactaaaaccaaaccagaacaacatctagttgactacaagatgctttatagaggaaaaggcacaggctaacctctccccttctccagtatctcagattcagctgggcagctggcagtcacagaggtagcaacaaggcctctggtccaggacttactgaaccatgatgtaagtagagtttgggtggacttagcttggggtagccagacatgcttcagaagcagaccctgtgcaaaatcttccttctggtcttgagcaaccatacctatctctggctgctttaggactgctacatcctggaccaaagtggaaccaaaatctacgtgtggaaaggaaaaggagccacaaaggctgaaaaacaggcagccatgtctaaagcgctggtaggagctacagatgtgcaatactgttcaaataattctgctaagagcacttcaggtgtgtcactccacagagccatgctaggtatttgagcatataacattgtgcttacgtacayggactgcaaagtcaggcagacaaactgggattcaaatccaggttttgtcttttccagctgtgtgctctggggaagacatacttaacacctgtgggcctcagtttccccatatctaacatgggggtcatacccatctcctagggttattgtgaggattaaatatcatttgtaaagcactcagggccgggcgcagtggctcacgcctgtaatcccagcactttgggaggccgaggcaggtggatcacctgaggtaaggagttcaagaccagcctgccaacatagtgaaaccctgtctctactaaagatacaaaaaaaattatccaggcatggtggcgcatgccggtagtccaggctacctggcagggcactgagataggaaaatcacttgaacccgggaggctgcagtgagccgagatcacgccacggcactccagcctaggtgagagcgagactctgtctaaaaaaaaaaaaagcactcagaacagttcttggcacacagtacctgctgaataaaaggtggctgttattattgaaggggatatcacatatcaaggttaatggccctgtcctcaaggagcttatatttgtgcagatccatgcagatgaaccaagccagaagcaataaatgagcaaacaaatgtgatgcaaagtcagtaaggacaaaagtactgaaagaacacagcataatcatcctaaaaattaacaaccataatcaccgcaagccaataaacagatccaaaaatgttccactcagtcattttttttttaggcaggtaccttggtccttagacaaaagtgagttagaatttgactctgactcccagaggggagacgcttatatcatgtggcttcatagaggtgaattaccagacaagcaaagaactcagtgtattccaccactgacctgcctttgggaatgggtggctctgcagggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattggtgagactgcccccagatcatcctctcattgctaagactctagaaaagcaggcacagatgcttcttactcactcggcttttcccaaccctttctccacagctaaagttttccaggataaatttgatgtgactctgctacacaccaagccagaggtagctgcccaggaaagaatggtcgatgatggcaacggaaaagttgaggtaagcccaatgattcaaatgtcagggcagacagcactggccttcatggctgtcctgctgggggcaggggtgcaggtgattctgtgtctgctttgctttccctttcccctccggcacctcaggagtcttctttaagagtcttgtgagtctgtagagttttcagggtagtgaaaggcacatcctcaaatgtgctatcaatatctcacctggaagatatattcaaatcattgctcagccttgcaaagaccgagccatgatgggatgctcctgaacaggatggcccagttcatctcacgattcaaatcatgcaaatgtgatgagtcctcagcactgggagagaaccagagggagaaagggaacatggagtaaacgtcagcacctttcccacctggattctctctttagtgtggcctagcccctctcagcacccccatctctggaaaacggtgtctccttctatgcccaggtctggagaattgagaacctggagctggtccctgtggagtatcaatggtatggcttcttttatgggggagactgttatctggtcctctacacatacgaggtaaatgggaagccacatcacatcttgtacatctggcaggtaggcctggcacaggcttcagctttggatcctgatgtgtcctctggccactgggctggggcggggagcatgggtccttcatggcctctcaccattgcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgaggtgaggatgctctgataaaattacaccatgagctggaacgttccaaactaacaaaccagcacaggactattggagagcagaggaggggtggggtagggagtcaggcttggattagacagaggaagaagggggttaatccctctaagacagtcaagtgaatcccaactgcctagggcttcaagtctgaaccactatctaaattatgttcaaggtctttcataacctgacccatattacctatgcaggtgcaccaccctcagctccctaacctgcaccctccactccagtcaggtgggtctcttcattagacctcacgtgtaccataccatacccctcctgcttcagatgtgctctttcaaattcaagtcccacttcttccatgaagccctggctgaagcactaccaagcaatgcgtaatggcacatgcttgatatcacacaagtctggggtcaagtcctagccttgtcatttactagtcaagtttccaagtctcagtttcctcatctgtactatggaataataacatctacttcataagagttataatgaggatcaatgaaatgatgtaggtaagcaccagtcacagagcctggaatatgataaagttctcaggatgaaagttgttgttatcggtgacataactccagcttaccctgaccctttccagtgagtctagaagctcctcaagggcaaacataatactataacattcacgtttcccacaacagctcctctagcactctgctcacatggtgctccttagatctggactctgcttttcttctctctagggtgggacttccaggaagggaaatgccgagcctgaccctccagtaagactcttccaaattcatggaaatgacaaatctaacaccaaagcagtggaagttccagcctttgcctcctccctaaactccaatgatgtctttmtgctgcgaactcaggcagagcactacctgtggtatggcaaggtaggatggctgggccccgggtcagaccagcccctcggagcccagacctgcactcccctcctcctgtcagcaaggtcaaaggacctagagtaggctggagtgcttgctttggcagcacatatactaaaactggaatgatacagagaagattagcatggtccctgtgcaaggatggcatgcaaattcatgaagcgtttgatattaaaaaaaaaaaaaaaaaaaaaaaagctgggcacggtggctcatccctgtaatcctagcactttgggaggctgaggcaggcaaatcacgaggtcaggagttcgagaccagcctggccaacatggtgaaaccccatctctactaaaaatacaaaaattagctgggcatggtggcacacgcccatagtcccagctactcaggaggctgaggcagaagaatctcttgaaccagggggcggaggttgcagtgagccgagattgtaccactgtactccagcctgggcgacagagtgagactccgtctcaaaaaaaaaaaaaaaaaaaaaagccaggcacagtggctcacacttgtaatcccagcactttgggaggccgaggcaggaggatcacaaggtcaggagaacgagaccatcctggctaacacagtgaaaccccgtctctactaaaaatacaaaaaaaattagccgggtgtggcagcatgcgcctgtagtcccagctactcgggagkctgaggcaggagaatcgcttgaacccagtagacggaggttgcggtgagccgagatcgcgccatggcactccagcctgggcaacaagagtgaaactccatctcaaaaaaaaaaaaaactcactgaaagccctgcttacacctagcagaaatctcataaacttctatgcagatggaggctggataagtcaatcttcccatgtgaatttggtggactctaacagacaggcactaatacagaacaaaaacacaaaatatgatgtcaattcatattgcaatagtggattaaaatgcactaaggccgggcgcggtggctcacgcctgtaatcccagcactttgggaggctgaggcaggcagatcacctgaggtcaggagtttgagaccagcccggccagcatggtgaaaccccgcctctactaaaaatacaaaaaattagctgggcatggtggtgcacgcctgtagtcccagctactccggaggctgaggcaggagaattgcttgaacctggcaggtggaggttgcagtgagccgagattgcgccactgtactccagcctggctaacagagcaagattccctctcaaaataaaataaaatgcactaaaattattttacaaaaaagaacaggaaaagatgcttaacatcattagtcactagggagatgcaaatcaaaatcaatgagataaccactacacatctattagaatggttaaaaaaattgacaacataaaatatgagcaaggatgcagagcaacaggaattttcatgcattgttggcaggattgcaaatggtacagcttctggaaaacatttcgacagtttcagttttttttttgtttttttttttgagacagagtctcattctgtcgcccaggctggagtgcagtggcgcgatcttggctcactgcaacctctgcctcctgggttcaagtgattctcctgcctcagcctcccaagtagctgggattacaggcgtgtgccaccacacccagctaattgtattttcagtagagacgaggtttcgccatgttgcccaggctgctctcgaactcctgacctcaggtgatccacctgcctcagcctcccaaagtgctgggattacagtagggagccaccacgcccagctgacagtttcttacaaagttaaacatacacttaccgtatgatccagcaatcctactcctgggtatttactcaagtaaaacaaaaaactatcttcacagaaaaacctgtgcacaaatgtttatagcacctttattcataatcagaaacaaccccactggaaaatggataaacaaacagtagtacatccacatgatggaatacttctcagcaataaaaagggatgagcagcgcgctggtaaacccaacagagatctcatatgcattctgctaagagaaagaagccagactgaaaggctaaatattgtatgactccacttacagcattctggaaaaggcaaaactatagtgatggagaatagattcatggttaccagaggttaaggattcagggaggctttgactccaaaggggtcgcaccccagataattttgggacggactgaggaagaaactgttctgtgcctttattgtggtggtagtaacatgattctgcttgtgaaaattcttagaattgtatgtcaaaagagtatattttattgtatgtacttttaaaaataaatttaaattttttctctaaaataaaaatcaaaagtaggtgcctaaattcaaactgaagctgaaacaaaggtgacttttgccaacacccactgtgggtttcaaagcctagtcctgttctttgccccacactgttttcctccccactccccagcactagaacaaacttgtctgtcttcccaggctgagggactgtggtttggtagctgatcctggcacactgagttattagtctcagatgcttttctttccacatcgaagtgcccctgtgcaactaacatctgtgctctcctcgccccactctcaggggtctagtggggatgagcgggcaatggctaaggagctggccagccttctctgtgatggcagcgagaacactgtggccgagggccaggagccagccgagttctgggacctactgggagggaaaactccctatgccaatgataaaaggtatgggaacacagcctccccctcttctgggctccccctgcctgccaggcttgtgaattgcacaaaggctaaaacctcagttttaaaaacatttctaagcagcttgatgcccttaaatggactayattgcagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtaagacacagctgcagaagtcagaacatgagaaagactcccacagtaagggttgtttttgtgtagtatccccaccctagaataaacccagggtagccctggaccatccccagctcaatcaaacctttgtcagcagtgaccaaaagaaagcccgggttttttttccaggggtgatgtttgagaatgatgtttgaaactcaccatcctgggcattttcccaccttgctytggaaaaatccagccatcctatcatcatcctatcatcattttagtcttaggatcaatagcaacggactccacatgcagaggatatgggcctttgggggaacaaaggcagtcagtagactattgtcatggtcaagtaagagctactgtgggcccacataagggcagtggagtagggatggagggatggtgacagatttgacaaatgcttaggaggtaaagttggtcagccctggtgactcattggatatggggggtttctaggaaactctcaggyttctgccttaggtgactagatagataccacctatcaaaagtggagactcagatacaagtttagtaaagaagagctacatcytgaaggtgttatttttaaggtgcttagagcagtcaagaggaggtgttctgcaagaagttggattcaggaagctgaagttcagagacagctccaatttggaaaggcagacctggaagatacacatagcaattaaaatgataaacatcaagctgrttctgggaaaacctttctctgctgaacaaattaggctgagaaagttttctgaggctgtgaattgctcacgaaagaaaggggaaagatagggtaatgtgtatgatctagtacttagtccttggtatgaacacagtaacatatattaaatctccaccttaacaggtgttcttgtggattggggctgaggccaatgccacggagaaggagagtgcccttgccacagcacagcagtacctgcacactcaccccagcggccgagatcccgacacaccaatcctgatcattaagcaggggtttgagcctcccatcttcacaggctggttcctagcctgggaccctaacatttggagtgtaagaaaagagagtagggaagctctaacttcctgccaggtagctcagaacagctcagtgggcaggaaggtggagtactgattcacggctcagtgaaaccaggacctcatttccctactcccatcccactccctgccttttacttttctcctctttttcacctgccacagcagtaagtccaggtggacaattcacagcaggtgtcagcaataagcagtgtgaagtataaacagtttataaagtatatccatacacatcatctttttgatctttacaacaatcctgatagccagtagaagtattgctccctattttattgataaggaagctaagaggataagtcatttgtctaaagtcacagttaatcaacagaaagccaggtttcctgactcctaatcaacttttttttttctttttttgagacagaatttcgctcttgttgtccaggctggagtgtaatggcacaatctcggctcactgcaacctctacctcctgggttcaagcaattctcctgcctcagcctcccaagtagctgggattataggcatgcaccaccatgcccagctaatttttctatttttagtagagatggggtttcaccatgttagtcaggctagtcttgaacccctgacctcaggtgatccacccgcctcagcctcccaaagtgctgggattacaggcatgagccactgtgcctggccttcaactgctctttcttaaatcttattgggaggactgaggggttaccatcaaagaatgtgcgttatgtttaagcacctttcaagcctgcatggacccaaaaggggggattttcatttttacttatccttgaaatgtcttctgactccctggctcttttgcttttcctgaagacacagaccagacctaaratgtccctcccctataagaaagacctcatcctgtgttttctctctcttcttctcaggcaggaaaaacatatgaacaattaaaagaagagctgggagatgctgctgctatcatgcraatcactgctgtgagtcgggttcgctcttgggagaagccagccacatgggcaaccagagccagagaacacacaaatgctacagatgctcacaggcaaaactcatgtccttagtattaccatagttgtctgttttgatgtaaagactttttgtaatcaatagaaaagcaggtctcagagccaagttccttattttcctgacttccagattttcaaacagacttgctgtgtaaaaacaacaaaaatggggccgggcgcggtggctcatgcctgtaatcccagcactttgggaggccaaggcgggtggatcacctaaggtcaggagtttgagaccagcctgactaatatggtgaaaccccgtctctactaaaaatatgaaaattagccggccgtggtggcatgcgcctgtagtcccagctactcgggaggctgagacaggagaactgcttgaacccaggaagcggaagttgctgtgagctgagatggcaccactgcactccagcctgggcaacagagcgagagtccgtctcaaaaacacaacaacaaaaaaatgaatatttgttttattattcaactctgccgtttaaggagagattaaagtcattggcagtatttttcagaaataagcttctaacccaaatgacatttttattcatttctgacagtgaagtccacagaaacttaggccatttacacctattttaatggttaaaagaagtggagcctctagccaggaatccagcagttctttaacctcaggaggagtgcatggcaccaggtgttcaaaccatctggcaattctgtcctttgtgctctacaaactcagattccaaagctaatgttgatgtagtatctttaaattgtatttaagtaggactacaacctaaagtcatttaaaggctggaaatgcagggctaaataaaagtaccaagagaaggtatgtgatcccaatattcaaatgagatccagacacaagatgtatgccaaactagctatacaggacttgccttggacttactgaatcagctttcccaagaacaaccccaaaatctgaatattttctattcccagatgattctgacatgcagccaggtttggggagcattgttatcaaagatgattacagagggtgaagtggcataagtcaaaatgttaaatattatacacattcagaactgtaaccacacagacactgaggagtcttttccctgtgcctacattcttatcttacctaggacatgaagaatgcaaccctctccctgaattctaatgacagtgagccaaaatattaccctatagcagttctgttgaaaaaccagaatcaggagctgcctgaggatgtaaaccctgccaaaaaggaggtgagtggctgaaggaactgtgtctgttggaagtggagctctccgtgagtaaaaaactcagctcagcaaatggcctaggacagctccggcacattgtagccgctcaatggacatctgagctacctaggarctcaaaccaaaaaaaaccagggttctttcttgattcttttctctccacctacatcagtctatcagctagcttctgttcactcctcttccatttctctgctactagtctagtccagctatcatggactacttactacaatccaactggtttccacctgttcctacaatccgttccccacacaacagccaaagagatctttaaaatatatggcacggccctgtttaaaacacctggaatagcttcccactacatttaaaaaaagaatgtgaaggcctatacaatctggcccctgcctagctctctgatttcatttcatataccaataccctcatcactcaccacccttcagccagtacagcggctgctttgctgttccttaaaacatgcttattccagcctttgagcctttacacttgctagtgttcgtgcctgaaaaaacatccttctcccaaatcatcacagcaccagcaccttctcatcatgtaggtctcagctctaatatcacctccccagggaggcatttcctgaccaccctaatactgcttcccatacctgctccagtccctttatacttgttcattgcctatttccccctctagtaatatccttaaaaggaaggacctttgtttgtcttgctcaccatcatattctcagcttctctgcacctacaacagtgcctagcagatagcaagtattcttaagttttgcgtgaatgaattaacatatttgagttaaaagaataaatttcttggccgggcacggtggctcatacctgtaatcccagcactttgggagggtgaggtgggtggatcacgaggtcaggagttcgagactggcctggccaatatggtgaaaccccgtctgtactaaaaatacaaaaattagccaggcgtggtggtgggtgcctgtagtcccagctacttgggaggctgagggaggagaactgcttgaacccgggaggcagaggttgcagtgagccgagattgtgccactgtactccagcctgggccacaaagcaagaatctgtctcaaaaaaaaaaaaaagaaaagaaaagaataaatttcttttccccttgaagaagttgatttaggcacagactctggactctggatttcccacaatgtcttatctagtcaactcaagtatctggactacaattttcttgaaagcaaagcccatatattaataatctttacttgtatataaatattcaataaatcattaagtaaatgtgtagaagaattttatgctcaataagatccacccgatcatgcatttgaaaatttatgggtaaaaatggtagttacgggcagaaaacaaggaaaaccatagctcaatttagttcttcattctgccaaaatttgatgtctgtaattcatccttaatacataacccatttattgccttctggcaagaaactggcgcttgctggcactgtgagagcagtgaatccagtaagcttctgccacaggccaaaatgggactccctgacctgaagaacacctctccaatgaataatttaaatctttaacagcctttctgagaaattcattctacttccctcttcaaggatccacctagaactccctcttgctccaacttcctcaacttctgttggcaatgatgtcatgtcttccttctaactagaaactttgttttctctcttagaattacctctctgaacaggactttgtgtctgtgtttggcatcacaagagggcaatttgcagctctgcctggctggaaacagctccaaatgaagaaagaaaaggggcttttctaaagcaagaaggcctatacctattgcaaggccacagaaaagagcagatagtgccaatatcaggaaataatttatccaccaatttctgcctgacattcagctacttaatttagatataatagagtctgcaaatcacggcatgttctccattttttctcatccttgcattccttgcttgttatatacctaaaatgttaaccatatagtttttgggttttgtggccctctagctaaagcctcagcagaaagcactaaaactgcataaatctggagaaatcaaaagaaagagaaccaaaaaacaatgcttaaaatgtttaataactttatgtttaatattataccaggacctacctttgttttcaattttaagatgattatttctaaaatctatttagcctgtaaatcattgaaatcatatatgcactccataggcaaaatccaaatacccagatctgtaatgtgtcaaagcatttttcacttttcaaataaagatacctataatgaacaaatggagttattttcagtattctgggtctgcttgttacggtaattttatgttatacttgaagaaatgtttcagtactggggaagtaaagaggcaatgttaagtgagctctctgggtaactggactactctaatttctgtttctggcacaagaatgtcaaaatctgccttacagctggccaggaaacctcagtacccacccacccacacatcatccaaaagagaaataggggcatgtgttattaatttcattaaatgaggccagaaccagtgtgtctaccactgcagagcaccttcaaagcatactacagacaatcacaaagaagagaacccacattttccagacaactctaggtttgaatcaataatcctaaagaaatccatgtggcacaagtaatataactagggaggttccgaggcagaagcacggttcacagtgtcgcaaagcaaaaacagaacaaaagagttctatgtcataaaaggtgtaagacagaacatataagttagaaatttcagaaataccataataaatctatgttgaagggagcagcagtattgttgatgcctgttctccacgacactatcacgtcaataaggcccacctgttgtttttgaaaggcacagaaaagctaaatccagtattacgcaaacaaggaaaaaattatttttattatacaactatttaataattttacccatgcattctcggtctgaagaggtttgggaaatattcctttttgtaatgatgtccagagctaaaagtaaatattcctcctgggccaaaagtctctggaacctattcagtttctgctgcctcttcaccttctccacattcaaaccgcacaaagtctactaccgacaccccctgaggctgcacatactgccccaaggtaatggagggatccagcaaatacggctgggacagcatcttagtctctgcctctcccccaggctcatcgtccagggagccaacagagaggggggccatgcccaccacatgctgcccaaggcggcggccaacgtcttcaaggtttgttttctgttcagacgtctcacagatgaccagggccccatacttccccagcaccagcttgtgaagtgagggactctgcattgctccgtggacataagagccaacgtagaacccagatggcaccttcacccatgcagctcgtttaagaatcatgttttctcccagttttcctattaaagcaaaaacaaaaaaccaacacaccaacaaattgtgatgtctgtgatggtaccaaaatatgcacagaagaggcccagtttggaagacagtccctttgcatttacataggatatgcagtaagatgaagagataccattttcagtttttgtagaaagaggaaaaggggtatggggcaggagagcgggagtgggggaagtgaagaatacctttatgaagcaccaactatgtgccaggcactctggtacttaaaaacaggccgggtgtagtggctcacgtctgtaatcccagcactttgggaggctgaagcgggtagatcacctgaggtcaggaattcaagaccagcctggccaacatggatgaaaccctgtttctactaaaaatacaaaaatcagctgggcgtggtggtgtgcacctgtaatcccaactaatcaggaggctgaggcaggagaatcacttgaacccaggaagcggaggttgcagtgagccgagatcgtaccattgcagtccatcctgggaacaagactctctccaaaaacaaaaaaaacaaaaaaaacaacaaacataggttgtataggttgtggtgacacaagtatgtgtgactcaggtctcagttctgcctatttactgactatatgacctcgggcaagtgactcaatgacataatctcatttactaaatttatcaagcctttgtttcctcacctttaaaatagagatgacaccacctacctttcagggttttggggagaaataaataatatatgtaaaagcagccagccgtggtggctcacgcctgtaatcccagcactttggaaggccgaggcaggcagatcacctgaggttgtgagtttgagaccagcctgaccaacatggagaaaccccgtctctactaaaaatacaaaaaattagccaggcatggtggcacatgcctgtaatcccagctactcgggaggctgaggcagaggaattgcttgaacctgggcagcagaggttacagcgagcgagatcatgccattgcactccagcctgggcaacaagagcaaaactccatctcaaaaaaaaaaatttatatatatatatacatatatatatatatatggagcattaactagggctgggtgcggtggctcacgcctgtaatcccagcactttgggaggccgaggtgggcggatcacaaggtcaggagatcgataccatcctggctaacacggtgaaaccccgtctctactaaaaatacaaaaaattagccgggcgtgctggcgggcacctacagtcccagctactcaggaggctaaggcaggagaatggcgtgagcccgggaggcagagcttgcagtgagccgagattgtgccactgcactccagcctgggcaacagagcaagactccgtctcaaaaataaataaataaataaagcattaactatagtatctggcacatagcactcaaatgctagctactattacaataagcttaggcttagagaacttaggtaacccacctagtaacacaaggcagagttagaattaaaactcagatctgactccaaagcaattaggtgctttttcccaccatcctgaatactccataactgacacagacaactcctgatcatcccttctatccggaaaaagtccacagctcaaagcaccatgtcatcggatagtttcaatttcctctcatcaaaaacagaaaagataacattgtcaagagttatttatgagaaccagaaacagattttaacttatttttcccctttctctcaggatgttattctcttctaacagaagtccaaataagccaaaaggtagaaaggggtaggagaataaacaaaagggtctgtataagtatgcctggattagccatagtcatatctaaaagtcatgaaaaaggagaatccagaaaccaaaacaaattttaaaatagctcaaagcatatacccaatagttaattcccagaaactgacaaggctgaaacacccagctcttccagaatttcttaataagcctcatacatagctgtctgcctggtttctcacccatgactcattgaaacatcatagataatacaagatgacctgataaaaacggaactgatgccttgactggaaacttcagattagtaaattcccagcaagctccaacccttccctaccacccaccctccatcaaggatacttaggaagaaagcaagatgctagtcccaccacaatgatccagatgtggttcctatagccaacaggctctaaaagaatgtatctttacaaattcacaaccagattttttgaaaagaaagatcaaattcctaaaaacaatgctcctcaattgtcctgccaccttttataaagaagaggaaataatctttaatgtactattttccctacagcatatactcaagtactcagctggaagtcaaaaggccatctctgcctaaagacatgctttgttttgttggcacagtgatgaaaataattttaattagttgcaaacagccaaaatccgtgagattttggatacaaatctaaattcttttaaggaatttagaaattctgatgaccccaggactccgtttccctagatataacaattggttacagcttggcaatgggacttcctccagcagcgtatgagctctttaagatgcctaatgtggccgggcgcggtggctcacgcctgtaatcccagcactttgggaggccgaggcgggcggatcacgaggtcaggagatcaagaccatcctggctaacacggtgaaaccctgtctctactaaaaatacaaaaaattagccaggcgtgatggcaggcgcctgtagtcccagctactcgggaggctgaggctgaggcaggaacctgggaggcggagcttgcagtgagccgagattgcgccactgcactccagcctgggcaacagagcaagactctgtctcggaaaaaaaaaagatgcctaatgttccctaacatctaacacacacaccacttctcacgttcgtatcatctgacccttgtaggcacatgattcttgacctagatttggaggaacaagataacaagagatccagtccctaatttccagtttccagaacctttacaaatactcaccaattgctaaagccaactgatccttgagtgagccttctctgtcaggcccagctggaagtccagaaagctcagaggaattcaagaaaccctaagtgcacgaagaaaacaaacatgaactgattctgtactattcaaattatcaaaagaataggcaaaaatagtctatctctaagaaaagtattggccaggcgtggtggctcacgcctgtaatcccaacactttgggaagccaaggtgggtggatcacctgaggtcaggagtttgagaccagcctggcaaacatggtgaaaccccgtctccaacgaaatacaaaaattagttgggcatggtggcacacgcctgtaatcccagctactggggagcctgagacgtgagaatcgcttaaacctgggaggcggaggttgcactgagctcagattatgccaatgcactccagccggggaaacagaattgagactccatctcaaaaaaaaaaaagaaagaaagaaaacattctttaagacaactaagtgtagacaatattttcataaaggcaagaatgttaaaaattggtaacagttccatctttataaacattttattctatcactgcaccacccccaattacattccactctcatcctccagcctaacttcctagaatgtaatttcctagaaatcaagaacaattattttctttttcttttaaatatagagatggggtttccctatgttgctcaggctggtcttgaactcttagcttaagagatcctcctgcttcagtctcccaaagtgttgggattacaggcgtaagccactgcacctggccaagaacagttttttcttttttttgagatggagtctcgctctgccgcccaggctggagtgcggtggcatgatttcagcttactgcaacctccacctcccgggttcaagcgatcctcctgcctcagcctcccgagtagatgggactacaggcatgcgccaccatgcctggcaaatttttatatcttttttagtggagacagggtttcaccatgttggccacgctggtcttgaactcctgacctcaagtgatccacctgcttcagcctcccaaagtgctaggtttacaggcgtgagccactgcacctggccaagaacaatattttcataaaatcataaaatgttagagctagatttgcacatttttgatgggaatgcaaaatggtacaaatccaatggtgtgaagttgtagtatctaataaaactacatatgcatttatcctttgaccctgaaatcctatttctatgaattcaccttgatgatatacttccaataatactgcacaagattattcattgaacaattatttctaatcagaaaattttaaaaacagcctaaatgcccaaacatagcaggagattaaactatagcacatccacacaacagaatactatgtagttggaaaaaataaaaaggatgaccttcatgaattgctatggagtatttccaggacatattattaagtgaaaaaagcagattataagtgtatatgcatattatactactatctgtgcaacaaagaactatttgtataaatatgcttatttttgcaaaaagaaatactgaaaggataaccacaatccaatgacactggttatctaaataaagggatggataggaacggggtagaagggagagaagcagtaagactcctctgagcatactttttttttgacagttttaactttgaggactttcttaatgtatcttatgtattcaaaaataaaattgaacctggccggccgggcgcggtggcccacgcctgtaatctcagcactttgggaggctgaggcgggtggatcacctaaggtcaggagttcgagaccagcctggccaacatggtgaaaccccatttctactaaaaatacaaaaattagccaggtgtggtggcgggcacctataatctcagctactcaggaggctgaggcaggagaatcacttgaacccaggaggcggtggctgtagtgagctgagatcatgccattgcactccagcctggctaatgagagtgaaactccatcttaaaaaaaaaaaaaaaaaatctggcccagtgccgtggctcatgcccataatccagcactttgaggaggccaagtcaggcagatcacttga

SEQ ID NO: 18002 - DNA, 125560 bp, Homo sapiens
  misc_feature (1)...(125560): n = A,T,C or G, or insertion/deletion polymorphism (see Tables 1-2)
ctgactatgttacatattgcttccagactacatttttaaaaataggctcacgttgcatcactgggggttgaagaaatacttgacactaatggcgatgtcaggaagagaggtctggaagaaataccataaaactgaaaaacatggtatagatagatttgtaaatcttttttatagatttgaaaaacatatttctaacacaaagttacagtcaaatatttaatacactttatctctcaagcatggtatgctttaattgaaacaatggacctaatcattactaggacttttagaaggtcacttctttgtttgcctttgttttaatagcctgaaatctcccaaaaatatatcctatttggtttccagtatcaatttaaagtctttctggaaaaagataaggtcaaaattcaaaatctattttaaaatccttatttctagacttgtaacgagttgattgctttgattttaagtaagcaaatctagttaattagctttttaaaaataaaaaaggtccatttttaactcaatgttggttcatatcagatacaaccagccttgtattgacaattggttgaatatacaatattatattaataacaacagatactacagttgatcttagccaaaaggccgagaagtgatgaatatacagtattgaatattgtattgcatattggttgaataaccaaccctgcacaatcaaattttttaaaaagaatccttacattctaacggtacttaaaaaaattttaggcttggggcagtggctcatgcctgtaatcccatccttttgggaggccaagtggggaggataatttgagcccaggagtttgagactagcctgggcaacacagtgagaccccgtctcacttaaaaaatagaggtcacttaatagagaccccgtctctattaaaaaaacatattttttaatgtatatacagaaagtcccccccgagctcaatcaatgtttatgtatagtattaatataccactccctacaaataagtttctaagtcaaaggtattgtcagaagttcaaatgactggaccactcagtgctttgtgatattattttgatgattttttgactgcattccattccgaaaactaatttactctgagtagaagcagagttaataaagtatgcaaaaatactaatctggcttatttaagtagtctagtgacacatctgagaaaaattttgtgtgagattcaataaaagctgagatttaaagaacaggttactgctggtctccccaagttaacatactttacctgagacatacacaaaatgaacttttatccatctctctctctctttttttttttaagtatttgcttgaggcataatcataatcaacttctaaagttacattttacttgatttgttgtcccaaatgtagacaaaaaacccataaatagccacaggcacagtggctcatgcctggaatcccagcactttggaaggctgaggcgggaggagcccaggagttccagaccagcctaggcaacatagcaagactctatatctaaaaaatttgtttaaaaatgttttaaaaaatatttttaaacataaatatcaagatttctgttgttaacaaagtaatgggtagtcattttacatgaactttaataaaacaataatagatgaactgtgttgtgcgttctacggtggctagaggaaaatataatcattttggggaatgccaatgcatgaactcctcaggagtaggtactcttccattaatcctcccagattttcagctcccttttctgaccactggtctttagtctccacgggttcttccacaatcagcccctccccacaaggtaaaatgtgcatacttcagggctctatcccttaccctcttattccacataatatccctggagaaaatcatcacattttaacttcaatcactaaatgcttaatccaaattctatcttcatctcagactttttcctttcgttccagacccacatgtccaactactactacttatgggacctcccaacgtatatgacaggcatctcaaactgaacacatctaccccacttcttaaactcctcaaaaaatttttttcttctttagagttcaatgaataacagaacaatccagtctatcaccccactgtcatccctggcttctccttcctcatctcctatatcaccaagatctgccaattctaccttttttagtggcccctccttcttattcccaccatcgctctcctggttctcttcatttcttcactgagcttcagcaacatctccaatttttttgtctctcatttaggctctctaccaatctgtcatttgagtgttgccagtgatcctttccaaatgcaaaactgatccagtcactgacccaaatcctccttattacctttaaggaaaataaactcatggtccttaggttccttctgatttggcccacatttgcctttctgggcttacttcctcccattttctgctaatacacatgaagaagtattctccagttcagccacaataaaccacggcttagttgttctcccggccttcgtgcctcagcccaggctgttctgcttcggaagcacctggtcatttcctgtttaccctttatgacatgcaattccagagcccaggaagtacctaacacattgtgaatgtggaatcaatgtctgctctatgcctaagtcaataacagccctttatattaaaaaagttcattacgacatacaagatattttcattcataatctataatcacatttatcttgattctcacaactagactatcagacaaccattgcaggttttattatcccaagttatcaatgacaaaataatagcttctggttttccaaaagggcaaagctagaaattaatgcaatgacccctaactaaaggtttgacctctctattattaccctacttaaattatcaggtacacaatgaagaccaccatgtgctaaaagcaacacagaagaagcgtaagtcatgcacttagctccaaacatatttaatccagtcagaggtacaagatccatccatatgagataaaattctataggaaagcatcctacagagctaaatgctaaaccgtgtagcacccccagtaggagagcgaagtgcatttagtgggcattagcctaatcctgaaagactttccagaaactggggcagcatgctcctgcagtcccatttatttatttatttatttaacttttattttattttttttgagacggagtcttgctctgtcacccaggttggagtacagtggcccaatctcggctcactgcaagctccgcctcccgggttcacgccattctcctggctcagcctcccgagtagctgggactacgggcgcccgccaccatgcccggctaattttttgtatttttagtagagacgggatttcaccgtgttacccagcatggtctcgatctcctgacctcgtgatccgcctgccttggcctcccaaagtgctgggattacaggcgtgagccaccgcgcccggccagtgtcctttagactgtggacgagtaaagggcggagagatagacattccatttgagtgcaacaaattgaatgtagaccatgacaagtttggagaacaaagaggaaaacaccaaaaatagaaattgattgttttccacctttgacagaactccctaagagtttcagaaagtatcagatagagaaaaaagtaccctcactctggtaaagaaaacaaaaatcaacaaaaaccctaaaaccaacaaaaacaaaaatgaaaacttccttcaacttaccacagtaaggctagaagacagaactattaataacatgttcatttgctacattttttatcaacctatttgcattaaataatgttaacctcccactaaagttatttctactttgaattctgaggtagtcaagagatttaaataagaaaaagactacatctgtctcttcattgttactttgttattcccgatccataatgcttcagtttgctacatttagttaaacatcagcaaagtaaacaataatgtaactattctatctagtaatgagcttggagacttaaaaaaatatatatagaactttattccttttcatttgaccactaataacatactgaacatgcccgtgaaaagaaataaaacacaatggtagaaaactccaaaaaggtagagtgtctttaccattcatcccccacccctatctcattagcaactttctgatctcgggtgttttctccaatagtaaagtgtatccctatatccaaaacaatttctctaaagcccttctcactcattcaacaaacatttaacaggtacattgcacaaggtgatagaggaagagaaactgaatattgtccctgcctcggacatttcagtgcctttacgcctgacttccactcctaaccagtcttctttcacaggtaccctgtcccctaaaatcaaatgttgcttttcacagttgcctttacttgtcacctaaagtatttcaattcaaaatttcctcaaagtcaacttaacagctgctgataaaataatcattctatatgattacaaagtgtttcaccaatacatatccccattttttccaaacttaaaacttcttcagtccttattactttagcatagagacctgcactgttgtttcttctttttaaaaaaatactaatgctaatcctttactgtttgagcagacttaatcctaccttttcttttgtcaataaatgccaggtgttttttaaatcactatcttgtcacttttgattatgatatactgatcactctatttgtatcttgaatgaaaagaccgctttgtgattttgctaatgatatgtaaactagaacttgagaaccactggatacaggagtactgctgatctttatactttctgtctaaaaatgaagcccctgtctctaaatttcaggaacagggagttaaggttccatgaagtgtttactttccacccttaatttattaccttaatacttcagcttaagaattatgtgttctgtatatatcacgctgcttgtcaatatccacacataaaccttcttgttttgacaattaatctgaaaaagtccccatatagtctgagagggggaaaacctaatttggaagaatataataaatgtcagtttccatcacagaatatatgcttctcaagttcaattaacctctcaatgattccctaagaggaaagtaattctccttagtgtccttgtcatccatggagtggaaatctttctactggcaagattagtaatcacttccatgacccccaaaacggctcttccttccatttccctcaagtactgtctggagcagcggttggaattaatagaggggccataatctccagacctgaataccaaatcaatcctgcagccccccacacccttaatgcccctgcactttcttgcttatcctttttctctcgtctccatttttctttcctccttctggtgttccggaacctatgatactctcctggttgtttgaatttttacaacctaccagataataatctcttgtgatcctcaaagcttccttaaagcaaaccctgaatcactgtgttttaaaaccagtatgaaagactattgtgtgggataatgttacattgtttcacagccctacaaagtttggccacaaaacgtgtgggcagattccgtaactcaaccggaaacgcgaaggactgaaacaaatcaacacacaaaaaacgaagccagcgagaaagatccaacccgggccccctgcctgaaatgggacacggggatgacggggcaaagccgggcaaaaccgtgctcctggctctcgcgattcaggagacgcgccaggctcactggggacgacagcgacgacggcggcggctcgcattgctccacgcttcccgtcaggggggctcgagggaccgccccaggcccggcccatgcccgggctcggagggagcccctggtgcgagggctgcccgcagggctccgtcctcccgctgaggcgcggctcccggagcaggaggcgcggaggccgccctcggcgtttcggagtcggggcggggaacgtccacggccaactgcgggcaggggacccccaggcggctacaacaggtgcgccggggccgcccacccggctcggggcgcgcccgcccctgcgccgacccccgaccccttccgccgccggggccccgctgttacctgcagcggcggctcccgattcccgggagggcggcccagggccggcgccttacccgcgggcaggcccactcgcccgacggacgccgcgggtcggcgacagcggggaccgcgggtcggcgacgtcggggcacaggtcctgcsgggccgcgggggccgccagggagggcgcgaccgcctgaccgggcttcaggagcagtgtcctcagccggtgacctggccgctaccctcgctcagtgtccccggcgacgcgcggrtcctcacgcgctccctcacttcctgcggcttttggtccctcccgctcgccgtccctttagttctgcccacttcgcctccgggttgtcagggcaaccgtagcgacgccggccctggctgagaggcgttaggagtccgggggttcgcccgcggaggccggggagcagccgaccatggagccccagagtaagggaggccyggrctggagctgggaccggggcdggygaccgggctrgggctccccgggaamgagtgtgggcgccccgcgcgcgactccgcaggtttcaacgctcggacacggaaatacggtttgcgtctcctcgcgcttttctctcctggagaggggagaagggggctacatcctgccaagtctgtatggttgggccgccggcgccctagagtccgcgctgggggctgggagcgactggagagccccgaggtatgggtggggaagggcgcagcgaccccagcgtgcgtcttcctgaaacttcgcccggacggttccatttactcctcctcctactcatgattttagtttggtagtttggttcattaattgtaagtagcccatttttcttctaaaatgtcagcaattaaacacgtccgaggctgggtcttgtrtttattagagaccccgtcttactccccgccccccgccccacacccctagtctgygacttgaaggagagagagagaaaagaagarctttgtccaagtgtatttgattcattcttaggggttctacaagttaggacactcaaaaaatgtttgtaatctctttttctgttttcccatgttgctttcgatgtatggcaaaagttgtgcagttttgagttatcagatctaaacacgagctctaacttactatttttgttgttgtttttacctttccagggactttgtttcaaggcctttctttctctgccccgcctaagctgtcttattgttccttttgttctcaaaataaggggagtgttttgtatggagacttaaaatttatctaaaacctttatagaaggatgcagtttgactctcaaaccaagtcgtcttatcttgtacaatttcagaaaygaagaactcagaccaaatctattctctggggaaaatgttggcatttttaaaggtcattcgttttccaccaagaaagtttcaaatacttttccttttaactcatttgctgaggagaaagcttgcaagttgtgacttatagttgcttgatagattttgtacagtatttgtcatttgcatttacagctctttggattctacatttttttaacctagtaaaagaaatttagcatacaagaacgctaaaatttttgttttatgtcaaactgatggcaggctgtgtatattcccgccttagagaagtgagttgaaatataccttttaaaaacagcaacttggcctggcccggtggctcacgcctgtaatcccagcactttgggaggctgaggcaggcggatcacgaggtcaggagattgagaccatcttggccagcatagtgaaacccatctctactaaaatacaaaaaaaaaaaaaaaaaaaaaaaaaaaaaaaaaaaagccaggtgtggtggcgcgtgcctggagtcctagctatttgggacgctgaggccgaggcaggggaatcgcttgaacccgggaggcggaggttgcagtgaggccagattgcaccgctgcactccagcctggtgacagagcgagactccatctcgaaaaaacaaaaaaaagaactttatttcttcagatttatgttactgttttcatgtgtaaactataatttsaagttmttcagtgctktctttatccmttcattcatttatagtgcctgttatgttgcagctctgttctagggattgrggattgaacaacggatcggacagtgttagttttggtcatcccaggaaaaytaagcagaggcttgctcaagaactcctgasgtcttggtggggttcggagattgggggaagaggagatggacaaaggctcccaagaggaagtagtaytgggtctgcagaatgacccagcaaagaatgagggcaagggattccaggcagtgggaattactkgtacataggccctgagacctgagagcagcgtgggtttgagkctcacggtaggaagattagtaaagctgtagctaaggagaggaggaggaaaaaacagggttggaaggagggaggagaaatgagataaggctggaaaattcaaccggagcctgatcagaaaggttctgtaaccatgtgagaaatgtattacttatgtgaactatacatttatatctcatgtcattggattttgaggtggaaaatatttaatttatacctgaggaatgactgtaaatttctttctttccacatattcttaaattatttcatcaatttaattttaaataattcaatcaccatttagctcaagttttgttgtttttttttttttttgagacagggtcttgctctgtcacccaggctggagtatagtggtgcgatcatagctcagtacaccctcgaactcttggactcaagcaatcctctcacctgagcctcctggctagatgtgactacaggtgtgtgccaccataccccgctaatttatttatttatttagagacagagtttcgctgttgttgcccaagctggagtgcaatgatgtgatcttggcttactgcaacctccgcctcccgggttcaagtaattctcctgcctcagcctcccaagtagctgggattacaggcatgcgccaccatgcctggctaattttgtatttttagtagagatggggtttctccatgttggtccggctggtcttgaactcctaacttcaggtgatcctcccgccctggcctcccaaagtgctgggattacaggcgtgagccaccgtgcccggcccctaattttctttttaattttatttactttgaatagagctaaagtctgattttgttgcccaatttgttctcgaacgcctggcctcaagtgatcctcctgcctcgtcctcccaaagtgctaagattacaggcgtgagccagcacacccagcctggaaattcttttacagtctaagaaacataatttggataaatatttactaccattcacagttactaaatatttaaaaggacaagattaaatgatctttgaggtttcttttaacttggagatttgtatccaaccagatttcacctgagacggaagttatttcctactgtcagccataatggaagcactacagaygtggcatcaagtattacagtgaattacarttatactgtcagcaatattatgttaacwgtacattgtttatgccgatattatctaacatattttaarccctgttccttttgttactgagaggtctaaaataacattttacaagtrtagttgaatatagcatcagtaaattsgttatgaggaagactccttcataattgcttttawggattaaacatgtatctaaggacaacaccaaggaactactagaaataaccctcgagtcagtcttttccgttctgtttccacasccttagttttctattacttttaggaatgacctttgttaactaagtcattaaaatccaataaacataractcttcagaccccacwgctggatcatactcttggcagcaagcagaggaaggcaggggctaccactgttttacagaataatagtaagtcaatgatccaagaaatgacttcccagggaaagggcaaattaaatacgttcacaaccttgggctgttgagagtggttttggctcttggcttgcacattgamgtctttaattattttcttgctaaaccaacttcagtgttggaaagatagctcatgtataaaataacatggaaaacgtacatcacttcccatttgttttgggtttttgtccttttttttttttctttttttggaaaatagttcaatagtactatctcttccttaatttcttaatgagttttaataccaaggggtggctttggggatctttagcccaaatctaagcaaacatataatctgagtaaaaactgtatatttatcaaatgcagcatcaagagaagccccccggctcccacttggtgctacctgttctgtaagctcttgctatatatatgtattttaaaaatccagcaggcagcagttttctgctacacgtttctttctgtttttktttgtttgtttgtttgttgtttgttttttgttttttgagacggagtctcactctgttacccaggctgcagtgtggtggcactagcttggctcactgcaacctccgcctcccaggttccagcgattctcctgtctcagcctcccaagtagctgggattacaggtgcacgccatcatgcctggctaattttgtatttttatagagacagggtttcaccatgttggtcaggctggtctcgaactcctgatctcatgtgatccacccgcctcggcctcccaaagtgctgggattataggcgtgtgccactgtgcccagcctttttctgccccccttttttttttgtagttgttgtttttagagagacagggtcttgctgtgtggcccaggtatgcctcaaactcctgggttcaagggatccttccccattggcctcccgagtagccaggactgcctactgggctcacgcatgtttttaaagaaatggtagataagagatctaaggtatttcagtgactaagaaactgaggtgaatgactaagggactgagacttctctctccaaacctgtttctccactagtcttycaagccttcccagttactccaacctgaaaatgagtcatccttggctcctcattatcaaccctcaccccacccttctccatccaccagcaggtctgtttattccacttccaaaatataccccaaatgtgcttcctcttcctccgtactccaagctaccatgccgtgtaagttatgattgtgatttttgcatgtcttcttccactgctacctggaagctggagtgacctttcaaaatatacatcaaatcagatcatgtcactctcctgccaaaagccctccaaagtccttacgktgatctagctgcctcttcaaactcatcacacatctgatcttagatgtattatgcttcaagcacattggtcttcttgtagtccctcaaacaagcttctttcaggactrtggctcwgaacaagctttcctctctgccagggatgctattccctcctgctatggcaggtctgactcctaatgtccttcaatctttgcctaaatttcacctcctgcaacccttccctggcttcctaaagtggtggtgccccctctctgatgttattctatctctgcgcttttctcttaayagtaataatcagaacttrtaattattttgttaatatttaaaatctagctggacgtggtggctcacgcctgtaatcccagcattttgggaggccaaggcgggcggatcacctgaggtcaggagtttgagaccagtctggccaactggcgaaaccccgtctctactaaaaatacaaaattagccaggtgtggtgttgcacgcctgtaatcctagctactcacgtggctgaggcaggagaattgcttgaacctgggaggtggaggttgcagtgagccgagatagcaccactgtactccatcgtgggagacaagagcaatgtgaggtggggggaggagggagggatagcgttaggagatatacctaatgctaaatgatgagttaatgggtgcagcacaccagcatggcacatgtatacatatgtaactaacctgcacattgtgcacatgtaccctaaaacttaaagtataataataattaaataaaaaattctactttcttcactcgactgtagggtggtggaagaggtcaggggacctgtctgccctgtttgccatcccgtccctagtgcctaacacggagtaaaccctaaacattcatggaatggatagcactgctgttcacagatagatgccttacctactttcatttccttaagagtgttgtggtgtacttaaaaaaagaaagccattttattctacattattctacaacacaaagggctgtgctccagtgaaatttgaagtgcctcttgtggattgtgctttgggtaaagttcatttaaatcaggtacttataaatgttaggtcgattacaaatatggtgtcccattttcttttctaacctaaacgagatgttttaaacgagtctcattctatccggtaagaataaggaaggaggcaagtaaacttattttttggaccaagcggccacgaggtcataagacctaaaaatctttacactcccagccagcacctgctcattaattatctgggagactggtaaggatttaaaagtaattttttccttaagcccaggaatcatttaaaaaatctgtataacatttttttctcatgtagtcttagccccgaagaatattaagtctatcaattaggttataattcaaatcttatcaagaaataaatgcttaataaatcaagattaaaaaaawttttcaaagcagtgtcttttaaacagtcatgttttaaaatccccatcaaaatggtaaaattcattgtgatcctgacctctgatgctgtcagccacaggaaggggcaaaacracttgaggcttgaagccgtgtstttcccgaagctcaggttcaccaaacatggtctccagatggagtctgttcctcagaacctgggctttacttcttgatgggagaaggaagcagtgttaaaacttgtctattctgaactagccaaccagattaaaggaggggtttgtgcataccarcatcatcccagaatgacctgaatgactcattacatgcagacagtggtgcaaactcattaacaagtaaacaactcacaccagtgctctgtgctcacagggctgggggcgttcttgggtatttttcttaagggaggctggargaagggaggaggcattcctttctcctagaggcaaaggccagttccttttgctgtgccccagacctttcctggttgttagaaactcttccaggccttttcttgggaaggtgctctcatccccacacccctgcctcctccctccacctgttgtgcactccctgagagaaacaaaacaacttaatcagcttattcagctacttgggaagctgaggcggggggactgcttgagcctaggagtttggattcagcccgggcaacatgtcgagaccccatctctaatttttttttaagttttawtttttttaatttaaataaacatattcaggctagtgcacgtactttggttctctactgaagtaattcaccctaaattgaaactagcattgctagtttagtgtattactcctctctaggcagcctctctctctctatatataaatatatattttgtttgtttgtttgttttgttttgtttttttgagacagagtttcactcttgtcgcccaggctggagtgcagtggcacaagctaggctcactgcaacctccacctcctgggtttaagctattctcctgcctcagcctscygcgtagctgggaccacagaatgtgatcccacagctgtgaccacacctggctaattttttatttttttgaactggagtctctctttgttccccaggctagtcttgccactatcctagtttttcttctgtattgttagacagggcctcagtgtccttgaactgcaaggaattaacactgagcgtagtattagtaaaacctatcttctactcatgaaaagtcaatcatttttttaaaaaaagattccacaattattataagcagaaacaaattaaaaggttgtatacctactgtttgaaaaacacgacttaccaaaccaaacataagaagtatgtatacccstatatttatgaaataaatagaatccataatttaaaacttcctcacaaaaacaatcccaagttcctgatggcatcactggtgaattcttcaatgaaagggaaaaaataacaccaacattacagattttttttttttttaatcttagggacagggtctcactatgttgcacaggctggagtgcagtggctattcacagtcaygttccagtgatcctcccacctcagcctcttgagtagmtgggactacaggctgcagaaacttttaagagaacaaaaataaagggaactcctgagctcaagcacttctcccatctcggcctcccaaagtgctgggattacaggcatgaaccactgyaccccgcttagtgtgctgtttttaaaaatgacttttgggcttgtgttcatgtgactgatgagcctgtagttttactttttgtaattttttagactacttttggtatcaagtttattgtaatctcaaaaaatgagcatggctctgttccctttatttttgttctcttaaaagtttctggccgggcgcggtggctcacgcctgtaatcccagccctttgggaggccgaggcgggcggatcacgaggtcaggagatcgagaccgtcctggctaacagggtgaaaccccgtctctgctaaaaatacaacaaaaaaaaattagccgggtgtggtggtgggcgcctgtagtcccagctaccagggaggctgagacaggagaatggtgtgaacccgggaggcggaccttgcagtgagctgaaactgcgccactgcactccagcccaggtgacagagcgagactctgtcccaaaaaaaaaaaaaaaaaaacaaaaaaaacgtttctgtagcctgtagtcccagctactctggaggctgaggtgggaggatcactggaacgtgactgtgaatagccactgcactccagcctgggcaacatagtgagactctgtcactaagattaaaaaaaaaaaatctgtccctaaaattaaaaaagaaattctgtagtgttggtgttacttttccctttcattgaagaattcaccagtgaagccatcaggaactgggaattgtttttgtgggaaagttttaaattacagattctacctattactagacataggagtttacatacttcttctgtttggctttggtaagttgtgtttttcaaacagcaggtgtaggtgtacaacctttcaatttgttgctgcctctaataattctggaatctttaaaaaatgacttttcatgatgaatagaacataagttttactaatgctataatcagtataaattccttgcagatcaaggacagtgaggccatgtctrataatccagaggcagaacttggatttgggarataactcccscctcttgcactctctgtgacaagtctagtttcgatatcaagtttatcttaatctcaaaaaatgagcttggctctgttccctctattttctcttaaaagtttctgcagcctgaagtcccagctactcaggaaggtgaggtgggaggatcacttgaggccaggagttcaaggctgtttactgaaacaatcaggaatgagcattcccaagagaatacaattacaaaagtaaaatcacctagagctttggggctgcttaaaaagcccagaaagaagtaccaagtgagaaaataatcaaattcagtggaaaaactcacttgagggtatcatggtcagctgggtttccacccctttgatgcacttcaagtcctgtgtatcccacaaagacttgctcctttctaaaggctatggttcacgttcaacagaatagcagcaaccgccataagcctgagggctggctagtctttaatattctgccctattcaaagaaatgagtctttccctcatttgtaaagatctcccaggtccgttacaaaaaaagaaggagcagctaggcacagtggctcatgcctgtaatcccagctctttgagaggccaaggtgggccgatcacctgaggtcaggagtttgagaccaccctggccaacatggtgaaaccccatctctattaaaactacaaaaatcagctgggcatggtggtgtgtgcctgtaatcccagctactagcgaggctgaggcaggagaattgcttgaacctgggaagtggaggttgcagtgagccaagatcacgctgctgcattccagccttggggacagagcaagactctgtctcaaaaaaaaaaaaaaaaaaaaaaaaaaaaaattcttacctcctggaagtgttttactagtgttggtttctatttgacattaaacacttccccaggccagtgcattagcagttagctccttactgaatattatctgtagcaaacagtagctgactcctagctctcttcagtgaacttgatttaaatttatagaattcttatgacttctatttcatcttgaaccaagagattgcttccttttcctactgatttacctttcagttacatgtagactgaaccagtcccagccatctttagttggtctctattcaaacattgtacttttgtttcttgattacatcttcaattattttagttatttctgagattctcccctgyagtttctccagttatctagagaagagtgtggcaaggtacaaagagtgcctgaataacattatgaaggctgtgagacttcaaataaatgagtagcctctctgagcattaggtttgtcctctgtaaaccaggaataatttttactgaaccagggttgttctaaggrttagtgaaatgtatgtaaagcctttagcatttaataggtgatcaaatggtaagtgatgcttatagaatgtttttatcatggtaaaatatacaaaacataaaacttaccagccttttaatctaaattgtcttattgtgataggcttgcttatagtaaaacaaactctttttagtatctgtaggatctatagtgataactsttcactccttatattctaacttgtgcctaattagttaggcacaactctaattagttatctattgctgcataagaaattacctraaacttaatgtcttcaaacaacaacaagtatttattatctgtgataggcagacttctaagatgtttcccatgatctcaatgtcctggtgttgtactctgtatgatctcttccttttttagtgyggatgggatcactgctcagrcttttggatgaaatcgagtraacgtrrgtaggatctgtgacttgtttctaactgacgyaatattgcaaatgtgatgggttgttactcctgggatgtgtgtgtgtgtgtgtgtgtgtatgtgtgtgtgtgtgtgygcacagaagaaaggagagrgaagaggagaggaggaggaggagagagacatacattaggatatgagatagacatatwgctagcatgcacgcaagattctccttgctgatttgaggaagtgtgtgaccatattgagaaagcccaacagcaggtggtgtctaggacctgagggtggcctccagccaatacccaataaaaaacakagctacataatcatacagacataaggaaatgaattttgtcaacaacctsaatgagcttgaacccagctcagctgacaccttgcctgcaaccttgtgagagcctatgcagtgaacccagttgagctgtgccccaattcctgacccacagaaaatacgagasaataaataysttttttytccctttttttttttttttttgagacaagagtttccctcttgtttcccaggctggagtgcagtgrtgygctctcggctcactacaacctctgcctcctgggttcaagcaattctcctgcctcagcctcccagktagctgagattataggcatgcgccaccacacgcagctaattttgtatttttagtagagataaggtttctgcatgttggtcaggctggtctcgaactcctcacctcaggtgatctgtctgcctcggcctcccaaagggctgggattacaggtgtgagccactgtgcctggccttttctcatatgtttatagcagcacaatctgcaactgaaaawatatggaatcagttcaaatgcccatcagtgaacgaatggataaagaaaatgtggtatatatgtaccatggaatactactcagccataaaaaggaacaaaataatggcatttgcagcaatctggatggaattagagacttgttctacgttaagtaactcaggaatggaaaaccgaatatcatatgttctcactcataggtgggagcaaagctatgaagatgcaaaggcataagaatgatacaattgacttggggacccaggggaaagggtgggagggggatgagggagaaaagactatacattgggtacagtgtaccctgctcgagtgatgggtgcactaaaatctcagaaatcaccactaaagaacttactcatgtaaccaaacaccatctgttccccaaaaacctattgaaataaaaaataaatttaaaaaaagtaaaaaaaccacttaaaaaagaacatgtattttcttaaatgaaatcctgacccacagaaactgtataagagaaaatatactagacaatatatgtatatttcctgagatgttcatttgttatacaacaatagcaaactaatatagagcttctgtgggtcctgatttgagaaatgctttagctgggtggttctgtcttggtcaatatgttgattargcctgcagtcatccgaaggcttgactgaggctagggcatccaatttcaagayggctcacttaacatggctagcaagtcaatgctgtctgttagcaggagacctctgtaatgtaatgcattaacttctgtagggttgcttgaatgtccttgcagtatggtagctactttcacccagggtgagcaaggtggaagctgccatrtgttttataatstagcctaggaaatttgaactatctttttgataacacaggtcagccayatttaatatgagagagaactacacaaggcctggatagcrgaagygaaaatcactgsgggccatcttggakgctggctgccacagagattagcaactggaatactgttttcaaagaaacagctttggctttttatrttttctctattatgtctttgtttttttttcattgatttcacttttatccttattatttccatcattttaatttcattcggcttaatttgctgggatttttgagatggatgcttagatcagtggggttttcttctttttctttttttttttttgagacagggtcttactgtgtcacttaggctatagtgcagtgatgaatcatagctcatagcagccttaaattactgagctcaagtgatccaatcctccctcctcagccttccaagtagctgggacracaggtgtgcgtcaccatgaccaattaactttttttttttttttttttttgctgtgacaggtctcactatgttgcctggggtggtattgaagttctggcctcaagcaaacctcctgccttggccttccaaaatgttgggattatacatgtgagccaccacacctatcatatcattgttttttagtactttgttttgttttcaaatacatgtgtttacgattatagatttcccccaccccagagttagtcacatcccacaagttttctacttttgtaaaattrtattgaagtataatatacctgagagaaagtgtgccatcttaaatgtacaggtggatgaattatcacaatgtaaatgaatctctgtaactagcaccaagataaaaaaaaaactactagttatttaaacctaagtttgataatattaccaattactttaaagttcatgtctgataattctaatacctgaagcacttgtgggtttgtttcttttttctgttttttattttgttcatagttttcagtcacttgatcatatatcctggsattcctggtaacatatacatacttctaatttttaaaaattgtacagctctagcataaagagtcytacaatgggtacttatcccccatctataactttttttacactttgttttstttttactctttctagaatttattattttactttttggataagtaatatagttacaagtttcaaagataaaaaattaygaaagaatgttagtgaaaagtctcattcttgcaatgccaccaccctcttcctgtcctacaggtaaccaccatgattaatttctggtatatcattccagagatagtttaraccttgtatatagaagcaaattatgtatactgcattcctgtgtctgttctgtactttgcttttttcacctgacattatattttggtgagttttctgtttagtacataatacattttctcgtattttaaacaactgtattctgttgtatgaatttatcataatktattgaatcagtccactgctgatggacatccagtttgtttccagacgtttgctattgtgataggctgaataaaagatgtccacaggctgggtgcggtggctcactcctgtaatcccagcactttgggaggccgaggtgggcggatcatgaggttaggagattgagaccatcctggctaacacagtgaaaccccgtctctactaaaaacacaaaaaattagccgggtgtggtggcatgtgcctgtagttccagttacttgggaggctgaggcaggagaattacttgaacccgggasgcagagtttgtagtgaaccgagattgcaccactgcactccagcctgggtgacacagtgagactccgtctttccaaaaaaaaaaaaagatgtccacattcaaatccctgaatctaggagtrtattactttacatagccaaaggggccttgggagtaaggattgtgagatgggcagaggagcgtgtatcatccaggtgggcacratggaatcaatcacaagcgtccttataagtgggaagaagaarcgtcagactcaggyaatacgaagatggaagtggtggttgcagtgatayacgatcatagagccaaggtgtgtggaaagccgtcagcagaaggaagaggcatggaaacggactctcccctrgagcctccagaaggaaccagcctttgattttagctccgcaagacgcgttttggacttctgacctctgggctcataataagataagtttctgttgttttaagctgctacatttgtggtaactaattatagcagcaataggaaacttagaagagctgtttttacaattataagcaaagctgcaagaaacaatgtgtatctgasaytttgcatttgggcaagtatatctgcagaatgaatgtctagatgtggactaggtrgttagttttgataattgttaaatcactctcctctagacrggttataccagtttatacttctagtagcaatatgagtgaatacctctttcgcacagcctcctcaactcaatgtgttaccaaacttagaatttttactgttctgctagtaaaaagccctaatttctttggataacttactaattattgagtcttcctcatctgcacaacatggttagaagctccttcagagttacgyctgggtccttatttctgtttttttctccactgcatacctttgtgtccttcctgttaaccttatatagggcgggctccctgcacagaaggaggagatgatatactcaacagcatctgtgcatgatagttagaggggaaaaaatgcgatgtagaatccattctatccatctatcaagttccatttaggaaaacaaaatgttagaactaaaatatcctaatcacaataattgactagtgaagactgaagaagtggttgcctagcaatgccctgatcgtctttgatgttgactggttgacataaggcgggatcaacaaacacacagcacgtgtgtggccctggcacctgattcagatccttcccactaaggtcaacaatacccaggctcttggaggcagccactcctcatygattatttgcacatgagataaacctgtttgttttaccataytgaaggactaacagaagcacaaactgtaactmaagtgcttttccagtgaagagtgaaataggaaagaatgaaaataacatatatctacccccctcctcctcttcctttagcttggggktcatcattacctccatttctccrttttatttttrtttcctttttattggcaccaccyaygtryrtgtgtrtgtgtgtgtgtgtgtgtgtgtgtgtgtgtttttgagattaaaactttagrgaaagaaacagctctcttaaaaatgtcagcaayttcaattcattgctttttaaatatcctsgttaatwatttacaccyttggttaaaatattcaatcatctacttaatatatagtgcttacctttgtttttattttattttttgagacatagtcttgcttgctctgttgtccgggctggagtgcagtggcccagtcttggctcactgcaacctccacctcctgagttcaagcaattctcatgcctcagcctcccgagtagctgggattacaggtgcccaccaccatgcccagctaattgtgtttttagtggagacgggctttcaccatgttggccaggcaagtctcaaactcctgacctcaagtgatccgcccgtctcggcctcccaaagtgttgggattacaggcgtaagccatcgtgtccagcctattgcttagctttaatgtgaatyagtgttarcatatacattcagaattctttaaacttcaaagaaaccacaaaattatgtatcatggaaatacaaatcagaacaaaaatctattgactgtgagcccacaaaacataatttttgtttcctgaaaacagaaaagtatgcaaatgaatgaggccttttaagggaatcttgtggcttctcagtccttgctgttctgaattggtgattatcaacagaaatgcccaacaggtgattctaaagatactggtaattctccacccttatctgattgcacctacattttgcttgttgctcattctgcatgacacctaaacgctgcatgacacccaaactcattctgcatgacacctaaactcaggtgacacctaaatgctgcatgacacccaaactcattctgcatgacacctaaaccctttagcagtcggccaaaaggaggaaggagggcgtgtttatgaaacagacagctgtcgtgagtcctggcgctcagcttcattcactaatcagttgcccgttggtaacttgattacagataacttcagtgtgactcaggctcgtttgccacagctgtttctcttaaaagttctctgataagtcattgccaccactacttccaaatagcrtaygttaactttgagttaattttasataaacyygggttaatttacamaattttggcaccaacaacatggttaggcaagkcagcatggatgggtatwggaatcyrtcaatctggkttgctgtrtaccagctctgggactgggggcaagttgtagcagccctgagcctsctgcttcacctgtatcaggggaggctgagacccaccttgcaggggtcttgtgaagattaaatgcagtgctgtgtgaatggtgcctaccttcgtgcccggcctgtcaasaccaggcagtttacacaaaaacacttgatattgactatgaaacaagatccrgaagagaacaaatataaatacagatggatcagctaaatgaaggactgycgagtaaaaacacaaagaagatgtttgtgagtggagggggatggatctccttcyccacccagcagtgaatatcatgggaatctctctctacctgaatctacctcttataattcttaaattaagaaccattagaactcttctaaactttctaagtactcattacagtatgaaaccctgcccgcctcccagacaacttcctatggacattagattttttaaacataggatatgttaagtgatggtcttcattcctcaatgtcacattctaaatttgtattactttttcttcattttccaaagctccagctcagcatctttgtatgccatatatatatatttaaaaagtctcagtggtctttttatgtgtcagtttctacaccccagcctcaggtagtgtaagcttcatgaggacaggaaccagccctgcctgctcacgctgtcaccagcatgtttgcagggaggacacatgacagtcaggtattggttgaataggtaaatggaagactggaaaatgtaggctggactgagaacttgtggatagacacacctcagtgattagtgaaaaggaagattggtccaaagcaatgtttgttaaccawattttcattatcaaagaggaaaaactaaacattccctaacagaaatgaaaaaggaataaaatttttgttagatgatgttgarctttgaaaggccaccaaggacactttyaatatcaaatcttcctcatccccccaactccagaaaactagtttttgctcagrtaytggctcagtggaaaatgtgtggtctgaagctgtagtctcctagtttgtgagcttattttcgctgcctgaaggtttgagtcaccgtagaaggggaggaggggtggtggagatcagaagtgaggtctgaactcccgggttgacttaggtgcggaggggatgacttaggtgcggaggggatgaggtagaactgctggcagggaggccccatctgatctgagagtgagcttggcaggcagaaagcacttgacaaagcccagggaatggtcgggagagactggtagatccagcactcctattccttgaggctggtcagtgatgtgtattaacctaggatggctaatgtgttggtgaaagggatccagctacaactccacactcctgagtcggggcccagtgttgtgcatttctgtcaaaaatactgcaggggactgccaggctgctctttccacaggccacactttgagaagcatggcgttaactcacctgtgcatgttacatttgttaaagggtaacttttcaaaaacagggaaaactatcattcatatagatataaatgttattttattaatgaagtgagcagtgagatgttacaaccagttcaaaagggaacccaaagggacggacacatctattactcagaatattgaaataaactggaaattgatgcataagtggctttgccacatggagaaggattggctttccaaggcaggttgatttgcatgtttataaacaagaatcatttgcrttatcwgttcttttcaacttcacataccataaaacaggtgaaaggctagactagaaaaccttaaaggggctgggtgcggtggctcacgcctgttatcccagcactttgggaggttgaggtagacatcwcttgaccccaggagttcaagaccagcctgagcaacatagaccctgtctctacaaaaaaagttccaaaaattagctgggcatgatggcatgagcctgtagtcccagctactcaggaggctgaggtgggagaatcccttgagccagggaagtggaggttgctgtgagccaggatcatacccttgcattccagtctgggtgacggagggagatcctatctcaaaagtctgaaggagtgtgatctaaacaatgtgtagtgtttccactgaagcacagatgttttycctgtgatttgtagtgattggcattttyaaactgcaggttsctgtcyatattmacttgacagtttgtaataactgcttgagattagcagtttgtctgtttcttcagtttagttaattgtcatatgtarctcctctgtgtaatatgagaaagtaatgagaattttttttttttcttttcagacggagtcttgctctgtcaccaggctggagtgcagtagtggtgcaatctcagctcactgcaacctccgcctcctgacttcaagtgattctcctgcctcagcctcccaagtagcagggactacaggtgcatgccaccacgcccagctaatttttgcatttttagtagagatgtgttttaccatgttggccaggatggtctcgatctcttgacccgcctgccttggcctcccaaagtgctgggattacaggcatgagccaccacacccagacatgagggctcttaaatagaattctcatctataaaaagtaggtactgtcagtattcccctcacataggtttatgaagaaggcattttaaaaagagaacccctgtaatcgatcagggaccccatctgccttctctgtgggcgtaggataaattcttttgattayytctatttgatataaaaaaatctgtarttaaaatataccatttgcrttatccataatagccaaagggtggaagcaagccaagtgtctatctgcaaatgaataaacaaaatatggtatatatatacactatatgcagtagaatactattcagccttacagagaaaggcaattctgacacatgctacaccatggatgaacctggaagacattatgccaagtgaaataaaccagtcaccaaagaacaagtattttatgtgatcagcttcttgataatctccaaaatagccaccttagcatattgaatgtttgaagctgaaggaawctcagaaatgacaggaagaacactctgaccttcccaccctcttctctgacgcaggtcacaaggcccttgggtgagaggtgccctctctgtccctggaggaaggaacatcyttctctctgaagataacgctgaatcgaatctgaatgatacktcctgctgttcctcccagtttactacgcttagctcctacccctttttgtcctctcrcaattttctgcttctctccacttttcatcaaactgttaaaaattatgggaggccattcttttgggctgagctcctgcactagccctcaacagatcagaccaaaccaaaatggagttacttatgctaaatgctgtgtcatcaaactgaaactttaaggaagcagatagatccccaaacagaccagtttttcctgaaaacatgagattccagtctacttraatcagcggaagaaggaagtcccctctgctttaactattamaaaaaagtaaccgaagtagcttgatgttaaccamtcaggtttttctattctgtttccttgttgctacctcataaaacckgtggttctgctattgcccagtgggagctctcattctgttttgyagagtggaaggtgcccagattcatgaatcatgaataaaagccaattaaatctataaatttgttgtagtcctctsataatataaaacctaatttgtaatttagtcttttgacgaacctaatatamaaagacataggtttaactgtttcttcaggtctttatttccttacaaaggttcctagttagatcaagttacttccagaaaagtcaatttcttctgtgtcatataaaacttatattaagtaaatgtgtatgmttttctcttgttaatctgtcttttggtacaagagccccagccaagaaattagaagggtggaggaaaaatattkttcctcccttacatatgattccacttayatgagatacctagatcagtaaaattcacagaaacaaagtagaatggtagtcaggctcagtggctcattcctgtaatcccaacatcttggaaggataaggcgggaggatcacttcagcccaagagttcaagaccaggctagacaacatagtgagacctcatctctactttaaaaagaaaagtcaggtgtggtggaacatacctgtagtcccaactactggggaggctgaggtgggttggatcactcgaatctgggggttcaagctttcagtgaattatgatcatgccactgtactccaacctgggcgacagagtgagaccctgtcagaaaaaagaaaaaaaaagggtagtttggtkgttgccagaggctggggtagagaggaatgagggcttattgcttactgggtacagagtttcacttcgggatgatgaaaatgttctggagatggatggtggtgatggttgtacaacagcgtgaatgcacttaatgccaataactgtacatttaagactggttaaaatcgggctgggcacagtggctcacgcctgtaatcctagcactttgggaggctgaggcaggcagatcacgaggtcaagagatcaagaccatcctggccaacatggtgaaaccccgtctctactaaaaatacaaaaattmgctaggtgtrgtgrcgggtacctgtaatcccacctacttgggaggctgaggcaggagaatccttgaacccrggaggcggagtttgcagtgagctgagatcgcaccactactgcactccagtctggtgacagagcaagcctctgtctcaaaaaaaaaaaaaaaaaaaaaaaaaaaaaatatatatatatatatatatatagttatatatactttaccatgataaagacattttataagcaccatttaccatttgatcacctattaaatgctaagtgctttacatatatttcactaatccttagaacaactttgttcagtaaatattattcctggttcacagatgaggaaactgaggctcagaaagattatttatttgaagtcttacataggctttataatgttattcatgcactcctttatgccctagatagttgaagaaattgcaggggagaatctcagaaataactaaaataattgaagatgtaatcaagaaacagaagtacgtttgaatagagaccaactaaagatggctgggactggttcagtctacatataattgaaaggtaaatcactaggaaagggaaggagtctctgggtttcaagatgaaatagaagtcaygagaaytctataaatttaaattcaagttcactgaagagagctaggagtcagctactgtttgctacagataatattcagtaaggagctaactgctaatgcattggcctggggaagtgtttaatgtcaaatagaaaccaacactagtaaaatacttccaggaggtaagaattttttttttttttttttttttttttttttttttttgggacagagtcttgctctgtcccgcaggctggagcgcagtggcatgatcttggctcactgcaacctccgcttcccggtttcaagcaattctcctgcctcagcctcgctagtagctgggattacaggcacacaccaccacacccggctgatttttgtatttttagtagagttggggtttcaccatgttggccaggctggtcttgaactctcgacctcaggtgatcctccccccttggcctctcaaagtgctgggattacaggtgtgagccactgcgcctggctgctgctcctttttttgtaatggacctgggagatctttatgaatgagggaaagactcatttctttgaataaggcagaatactaaagactagccagccctsaggctcmtggtggttgctgytattctgttgaacgtsaaccmtagcctttagaaaggagcaagtctttgtggaatacacaggatttgaagtgcawcaaaggggtggaaacgcagctgaccatsatacyytcaagkgagtttttccactgaatttgattattttcycatttggcacttctttctgggytttytaakcagcccaaaaactctagrtgattttacttttgtaattgtattctcttgggaatgctcattcctgattcctcgttwcaccaaacagtaggtgtgkaacytkcttatttgtttctgmytatartaattctggagtctttaaacaaaacgactgtgactttycatgatgagtagaagatagrttttactcatgctacaatcaatattaattccttgcagttcaaagacactgaggccytgtctaataatayagaggttgaacttggacttgggagatgactcctgyctctcrtactctctgtggctctgctttctgttattttactcataagcttgttttgtctccttgctgagaaytgtcaaacatgaaatgtaatttcaggctatagtgaagaaggatgacataggccgaaaaaattggcaatcatttggcctgtacrtgttgcttttkttttttttctggacttargatrtagaccaaaccttgacakttctggcctttgagtctttcacaactgtkattataatrcattagctcttctagaagttagaagtgactttggattaantctttcataaggtggctaaatgaattwatatggctcatcagaattcactwgattggwwaagcaggaaatttacagagakttttttctttgctgtaaatgtttttctaaattgaaaaacttctawtactgtcttctggaatactakaaataagtgcaagtgattgtttttggcaggaggccacataaacatttctgcttctctgtgacttatgggtagcattsatatamattgttaaaaataatgatcgtagatagataatgwdtcagartttgggctcascbrctgtagctgctgttgacccagaggaaccactgggakcctcacatctcagggcagcacatcgtttgcagcaatggttggttctgtacaaccttttatgaaattaggtgaggcccttgattagaatttgttttttaaaaggtttaatatgagtttatatctctaaatatcagtttctaattttttttaaargcctatgtttacaacaaatttgggagatacctatatgcwctactaactagtgttcttttgtggtgctttagaaattctggcttacttgtatttttgctggccttctaatgatttcactcatcaatcagaagatatttgtgtccacctycctgcttcctctcyggtgatcttgtctattcttggccattttagagttgacttagcagccttcacaaaactggttggaatttccactgggwttaaattgataggtcatttttgggaganctttgcaatattgaactttccaatccntgaacttatctgcccatgtattatgtttgtttttggtagattacaaaattatatgatcactccaaaaattaccttgccctttatagtaaaaccttccattgtaaacttctggcaatcactgatctgtgttcctctagcattgcttttttttcagaattttatacaaatggaatcgttcagkmtgtagcctttgagtctggctactttcatgtactkyatcaacagttattcctttttattgccaaatagtaatccattgtataaatactacatggtttgcttattggtttgtcattggaggaatatggactattttcactttttggtaaaytataagtggattggaattcacaaagtgctttttgtctgagcataggttttcatttcacttgtgcaaatgmctaagggtgtaggattgctgagtcacatggtccgtgtacgtttgactttatcagaacctgccaaattgtcttccaaagtgctgtgccacttctgtttctttaataaatacaggggtattcaagctgtctgtttsttcttgagttttggtagtctgtctttcaaggaattgatctatttcacctaatttgtagaatttagaagcatatagttgtttgttttgtttttgtagtatccattctagccttctagtgtctacaggatttgtaataatcctttcatttctggtattggyaatttgtgttttmtcttcttcctttgtcagtctgctagaggcttcctcatttgattgctttccaccttccaccacccctgcaaagaaccaactttggattttgttgaatttttttcctttactgtttttgtttaaatattactgatttagtctgtttttcttatgcctgatttgagtttatttggttctttttttacttaaagtaaatgcttacattattgatttgatgcttcatttctcataatttagtgctataaatgccctgtaagcacatattttgataagatgatgtcatatttattaagttcaaactgttttccaatttttcttaagacactctctttgacctatgggccatttagaagtacgccatttaacttctcatatttggggatgttctagaaatgttctagattcctagtttaattctgtcgtcagagaaaataattcactgaattttaattgtttaacttcagggtttgttttatsacycagaatatgatctctcaccaccgccatccagataattcttcaggttttgacgtttcccaacctgtctgctggttacttttcagagtwcttggatcattrytatttatattttgtcyagagtttcaaattgtgatcagtggaaaygacaggccrtagcatacrtacgccatcctgrccagcatyacaggtggtcagtacatctttctgttgttgttttgagacagggtctcactctgttgcccaggctggagcacagtggcatgatcarggatcactgcattctcaaccggctaggctcaagtgatcctcccacctcagcctcccgaatagctgggtctayaggtgtgctgccatgcccagctaatttttgtattttttataaagacakgattttgccttgttgcccaggctggtctcaaactcctgagctcaggccatcctctcactcgggcctcccaaagtactaggattataggcatgascaccacacctggccagtacatcttaaaaatgatttctgatccacgttgaataatgatggcctataaataytttttcttgcacttgcyttgttgggttttgatatcaagrttatttttattttaaccttataaaatgaactggggagtcttctttytttattctctcagtttgtgttagtggcagagtttttkktgtttggttrgttggtttctctttttcttgtatgtttcayggaactttttggtgaaggcacttgggcctrsaaatttctttatggsaagwtttttcatkactgattcaatatatttaatctatgtaagwtttttttctacttttkgagtcaattttgattttttttttccaaaaattcatatctcaccaagtatggtggcttatgcytgtaatcccagcactttgggaggctcaggtgggaggaccacttgactacagtagttcaagaccagcctgggcaatatagtgagactccatctctgcaaaaaaaaaataaaaattagcttggtgtggtggtgggtgcctgtagtgtgagctacttgggaggctgaggtgggaggatcatttgagccaggaaggtcgagactgcagtgagctgtgattgtgccactgcactccagcctgggcgacagaatgagaccttgtctcaaaaaaaaaaaatttttttcatctatgctttaaagtctgttggcataaaggtattcataattttacattatgaatttgtttatttgagacagggtctcactctgttgcccaggctggagtacagtggtacaatcatggctcactgcagcctccgcctcccaggctcaagccaccctcttgcttcagcctcccaagtaggtgggaccacaggcacgtgccaccatgcccagctaatttttgtatttttggtagagacagggttttgccatgttgcccaggctggtctcaaactcctgaacttaagcattcctcccacttcggtctcccaaagtgctgggattacaggmgygagccatcgttcttggcctgcaagttatgacttcctttcagagtctwtctatctgtagtacagtcctcctgtgcaagattgttttttgactgctttttcttgacaaatcttgctaaaggtctgtgaattttataatgtatttttwaagarccaggttttagcagggcatggtggctcatacctgtaatcccagcactttgagaggcaaaggtgggaggatcgcttgagcctgtaagggggaggctgtagtaagctgtrattgagcgactacactccagcctgggcaacrgaatgagaccctatctgaaaaccaaaaaacccacaagttttagcttggctgattctattgtgtgtttcttttgtatttcatttgtttgttatgtttttcctttttctttctttgaatttaacttgttctttgtctgatttattgactgatgcttagttttttttttttttgagatgtagtctcgctcgctctttcaccaggctggagtgcagtggcacaatctcggctcactgcaacctccagctcctgggttcaagcaattctcctgcctcagcctcccgagtagctgggactacaggtgtgcaccaccacgcccacctaatttttgtatttttagtagagatggggttttaccacgttgggcaggatggtctcgatctcttcacctcgtgatccacctgcctcggcctcccaaagtgctgggattacaggcttgagccactgtgcccagtctgttgatgttttttccaagttccttttctaatgttctcatttaagactataaatttccccagcctggacaacatggtgaaactttatctctaccaaacacacaaaaaattagcctggcgtggtggtgtgagcctgtggtcccagctactcaggaggctgaggtgggaggctcacttgagcacaggaggtggagggtagtaagccaagattttgctactgcactccagcctgggtgacagagtgagaccccatctcaaaaaaaaaaaaaaaaaaaaaagactatcattttccccttatgaatggatttaattatatcctacagtttttaatatgtagaactgatgatgaatttgccttattttatcttcaagctatgggctatttaaaagtatacttttagaaagtttctaaaattgttaccagaaattgtgatctgtccactttcttagaaatttgttacttaacactcgtctatatggttaatttttgaacktgtccacattttcttgaagggaagtctgtttctgtagttaaatctcatgttctatatgtttgcattkagtatttttttcatagttttaaatcttcatcctccctaattatttttatactttatttactgagagatatattaaatatcctactagaagcatggatttgtctgtctcctcatctgtcaacttttgctttttgaggctgtacttgggtgcatatgattcaaaaaatatacatctttttttaatttgaacttttatcaaaatgaaatgttttccttcatttatgtatgctttcaacattacgtatgatatagctatagtaactttggttagactttgcactgtgtatctttcacgtgtatgtgtgtarttttttcccactgtgctgcccaggctatagtgcaggggctgttcacaggtgttcacaggtggctcmctgctgccttgaactcctgggctcaaatgatcctcctacctcagtctttagagtgatgtgtgccaccaccgccaaataattgtttttatttctttagagwtagagtttggctatattgccaaggctggtcttgagytcttggtctcaggtgatcctctcacctctgcttcctgagtcactgggattacagacatgtgccgccaagcctrgctcctctgatacgtattttaataccttttaaaatcattcaatatctttgtattttaaatatgacttaaaaatagcatggaatgagattttaacaatttatccatctttaaytggattacttaktccatttgcatgtatttgtattctgacatacttrgattctgtatagatggtgagtggtgtgtatgtacatgcatatgtgtttgtgtcattttgtcactttctatttatcctacttatrtttctttttttcctttcttgccttcttttcaattggtgggatattttttcttctctagtcattttaagttctagtctttgtttatattcttttagtaactgtcatgctaatttaaatgtgcatatttaagttatgaaagtctaaaatttatcctcctcctgggtgataggataacttargaatactttcatcgcattaaactcctcttgagttatgctactacagtatattttcaactttttattttgacataattgcagattcacaggcggttttaagaaataatagaaatcccatatagtcttcactcagtttctcccaatggtaacatcttgcgtaactaccttkttcatatttcaccagttttatgtgcacttttagktttttttgtgtatttagtkctatgaaattttatcgtgtacatagattagatacctaaycaccatcaccatcgtcaagatayagaasagttccatcagaaggatggatcccttgtgctacccatcttatagtcacaaacacgttcctcactycctgacccctggcaaccactaatckgtttttcatctctgtaactttatttcaagaacacatgtaaatgaaaccatacactgtctgatattttgagattgagtttttttattcagcataattatcttgtgatccgtcaaagttgytttgatatattttatcatttttctttttatatttcatgggacattacttctattgttttatacgtttcacgtttgtttagttttatccatatattcacctgtctttttcctgctcttcatttcttcttatatcccagatcttccacttgagatcattttcttcctgcctgaaatctttttggtatctgtttagtaatggtttccttgggcgagctccctcaatttctgcacattttaagctctattatgttagtctcatacttaattttttttattgtggtataagaggcatacaggtaaggagatcatgaacgtacaactcaaaattttcacctagttaacacctaagaaatggatatgaccagcaacccagaagcctctcttctgtttcnttctagttgctgctcttacctcctctcgaggcagggtcatctgcctgccttagcctcccagagtgctgggattacaggcatgagccaccgagcctggcytaaaatgaccatcttgtcttttgagacagagtcttgctctgtcaccccagctggagtgcagtggcatgatcatggctcactgcagcctcaatctccctggctcaagcgatcctcccaccttagcctcctgagtagctgggacaggaggcacacatgccacacccagctcagtctactgggctcaagcaaaaggtatctcctattctgactttttacactatagattagttttcctattattcgctttataaatgcgatcttttcttttggcttcttttgtcagctttagacttgtgagttctatccatggtgttgcacatggccgtggtttgtttattgttgtgtgcattcagttttactaatattgcacaatatgtttatctgttctgctggtggctgrcattcaggttcttccaagcttgggtccattatgagtaatgccattataaacttttttttttttgagatggagtctcactcttgtcgcccaagctggagtgcaatggcgcaatctcagctcactgcaacctccacctcctgggttcaagcaattctccctgcctcggcctcccaagaagctgggattacaggtgcccaccaccacgcttggctaattttttttagtagagacggggttttgccacgttggccgggctggtctcgaactcctgacctcaggtgatctgcctgcctcagcctcccaaagtgctggaattacaggcatgagccactgtgcccggccctaaactttcttgtacttaccttttggtgcacacgtgtgtactttaatttgatctgtatctgggagtgcaagtgctttatagagtgtacgtacagttttaggagatactgctaaaaattttgcagtggctatatcagtttacactctgccagctgtggatgaatgttccagttgtttcccatccttctgttgtaggaaaggagtcctgatctagactccaagagagggttattggatctggtgcaagaaagaattcagggcgagtccatagagtaaagtgatagcaggtttattaagaaagtagaagaataaaagaatggctactctatagacagagcagcccgagggctgctggttacccattcttatggttatttctagataatatgctaaacaaggggtggattattcgtgccttttttttttttttttttaaagaccatgtagggtaaatttctgatattgccatggcatttgtaaactgtcgtggtgctagtgggagtgtagcagtgggaggaagaccagcggtcactcttgtcaccatcttggttttagtaggttttaggcagcttccttactgcagactgttttatcagcaaggtcattatgacctgtaccttgtgctgacctcctatttcatcctataactaagaatttcatcctataactctctgggaatgcagcccagtaggtctcagccttttttcccagctcctattcaagatggagttgctctttttcaaacccctctgacacttccatgtacttactatcgtgtcagcttttaaaaacttttagtctttctgatagatgtatagtagtatctcatggtgtttgtaatgtgaatttctgtaatgcctaagtagggaagggcatcttctcatgttttaatactggtcatttagttgttctctttgggaaagggcctgctcaggtctcttgcctagctttctattgggttacctgtcttcttgtttaaaattactgatttgtaggaattcttatattatggaccaaagttatttggtcatattctacccagtattctctgaatgattatttgaataaagatgattaattttgctatagtgcartttatcagtattttcctttatggataacgtttttggttgcaggggagttttgaactttctctcttttccctgaaggttcgataatttgagtctctgtaataaacttgacagtagccagattagcaggaacagtggcatacagcctgatgatgtgcgtatgcacaggagtccacgaaatatgagactcacagaagagccaggtggttgaagcttagctagcaatttgagctgcagaaagaaacaggagcttaaaggcccctggatggtagtggcgacaagctatgggagagcgaggggaggaactgcactgggaacaaaggctcttatgcagaaaaaagtccctcaggtagcagccttcagaataggtgaaaagtctgtctggtgtggtatcctgagtgtggagaccttttagtttcctctgtttccataggagtctggttaatgtagatcccaggaaggagggcagggtttatgacagacaacagcattcctcctgggggaacttctcttaatcaaataagtgaaacttcggagaaagcactgcctgtatttgctgcttcccaggtgctctcaggttgaagtctacagctgcatattttggggtatttttttgagcccaacatgatctttatgaaaaattttacctaattctatgttatcttctagaagccttttcacatgtagcctgtctatctggaagggatttttatgtatggtattgttaacagtggagcgtgtgcaggttcttggcatcttgaacagagaattggacaaaacgcacaaagcaaggaaggaatgaagggatttatagaaaatgaaactacacgccacagtgtggaagcagctctgagcataggggctcaaagttcctgttacagagtttttatgagtttaccctctacttgaggtacaccctatgtaaatgaagaggatgaagtaaagttacaaggcaatttacggcatacaccttatggagaggatatttcctgttatagctgaagtgtgaattggcctgatgttgcctgcctccagaccctattttcctgcctcagtatcaagtaggaaactttttcacatggctatccagttgactttggcaccgtttattaaaatgaccatcttttcttttttttgtgacgaggtcttgctctgtcacccaggctggagtgcagtggcatgatcctggctgactgcaacctccgcctcctgggttcaagcgattctcctgcctcagcctcctgaatagctgggattacatgtgcctggctaatttttgtatatttaatagagatggggtttcaccatgttggccttgaactcctgatctcaggtgacccgcctgcctaggcctctcaaagtgctgagattacaggtgtgagtcaccacgcctggcctaaaatgaccatcttttcttttgagcagagtcttgctgtgtcaccccagctggagtgcagtggcatgatcatggctcactgcagcctcaacctccctggctcaagcaatcctcccacctcagcctcctgagcagctgggacagcaggcacaacatgccacactcaactttttttttttttttttattagacatgaagtattgctatgtttcccaggctggtcttgatctactgggctcaggcaatcctccgctttgacctccagaagttctgggattacaagtaggagccaccgcacctggcccatcttcattgttcttcagtgtcacctttattataaatcaagtactatatacatgggcatgcttttggcctctgtaagttccttttttaaaattttccacaagttattaggggacaggtggtatttggttacatgagtaagttctttagtggtgatttgtgagattttggtgcacccaccacccgagcagtataccctgcacctatttgtaatattttattccttgccccctccacacccttacccccaagtccccaaagtccattgtatcattcttatgcctttgcatcttcatagcttagctccacatatcagtgagaacatacaatctttggttttccattcctgagttacttcacttggaataatagtctccaatctcatccaggtcactgcaagtgctgttaatttactcctttttatgaccgagtaatatgccgtagcataaatataccacagtttatttgtctacttgttgattgatgggcatttgggttggttccacgattttggaattgtgaattgtgccgctataaacatgcatgtgcaagtatcttttttgaataatgacttcttttcctctgggtagatacccagtagtggaattgctggatcaaatggtagttctacttttagttctttaaggaatctccacactgttttccatagtggttgtactagtttacatttccatcagcagtgtagaagtgtttcctgttcactgcacccacaccagcatctactgttttttgattttttgattatggcctttcttgcaggagtaaggtggtatcacattgtggttttgatctgcatttccctgatcgttagtgatgttgggcattttttcatatattagttggccatttgtatgtcttcttttgagaattgtctattcatgtccatagcccactttttgatgggattgtttttttcttactgatttgagtttgttgtagattctggatattagtccttcgtcagatgtatagattgtgaagattttctcccactctgtgggttgtctatttactctgctgactgttcttttgccatgcaaaagctcattagtttaattaagtcccaactatttatctttgtttttattgcatttgcttttgggttcttggtcatgaaatccttgctaagccartgtctagaagggttttccaatgttatcttctagaatttttacagtttcagatcttaggtttaagtcctcaatccatcttgagttgatttttgtataaggtaagagataaggatccagcttcattctcccacatgtgcataaccaattagcccagcaccatttgttgaaaagggtgtcytttccccactttgtttggtttgttgaagatcagttggttataagtgtttgggcttatttttgggttctctattctgtttcattgtttctatgtacctgtttttataccagtaccatgctgttttggtgactatggccttatagtatagtttgaaatcaggtagtgtgatgcctccagatttgttctttttgcttagtcttgctttggctctgcgggctcttttttggttccatatgaattttaraatttgttttttctaattctgtgaagaataatggtggtattttgatgggcattgtgttgaatttgtagattgcttttggcagtatcatcattttcacaatattgatcgtacccatccatgagcatgggatgtgtttccatttgtttgtgtcatctatgatttatttcagaggtgttttgtagttttacttgtagaggtattttgcccccttggttaggtatattcctaagtattttagtttttttgcagctgttgtaaaagggggtgagttcttgatttgattctccccttggtcgctgttggtgtatagaagagctactgatttgggtacattgatttgtgtacattaatcttgcatcggaaaaacttgctgaattcttttatcagttgtaggagctttctggaggagcctttagggttttcaaggtaaacagtcatatcatcagcaaacgataacagtttgacttcctctttaccgatttggatgccctttcttttgtctgatttctctgggtaggacttacagtactatgttgaggagtggtgaaattggkcatccttgtcttgttccccttctcagagggagtgctttcaacttttccccatttagtattatgttggctgtgggtttgtcattgatggcttttattacatgaggtatgtcccttgtgtaccatgtttgctgagagttttaatcataaagtgatgctggattttgtcgaatgcattttctgcatctattgagatcatgycatttttttttaaattttgtttgtgtggtgtaccasatttattgacttgcatatgttaaaccatccctgcatccctggtatgaaatccatttgatcatggtggattatctttttgatatgttgttggatttggttagctagtattttgttaaggattttagcatctatgttcatcaaggatatcggtctgtagttttcttttctggttatgtcgtttcctgattttggtattagggtgacttggtaccaattcttctttgaatatctggtagaattctgctgtgaatctgtctggtcctagactttttttttgttggtaatttttaaattaccatttcaatcttgctgctcgttattggtctgttcagggtatctaattcttcctgatttaagctaggagggttgtattttttccagggatttatccgtcttttctaggttttctacttatgtgtgtaaaggtgttcacagtagccttgaatgagcttttgtatttgtgttgtcagttgtaatatctcctgtttcatttcttaatgaggttgtctggattttctctcttctcttcttggttaatcttgctaatggtctatcaattttatttatcttttcaaagaaccagctttttgtttcatttatgtttcgtcttttttgtttgtttcaatttcatttagttctgctcggatcttggtaatttcctttcttctgctgggtttgggtttggtttgttcttggctctctagttccttgaggtgtgaccttagagtgtcagtttgcactttttcaatctttttgatttaggtgttcagggctatgaactttcctcttagcaccacctttgctgtatccaagaggctttgataggttgtgtcattattgtcattcagtttgaagaattttaaaatttccatcttgttttcgtttttgacccagtgctcattcaggaacaggttacttaacttccgtgtatttgcattgttttgaaggttcgttttggagttgattttcgattttattccactgttatctgagagagtgcttgatataatttcaatcttcttaaatttattgaggcttgttttattggcatctgcaagtttcattggttgatttttctatattttgtttggttttggaaataagtataataaaacacagtcctgctcttaaaatgcatacaatcagttaaatagctaatttcaacataatgtgatgtggaagaaaaacatattaaaattgtgctgtatttaaagtttcataatagaaatgttaatttctttactaaagtgacccttctactgcagcaggaagactgtttttataattgaaagatagtttgcgttttattacttggcttttctttatagtttactgtacatgaatatatccctaaacacgtattattataattctgcctgttttggggcagcatctaccttatagcactggctgagggctgagctgagcgtggctccaagggaatccagccttgggcagtaggtggcaatgttgggcaggcagatgaaggctccgggatgtctggctagttatggggactgagctgtgggcagaattccagtcctgcgtgaattaaggctggtccccaaaccaagtcgaagagacagaacagactggaggaggaggtgggagaggtccatgatgagagccgctgccatttatttagcattgtgtactgagctctgtgcagggcacctaacagcctagcatgcagcaactcagttcccaccacctgtacccctaccgttttttttttttttttttttttttttttttgcaaatcacgaagagaaagacagttggaatgtggcagaaccaggattctatcccagtctggctgtcctcacaactctgaatcatcaggtgacaacagtgtcttgctagaattgccagttgctgctgctcgggagcagctggtgcctgccctgcaggatggtgccatgggcctggctgagctgtggctcccagcacgatgctgtttcttccccaggtctgctcagtgctgcagttcagcagggtggaggctatgctgtgcatgccccaatctcttctgcctgggggtgtgggcagagctgctggccttcatctctctgcttgtttctccagacatctcctcctactctgatagagacaccctgtcttgggacatccccccattcattccttcacggaaagtcagcctatttttgtattttactttgtggtcatcttcataatatttcttcgtggcatcgacagcagtttgtaactggggattatctgattgttatctctctgccctgtggaactataagcttcctgaaggcaggggccgcatctgagctcactgttgtatcctcatagctttacatggcacctggcatccagaagccttacatatttacttgatgaatgaatatatgaatgacttccttcaactaattttgtctcttacttcctagttgccaggtggtataagacagcagggttatcatctaatatatatttgatgtgataagaaactaaagtcttgttgggaacttcagtctcaattggggcaaatcaagattttgtgattctgaagcagtttggggagttgtctttaagaaaaagaatgctgattataaacacaaaaaagattataaatctgtcttttagaatgccaaaaagtataattaaaaatataaaaagctgaccaatgtcacaaatgtcataacatttgaaaaataacatttattaactaattgtccaatatatttctataatatcttctcctatatattttggctacatgttattatgttacctttgtataacaattctgtcataataacttcagtggctggaatagaaagataattaagtctttctattaatatagtaattacacttttttctttagtctaaaaatgttagacttgcataaatgtcttgctatattatatgaagactacatttttaagctaataagggccaccagtgagggaaaggtttacatactttctttaccttctctgaattcgtcattaggtagtagcatgtttgatggtagattttcaactacaggaaaagcatggtacatattgctggagcatcagttttacttgttagtatatatgtagaaacatttttatattaggacaaatggaaacatcagagaatactgtgcaaaatgtataatttaaagctcaaacaccagacttcataaggctataattttgacctaatagcttgacacttttgaatctaagacaataatcctgatttccatcatagtctttccatttgtttgtaggtatttagttgaatttagtgatttattttttgtcctttttttcattccttaactgaaatttaaacataactttttatagaaataaaaaggatatacagaaaaatgcacatatcataagtttatggcttgctgaattttcacaaagtgaacccactggagcgagatgctgtctcaaaaaaaaaaaaaaaaaaaaaaattgccacaaccccagaagtacctcctcttcttcctttccggattcaatctccatgcttgccaaggaaaccacagccctgacttctaacaccatgggttagttttgccagcttttgaactctgtgtaaatagaagtatacagtatgtacttatttggatctgacttattttccccaacattatgtttgtaagattaatccatattgttgtagatagttgaagatccttctttctcattgctgttccattaatatagcaccatttatttattccagtattgataaacatttgtatagtttcttgtttttggctattatgaatagtacctctaggctgggcgtggtggctcacgtctgtaatccgagcacttagggaggctgaggtgggtggatcacccgaggttgggagttggagaccagcctgacaaacatggagaaaccccatctccactaaaaatacaaaattagccaggcgtggtggtgcatgcctgtaatcccagctactccggaggctgaggcaggataatcgcttgaacccggatggcggaggttgcagtgagcagaggtcgcaccattgccctccagcctggcaacaacaaaagccaaactccgtctcaaaaaaaaaaataaaataatacctctatgagcattctagtacatgtttgttggtaaacatatgtatgtatttctgttgagtgtatcgctaaaagtggaaatgttaggttatatggtatgtatgtgactgactttggctagatattgccaaacagttgttcaaggtcgtgacttataatctcacccacagtgtaaggaagttcttttaatacattgcatgattgtatgagagatctcactgttccatctctttactgrcacttggtattttctgtccttttaattttagactttgtagtacctgtgaaagctgtttgtcattgtggttttaatttggatcgtagtttattacagacattttcaaaaagattctgcttcacaacttgtttttggtattgagtcaatgtttagaatgtcatatttggaaagacctctatcaacttttttcatgtataagctttaagatttcagggtatttcccatatgaaggagtctgatggaataaactatggtatggacaatggagtaccacgcaactatattaaaaaataaataggatgatctcagtgaactgatggggagtgattttatatgatatataaaatgaaaactgcaaaaggtatagctagaatgatgtatataccttttgtgcatatgtatatttatagtatataggttttgcaaaaaataagcaaaaggataaatgaaacatgaatgaaatgaaatacccacaacaggaggtgagtgggaatgaggtggaagggataggtgagggaacggggcttaaagctgcctataaaagtaactttaacacgcttaacaggtagctgctaaaccacgctaatgttgtaccgattcaaaactaaacatttacaaagacggaaaaaactgaaatatcatacaaacagaagcaagtagacctagtttattgacaagccacacagatattcattgaacttgtaaacacatttttcagactccatatgtttattggtatatatattctaaagacacagaccgtaaaggcctactgaacattactcagtctcttggtagttttgataytattttgtatgtattctgggattgaacaattgagaaactatatcgatgcttttggaaaacaggattctcactgcggaagaaagaatatgtaaatayggaaggaagaaaacaatatagtcatgttggatttgaactggagtgaatagtatgaatttatgattaaaaaaaaaatcctgactgtccactgaaaagtctagaaacaatgattgcccagtaggaatgagcacacagtgtgagacctcagttgctaaatatatttcccattaacagaagtaggagaaatggcttagcaaattggatgatcctggtattggggcatgaaaactacaaggtgagcctagaatattcggtgtgccacgaaagcaaagaggtgctttaaacatctctggggagtggctgacacggtggtttacacctgtaatcccagcactttgggaggccgaggtgggcggatcacttgaggtcaggagttcgagaccagcctggccaacatggtgaaaccttgtccctactaaaaatacaaaaattagccggacatggtggcaggtgcctgtagtcctggctacttgggaggctgaggcaggagaatcgcttgaacctgggaggcggaggttgcagtgagccgagattgcaccactgcactccagtctgggagacagtgacactctgtctcaaaaaacaaacacccccctgccaaaactctagggagtggtaaaagtatacagaaccagcttgaagggtctcccactagccaaatttggaagcatttgagcatcaaaaagaataatgttaataccttcgcagtggagagatctggcaaactccactgtaaccaagtcatcaagcttagaatcactaataatgaaacacaccaacatcacatgccacctgatatgatgtagtggaaaatatacagtatcatctatgtattctttttgctaaaagtgtttaatttgaatataattatgcacatacaatcagacaaattgtagcatattccagaacacaactggcctggactcttaaatgtgaatgtgaaagacaacgaaagatgggcatctgttctagaataaaggagacagacacaccagctaaatgcagtttatgattcttcattgaatctgatggattgcagagaaaaaaagaaacctagctaaaaagaaaaaggacaattgggagaaatttgaatatggactacatattcgataatattaagtcaagcttttcagtgtaatggtattgggttatataggagactgtctcaggatatacatgctaaagtacttagagaagcattatgatatttgtaacttaaatggttctgtgaaaaataaaagtgtacacatatcagaataaagcaaatgtggcaacattttaagaattcattgcaatattcttttatctttctgtaggtatagaatttttgaaataagttagaacagtgatttcagggcattttaaatatttttgtgcagtgactaatccccgtatctctttaaattaaggatactaatttaccattttgtcatctatggttccctaataggaaacctgttaatataactcatggtattaataaatccaaagaatgatgaagaggcattcataagtctaaatcctttctagtttaaaaatacttttaaagtaggaaaatacagatgattgccttacataataaaattatatatatttcattctaaatgctaacatcatgctttaaggtagcagaacctagaagcattcttattaaagacagggtcaataaaataaataatttctactgtcattattattattattattwtttttttttttgagacagagtctcgctctgttgcccaggctggagtgaagtgtcatgatctcggctcactgcaacctccacctcttaatcttaatccatttaaatgtgaaaggcaaaacaaaaacttttggaagatatgtcagtgaaggggtagcctgtcgctccacacctgtgggtatttctcatcaggtgggacaagagactgagaaaataaataagacacagagacaaagtatagagaaagaacagtgggcccaggagaccrgtgctcagcatacggaggacctgtaccagcaccggtctctgagtttcctcagtatttattgattactgttttcactatctcagccagaggaatgtggcaggagaacagggtgatagtggggagaaagcaagaaaacatgtgaccaaaggaactctgtgtcacaaataagttcaagggaagatactatgcctggatgtgcacgtaggccagatttatgcttttcttcacccaaacatctcagtgtagtaaagagtaacagagcagcattgccgccagcatatctcgcctccagccacagggcggttttctcctatctcagaatagaacaaatgtacgatcggattttataccgagacattctgttcccaggggcacgcaggagacagaggccttcctcttgtctcaacctcaagaggccttcctcttttactattcctcctcagcacggatcatttacaggtgtcgggctgggggatggtcaggtctttcccttcgcacgaggccatatctcaggctgtctcagtggggagaaaccttggccagtacccaggctttcttgggcagaggtacctgcggctttccgcagtgcgttgtgccccctgcttaatcaagaacggagaatggcgatgacttttaccaagcatactgcctgtaaacatattgttaacaaggcacatcctgcacagccctagatcccttaaaccttgattccacacaacacatgtttctgtgagcacaaggttggggctaaagttacagattaatagcatctcaaggcaaaacaattgttcagggtacagatcaaaatgcagtttcttatgtgttccttttctacatagacatggtaacagtctgatctctcttttccctagagtcagaaaatacatttctaaacttgggataggaaataacattttcacaaaggtaaactgtaaagaaagtgaaataataagacacaatcctgcagaagttctatatttgcaacatatctaacaggattagatttcagactacataaagaatttctacaagtcaattaaaatacatccagtgaaaaaayaagcaacatatggacaatagacattttgcagaagaagcaatttggcaaataaaatcacgggaaggcattaaagctgtttggaaaacagggaaataagaccatcgtaagatacgattttgcatctacaggactggcaataattaagtctgataatggattatgggtcagtggaaactcatacttctggggaaagtggaaattagtataatcacttcgagaaacaatttgacattatcacataagtttgaatatttgtgtagctattgactaatagatttcactgctatgtctaggccacaaagaaaccttcatgtggataccaagaaaccaagaatgttcatagctgtatggtctgcagtagcaaaaacctagaaatgaccacatgcccattgtgaggagcctgagtacattatggtatattcacatgatgaaatataacacagcaatggaaaagtgtgaaccacggctactcacaacttgatatatcccagtaacatgacatttaataaaacaagtctcaaaatcataccatttgataccattgttatagtggcattagcattgtagcagcaaagccaaacaatacggaagaattcatattacaatgttatttcacttttataaatcatagggataatgtatgcaaaactggtggtggtgtctttgggggttattcagggcaataggatggggccagcacacaagtggggccactggtattagtaatgttctggccttcagatgggggctggttcccagcatgtgccttttacattttattagggatggggtccacacacccttctgatgtgaaatgtcatgataatgatgaaggaaaamtaaataagaaatagcctctgtatataaagagtaatcagagttaatataggaagggaacttcctagataaaatgctaggagtaaatttcatgggcagtgtgcaagagcattgtgaagacattgagagtctgccgagagccacaaaggaaacttgaacaaaaagtcacaatttgttcttagaaaaatttattctcgatggattgataggtgcagcaaaccacatgggacatgtttacctacgtaacaaacctgcacgtcctgcacgtatattccagaatttaaaagaacaatttattcttataaagatgtcaattctccctgacttcataggcttaacattttataacaattttagagttttttccccaatctggacaagctgagaactctcagcaaatcttaaacgatttgaggaggaggacattttttaacgaaaagaatacaaaattaagaaaacgaaattaggtagaaaagctaacattaactaaaaacaagaaaataaattacaaatatttaaaagctgacaaatataaaacattaccaacttaaattcagaaaaatatttttattaatcgactgcttgatacacctgttatatttttcattttactaactgaattatcaaatctacaagcttatttgctacttctatttgaagtttgtgtctttaattactgcttttcattagatctgaaatttttttataatttgcttttttttttttttttttgaaatggagtcttgttctgtcacccaggctagagtgcaatggcatgatctcagctcactgcaacatctgcctcccgggttccagcaattctcctgcctcagcctcctgagtagctgggattacaagcgtgtgccaccacaccgggctaatttttgtatttttaatagagatggggtttcaccatattggccaggctggtctcgaacttctgacctcgtgatctgcccactgcggcttcccaaagtgctaggattacaggcgtgagccactgtgcccagactataatttgctgcttgatgtcagaataatttctattaatttcattgttcatctttaatcaccattgtttcatagtccagtaattttctgtattttctgttaaactcttcatatgtctaaatcaggaatcagacatttttcatttttttttctaaactagcctaaaattgtttttctaaattgcagttaaaatggcatatttgacctttggtaacttttaaaatattgacatataattaatataccacaaaactcaccctttaaaaatatgcatgattcggtggctttttattatattcacaaagttgtacaataatcaccattatctatcttcaacattttcatcacccccaggagaaatctcataaccattagaaaccattctcccttttcctcttcttccagccctttgcaaccactaatctactttgtctgatttgcctattctggacattttgtatacatagaattatacaatatgtgaccgtttgtgcaatgtttattaaattttgaatgaactctctattcatgctcaggtgttccttctgagtcagaaaatatattttagagtctttaagatgttgtgtactttgtgctacaagatctcaatgctttataatgggcaaaccacctcactatccttagacccttgaatactaagttggcatgggtgattaaaatactacatgtaatgtaaaagataaattcaagaagaacgtgtaacttggaaaatctgaagtagtcagcaactttagggactgggaaggcagctttcccagggataactaagtgataaagcgaactgygtccagaatatattttaagtacttactaatgtgaaagcattgtggaatcttcacgtcttctaaaagtcacgtttttacgtgactgattgcaaatgcaacataaggttaaagttgctcagaacttatttcattctgttgaaaagacaaaactgcgtttgaattattcttgtgtatactttaatttcagatgaattttgacagttaaaagttggtttgctgtagaacatgatttttctgttttagagtagcacacgataatggcatacataaagcaatttgctactggagaatttgtagcaatatttgatgtttggtttatttacttatttgagttcccactttattttgtacatattttcccttattttgattaattctccatgagctattttggataaataaaagtcatatttgtccttctacctttatagttttccaggcactcatgtaaaaattgatcaaatctagaaatcaattgggtgattcctagaaatttctgttacttgaagaacacaactttttcattgtgatctctgatgaataaacctttttcacttaacaattcaataccttcctgttgggagcaggccccccaaaatctggcgataaaccagccccaaaactggccataaacaatctctgcagcactgtaacatgttcataatggccctaacgcccaagctggaaggttgtgggtttacaggaatgagggcaaggaacacctggcctgcccagggtggaaaaccgcttaaaggcattcttaagctacaaacaatagcatgagcgatctgtgccttaaggacatgctcctgctgcagttaactagcctaacctattcctttaattcggcccatcccttyctttcccataagggatactttcagttaatttaacatctatagaaacaatgctaatgactggtttgctgtyagtaaatacgtgggtaaatctctgttgggggctgtcagttctgaaggctgcgagacccctgatttcccacttcacacctctgtatttctgtgtgtgtgtctttaattcctctagtgctgctaggttagggtctccccaaccgagcttgtctccacaccttccactgttcttcttagtacttcagcataatactgtatgttccttctttgtcctgcaagacaacggtaaagtgcattataattaatttatgtgtaatccaagtaaacaagcctcattgtgttgtatgtgtcttaygattaagagctcaatacatttaatctagtctgacagtttgcctggtgtaagtcatgtgtgtcttgttaaaaaaaatttaataagaacaaaacaactggggggaggagccaagatggccgaataggaacagctccggtctacagctcccagtgtgagcgacrcagaagacgggtgatttctgcatttccatctgaggtaccgggtttgtctcactagggagtgccagacagtgggcgcaggccagtgggtgcgcgcaccgtgcgcaagccgaagcagggcgaggcattgcctcacttgggaagcgcaaggggtcagggagttccctttccgagtcaaagaaaggggtgacagacgcacctggaaaatcgggtcactcccacccgaatattgtgcttttcagaccggcttaaaaaacggcgaaccacgagattatatcccacacctggctgggagggtcctacgcccacggaatctcgctgactgctagcacagcagtctgagatcaaactgcaaggcggcagcgaggctgggggaggggtgcctgctattgcccaggcttgcttaggtaaacaaagcagccaggaggctcgaactgggtggagcccaccacaactcaaggaggcctgcctgcctctgtaggctccacctctgggggcagggcacagacaaacaaaaagacagcagtaacctctgcaggcttaagtgtccctgtctgacagctttgaagagagcagtggttctcccagcacgcagctggagatctgagaaccggcagactgcctcctcaagtgggtccctgaccactgacccctgacccccgagcagcctaactgggaggcaccccgcagcaggggcacactgacacctcacacggcagggtattccaacagacctgcagctgagggtcctgtctgttagaaggaaaactaacaaacagaaaggacatccacatcgaaaacccatctgtacatcaccatcatcaaagaccaaaagtagataaaaccacaaagatgggaaaaaaacagaacagaaaaactggaaactctaaaacgcagagcacctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagctgatgtgatcaactggaagaaagggtatcagcaatggaagatgaaatgaatgaaatgaagtgagaagggaagtttagagaaaaaagaataaaaataaatgagcaaagcctccaagaaatatgggactatgtgaaaagaccaaatctacgtctgattggtgtacctgaaagtgatggggagaatggaaccaagttggaaaacactctgcaggatattatccaggagaacttcccaaatctagcaaggcaggccaacgttcagattcaggaaatacagagaacgccacaaagatactcctcgagaagagcaactccaagacacatatttcctcataattgtcagattcaccaaagttgaaggaaaaaatgttaagggcagccagagagaaaggtcgggttaccctcaaagggaagcccatcagactaacagcggatctctgggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcaagactaggaagaaactgcatcaactaacaagcaaaataaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagacttcaaaccaacaaagatcaaaagagacaaagaaggccattacataatggtaaagggatcaattcaacaagaagagctaactatcctaaatatatatgcacccaatacaagagcacccagattcataaagcaagtcctgagtgacctacaaagagacttagacacccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcagcacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccactcaactacctggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaccccttcaaaaaaatcaatgaatccaggagctggtttttttgaaaggatcaacaaaattgatagaccactagcaagactaataaagaaaaagagaagaatcaaatagacacaataaaaaataataaaggggatatcaccaccgatcccacagaaatacaaactaccatcagagaatactacaaacacctctacgcaaataaattagaaaatctagaagaaatggataaattcctcaacacatacactctcccaagactaaaccaggaagaagttgaatctctgaatagaccaataacaggatctgaaattgtggcaataatcaatagttttccaaccaaaaagagtccaggaccagatggattcacagctgaattctaccagaggtacaaggaggaactgaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatacagaaaaagcctttgacaaaattcaacaacccttcatgctaaaaactctcaataaattaggtattgatgggatgtatttcaaaataataagagctatctatggcaaacccacagccaatatcatactgaatgggcaaaaactggaagcattccctttgaaaactggcacaacacagggatgccctctctcaccactcctattcaacatagtgttgkaagttctggccagggcaattaggcaggagaaggaaataaagggtattcaattaggaaaagaggaagtcaaattgtccctgtttgcagacaacatgattgtatatctagaaaaccccattgtctcagcccaaaatctccttaagctgataaacaacttcagcaaagtctcaggatacaaaatcaatgtacaaaaatcacaagtattcttatacaccaacaaaaacagagagccaaatcatgagtgaactcccattcccaattgcttcaaagagaataaaatacctaggaatccaacttacaagggatgtgaaggacctcttcaaggagaactacaaaccactgctcaaggaaataaaagaggatacaaacaaatggaagaacattccaygctcatgggtargaagaatcaatatcgtgaaaatggccatactgcccaaggtaatttacagattcaatgccatccccatcaagctaccaatgactttcttcacagaattggaaaaaaactactttaaagttcatatggaaccaaaaaagagcctgcatcgccaagtcaatcctaagycaaaagaacaaagctggaggcatcacactacctgacttcaaactatactacaaggctacagtaaccaaaacagcatggtactggtaccaaaagagagatatagatcaatggaacagaacagagccctcagaaataacgccgcatatctacaactatctgatctttgacaaacstgagaaaaacaagcaatggggaaaggattccctatttaataaatggtgctgggaaaactggctagccatatgtagaaagctgaaactggatcccttccttacaccttatacaaaaataaattcaagatggattaaagacttaaacgttagacctaaaaccataaaaaccctagaagaaaacctaggcattaccattcaggacataggcatgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaactaatttacaagaaaaaaacaaacaaccccatcaaaaagtgggcgaaggacatgaacagacacttctcagaagaagacatttatgcagccaaaaaacacatgaaaaaatgctcatcatcactggccatcagagaaatgcaaatcaaaaccacaatgagataccatctcacaccagttagagacaacaggtgctggagaggatgtggagaaataggaacacttttacactgttggtgggactgtaaactagttcaaccattatggaagtcagtgtggcgattcctcagggatttagaactagaaataccatttgacccagccatcccattactgggtatatacccaaatgactataaatcatgctgctataaagacacatgcacacrtatgtttattgcggcattattcacaatwgcaaagacttggaaccaacccaaatgtccaacaatgatagactggattaagaaaatgtggcacatatacaccatggaatactatgcagccataaaaaatgatgagttcgcgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcaatgggagatatacctaatgctagatgacgagttagtgggtgcagcgcaccagcatggcacatgtatacatatgtaacctgcacaatgtgcacatgtaccctaaaacttaaagtataaaaaaaaaaaaaagaacaaaacaaccaatatgtatatattttggaatagactggccaagatcttataactatttgctcatattttttataatacctgtttaggaaacatttaaacaaatcctttatgttctgcttgattctctgtaaataggaatcatgattttggaggcagaaaaatttgcaacttcacagtgttgctgtgagttgctcattgtgacaggcaaggatgaaagttcaaggtacttagggacggaagtcaacacattcattgaaacaaggctgtgctgactgtagaaattgttttctgtttggaaggttttgttttctgttgggagtattctgattctcagtcttacttctyttctgttattaccaacattttgttggtgatcatgattcttaatgaaacagttctgcataccatttcaaccatcagagtttttagtctccattgttttataggagtgttcttgacattttgaggctcctgccaatcttcattctttcaatttccttttttggtttccactaagataccttccgttgagtttaaattttagaatgatcaataattgtggaaaaaaattcatctgaaattgagacacacacaaaagcaattcaaatgcatttaaaaactgccactgtgttcagttgagccctgtaattgtgtaaccaaattattcttgtactgtaaatattgaattattgatgggatacatgtgggcgtttttcactggaacatttgtttcttcaggccactttgctatattggtggcaattttgcatgctgctttatctggaactgtcagactttgtggggacaagatgtgtcagataagttcaggtgtgcataaatcaggcagcctcatcccaagttgtacttactatttgttgtaatatttggtgtttgtgtcctacaaacccaggaattttcacaaattttatttcatgtgatttgctttaaaaaaaaaagcgtggtgtgtttataattatgtacactattttttgagtatctttcttgacaggtgaaaacttttattttaactaggtatcaataagaaccaaattctctgcttaaaattgtaaaactttggtgtttgggtgtttgcccgaaatgtcaggtcagggtttagatgccaatcctgccggtttcttgccctgaaaaccactgagctgtatgatttaagtcagtkaatttatagtgtgcagatttcatctgaataaagctgtttaaaaaaaagttcagagaagatgttttttactgagctctgacccaaaccaggatcacccttgtgtgtatcaggtgctggggctgggggatctggacaccaaagcacttctctgtgcctggaaaattcctatttgcattttccagcagctcaggtgtcatctggatgaaaatgttcctcgatgtctgagacagagtggcccaccctcctggtttgtatacctctgcttgcctctctcckgtggaatggtaccttgttgttgttctgtgagttgtttgtytccctctgtctcccttaagacctttgctgctgtggtgcccagcaggaaatacayacacacacacacacacacacacacacacacacacacacacacmcacactgttcttacgtgcctgatatggtggactcattaaaggctggggtggcagctctgggggagttaatttgctttatccccatagggagaaagctcagtgtagaaaatgctgtgttctcttcctcacagctgctgacttcaggatactggtcagcctctgtttcttcgtagtggtttttagacttgcatgtgcattggaatgacctgaaagtctgttaacacgtgaaatgcttggccccagcctcagagtttgggtcagtaggactggtgtcagaactgataatttccatttctagccagttcccagtgataagccaggaaccctgctttgaaaaccacttggcccccctgccagggctcacttgtcttgggagagggcttgtgaaggcccctctgtttgtgcagtttggtggtttgcatcaggctctatggctgaagttggaaccttcaagaggcccccctagatccatgtcactagtctagtctgaatgactgtctagggatttccagactttgctttccagacctcctaaatagaatggagtcacctcagggtgactgatcagggaggtggtgtgggtgatgcttcagacctcaccttctcaccagatcagctctgtttttatgtcttaggcacgaggatcctataggtgaacttgtttggagaatgagttcctatgcgggggaagaaccccacatttttatggtaacaacctggattctgggccctacaaagtgagcagcttgtgaaagccctgagatttcctctgagctgcaggtcccagaaagccagagggccagaatgcctcttggttgctaagttgtatttttttcatttcagagagagctacaactccaaattcagcatagctttgtggttcagatgctgaagtcagacagagttgggttcaggtcctggccctgcccctcctagctgggcacgctgctgcttctgggaggcctttgtgtctgtgcctgtaacatgggccatgattctctgccttccccatgggctgctgtgagtcttggatgaaatcttttggaagtaaagctcagagtcgcaaagaaaatgagcacttaaaggatttctcagcaaggcaaaatttacttctgcagaagggtgctgctcgcaagtttggtcaccatgagagcacaccgaacgaaggagggaaggggtttttatccctaacacagtgtgtccctgctgctgtgtcctatctccactgtggagttggaccgtacaatctaagcagaacctgattggctaacttgaatggtgcaggaatgtggttacaatgggggaaggggcagttttggtgggaagagccattgcgacaggaggggtaatttacagagcgggtagcagatgtgggctctgtagataaggaccagtgggaaagttgtttactgaaactgagacagggaggcataaaggataaggaagttagtttggccttggaagtagggaacgaagagcaaggatgctgaacaagctaaacctttgaagaggaacttcttttgtatctaacagattgtagatcccaaacacttggcacagtatctgacccatcatcagtgctcagttaaatattagtattgtcatgatggttttgttattgtagtgaaaattagaacattattcttaaaggatcaataatttttaaatgaaataaatatgaagacctacttgaaatctcagaaaaaatttcaatagttcatggattttttttttcctgtactgggcaaaattgatttttcattttaaaaaaatagagaaaggggtcaggtgcagtggctcacgcctgtaatcccggcactttgggaggccaaggtgggcaggtcacttgaggtcaggagttcgagaccagcctggccaacatagtgaaaccctgcctctactaaaaatataaaaattagccgggcccagtggtgcacgcctgtagtcttcagctacttgggaggctgaggtgggagaatcacttgagcataggaggcagaggttgcagcgagccaagattgtgccactgcaatccagcctgggcaacagagtaagactgtctcaaaaaaataaattaaaaaaaggggaaggaaaatgaattaaaggaggatttacktaactaaaagacagttttaaaagaacaactgccgacactcataacattagcagcaatcgctttagcattttgtgttgattgctttgctccaccaagaatatctgtgaaacactcataatgctcaaagttttttttttttttaatcttcaacttttaagttcaggggtacatgtgcaggatgtgtaggtatgttacataggtgtcatggtggtttgctgcacagatcaacccatcacctaggcattaagtctagcatccattagctattcttcctgatgctctccctccccacccacctccccgacagaccccagtgtgtgttggtcccccccatgtgaccatgtgttctcatcattcagctcataagtaagaacatgtagtgtttggttttctgttcctscattagtttgctgaggataatggcttccagctccatctatgtccctgcaaaggatatgatcttgttcctttttatggctgcatagttgtaacatcaaagttgatgcatcttattattgtgatcttttcagacagggtcttgctgtgtcacccaggctggagtgcagtggtgcgatcatgactcactgcagccttgacctcccaggctcaagagatcctcccacctcaacctcccaagtagctgggactacaggtgtatgccaccacacccagctaacttttgtcgcagcagattttcgccatgtttctcagtctgttctcaaactctgaggctcaagcaattctcatgcctcaccctctcaaagtgctgggattacaggtgtgagccactgtgcctggccccatcttatttttaaatgaagttttaataagatctcagttgtatgcttcatctcaagtgattattcagctccaaaacaaatcaagttccttccaagtacaaaagaatctatgttctaaggcagtggaaggaagcagggttggggaggatatatcatgttcaaggaaaatgaaaagaacttaatgttttgaaagacttctagtcaamggaactatgactcattatcctggatgtgatgggaggtggggggcatttaagcccacattcccacttccattttaaagtcagaatcaggaggaaaatggggattgagataaagaattttgctgtatcacagtttggctgaaaggcgttctgcctagcaaggatgcaggtgatttacacacgatctactcttgaagcttaaaccagtacttctatgatacattttttggggggggggcggtggtgggggtaaagggaggaaacaaccaggatgaggattgaatatatttgaaaggagattcaaagtgatgtttattgagcacttcactttggaaaagcaaaaaatcaaaggctgtcttaaagattgtacagaaaatatgatttattggagatatcccttgcctccaagctctaatrttaagcctccaaatataatgcaagttatattggtatagaaaatgggaaggagcaggcagatttattatgtatgagcatgaataatttttatctttattgctttcccacttcagatcaagttggaatttttaacttttcaccaaagattctttggttttacagaaaatataccacaggtacatgaaatgtaatatatttattgtataggtttttaatagtagaaagtaattttatagttaggcagtttaaaattaaaattatagtttagtggtcataagagttagatcattgtgtggtaacctgtgagtgtgtttatttagcaatgatggtgaccatgaagggactcgctcaggccatttaggagaatatccgacaagccagaaggaagatgattttaataaccaggaaaaacgtaaaactcattatagatttgtataataagggcgagttcggggtagtataggcttctaatgtacagtgacaatctcgctctgtygtccaggcaggagtgcaatggcgcgatctcrgctcactgcaacctccccatcaccctcccgggttcaagcgattctcctgcctcagcctcccgaatagctagccgggactacaggtgtgtgccagcacacccggctgttttctatttttagtagagacggggtttcaccatgttagctaggatggtcacgatctcctgaccttgtgatctgcctgccttggcctcccaaagtgctgggattacaggcgtgagccaccgcacctggcttactgtagacatctttaacatatcacaatcttccttcaaataataccccactgcttgatsttatgcacaagaaccttacgacagtattcttccaggccccagactctgtgctgttgttatcctctatgttgcttttgcatatcctattaacctcacaaaacgttgttatttttgttgtaggcagacaacatattttatatttacccacatacttgcctttgttagggctctttgttactttgtgtagatccagatttgtatcttgtatggtttctcttctgcctgaggaacttcctttaacattttgtatggttcaggtgtattagcgatgagctctctcagcttggtttatgttaagcttttattttgcctttatttttatttttttgagacggagtcttgctctgttgcccaggctggagtgtgctggcatgatctccactcactgcaacctccatctcccaaattcaagcaattctcatgcctcagcctcccgagaagctgggactacaggcacccggcaccacacccggctgatttttgtacttttagtagagatgggattttaccatgttgtccatgctggtcgcaaactcctggcctcaggtaatcccttcgccttggcctcccaaagtgctgaggttataggcgtgagccaccatgccyggccttgcctttattttttaaagataatgtcactaggtaaagagttctagtttgacacactttccttctgagtactttttttttaatatttaaaaaattggtttcttttacatttttaattgacttttttggcccatatttatggggtatatagtgatgttttggtgcataaagtgtacagtgatcgcatcagggtaattagcatatcgtctggaacattattttgggagggtgaacattaaatattctctttctagctatttgaaactatgtattactgttaactatagtcattctacagtactgtagaactctagaactaattcctcctatctagctgtaattttgtatcctttagcaaacctcttcctatctctctgctccctttacccttcccagcctctagtatcctctgttctcttttttacttctgtgtgatcaacattttttttagcttctgtattagtctgttttcacattgctatgaagaackgcccgagactgggtaatttaaaaagaggcttaattgattcatagttctgcatggctgaagaggcctcaggaaacttacaatcagggtgaaagaggaagcaggcatgtcttacrgggtttcgccatgttggccaggctaggtctcgaactcctggtctcaagtgattggccagccttggcctcctaaggtgctgggattacaggcatgagccaccatgccaagccttttgtagttttttgaggaacctccatactgttttccatagcggctatactactttacattcccaccaagagtgtttaagagttcccttttctctacatcctcactagcatttgttattttgtcttttgataatagccatcctccagtgaggtgatacctcactgtgatttagagttgcatttccctttataattaataatgttgagcatttaaaaaatatatttcttggccatttgtttgtcttcttttgagaaatgtctttagatcatttgcctatatttaagttgcatagtttgagaatacaaacaaatggaaagacatcccatgctcatggatcagargaattaatttttttgaattaagcagaaattttatttccaagctctttaaagattattgcaaacacaaagttgtcttctgaaagccccaaatcaaatcaaaggcacggcatcaaaataaataaaacacttgtgacattaagaattattttaggttgtagtattttacattactttgtttttaactatttacaatgttcttcgagtcatatttaaacatttcttaagacatgaaataggccgagcatggtggctcatgcctgtaatcccagcactttgggaggccaaggtgtgtggattgcttgaggtcaggagttcgagaccagcctggccaacatggtaaaaccctgcctctactaaaaatccacacacacacacaaattagctgggcgttgtggcatgtacctgtaatcacatatcacagttacttgggaggctgaggcaggggagttgtttgaacccgggaggctgaggttacaaggaactgagatcatgccactgcattccagcctgagtgacagaatgagactctgtctcaaaaaaaaaaaaaaaaaaaagatacgaaataatgtatttaggtacaaccacaactacaagcagaaaaacttaagaatacaaagactgaatctgcttcatctaatctatatatacgatggggcaacctaatgcccaacataaaattaatctttctggatgagtttgctaagaaacagctcccgtgttaagtgttaaaaaatgaaacaaccttctcatttggaaaaatcaaggcatcagttaattagtaaaacctactcttttccccagcaatttgtactttcttgccttcatttagaaattgtaaattcatgagcagaacacattttgtagaatttggtataaaaatatttgtcaggagcaacagataacaaatattcaattttttaaataaaatgttttccttcctaaatgtaaacatccagtaaataaaacatacatgatattctaggtatagaaacatcagtaattcacttatgaaagaggtacattttgacgtatctggtggtaaggtttttgtcttacatataaagcacttcaccaaaaacaaacaaacaaaaaacccatactgttattatttagagctatatttcttctcccagtttcctcagttgagtagaaactcaccaatttctgtagaattttggttataggacaaggctacaggaaaggtctgaaataactatatgtcacttgactagggaaaagccttctcttgaggcttggaggcagtcatttatcactttgtacttgaaggcattcctctgcagacttctttcctagagtcttcagggtaaagcacaggatcyggactccaggaggggggttacttcctgctggaacactgaccagcagggcatcctttcaggcattctgcatgcagtactgttgcagctctgcagctgcctgagagaccttgatcctctccacgccgacctgcagcttgagctgctccaccaggcgctgcagggcactcttgctggccctggaagacatggtagcagcagtgtgctccaagggtggttgagccaygctaggcgggtcagccctgccaggccctgagcgtgggcactgccaatattgttgaaaggaccatactatccaaagcaatctacagattcaatgcaatcttttgagatggaatctcgctctgttgcccaggctggagtrcagtggtgcgatcttggctcactgcaagctccacctcccgggttcatgtcattcttctgcctcagcctccagagtagctgggactacaggcgcccaccaccatgcccagctaattttttttgtatttttagtagagacaaaaaatacagtttcactgtgttagccaggatggtctcgatctcctgaccttgttatctgcccgcctcggcctcccaaagtgctgggattacaggcgtgagccactgtgccctggcctcaatgcagtctttatcaaaataccaatgacattcttcatagaaataaaaaaaatcttaaaatttatattgaaccacaaaagactcccaatagccaaagcaatcctgagcaaaaagaaagctggaggtatacactgtcagacttcaaaatatactacaaagctgtagtaatgaagacagcatggtactgtcataaaaacagacacatagactaatggaacagaatagaccacacagaaagtaatgtattcrtctacagccaactgctttttaaaaattttttattttttgagacagtgtctcactccatctcccaggctggagtgcaatggcatgatcatggctcactgtaacctttacttcctgggcttaagaaatcctcgtacttcagcctcctgagtagcagggactacaggtacgtgcaaccatgcctagctaacttttaaaaattttctgtggagacagagtctcactatattgtgtaggctggtcttgaaacccctggggtcaaatgattctcctgccttagcctcccaaagtgctgggattacaggcatgagccaccatgcctggctaccaactgatttttgacaaagkcagcaagaatactcactggggaaaggataatctcttcaataagtgatgctgggaaaactagatatccatagrcagaagaatgaaaatagaccctcacctctcaccctatatgaaaataaactcaaaatggatcaaagacctaaatgtaagatctgaaactcaaaatggatcaaagacctaaatgtaagatctgaaaccataaaactactacaagaaaacatagggggaagcccttcaggacattggtctgggaaaatattttatgaataagacctcaaaagcagtcaacaaatcacttgagctcaggagtttaagaccagcctaggcaacataatgagaccctgtcttttcaaaaaataaaagttagccagatgtgatggtatgtacctgtagtcccagctactcagggagctcaggcaggtggatcacttgagtccagcaatccaaggctgcagtgagctactatcaaactactgccccctagcctgggtgatagagcagaagcttgcctctaaaaaacaaaagcacaggcaacaaaagcaaaagtaaacaaatgagattacatcaaacaaaaaagcttctgcacagcaaaggaaacaataaacacagtgaaagggcaacctacagaatgggagaaaatatttgcaagctattcatctgatgggattaatatccagaatatccaaggagctcgaacatctcaacagcaaaaaacaatctgaatactttaaaggcatctctactctgctgtcagcttacatgcttctgaagagaggtctgctgtctttctttgtttttctgtagacccccttgcacccaccatagctgcttctaagattttccactgaatcctagcaattacattagaaygctacttggcataattttcttaagtttattctgcttggggttgttggatttgtgggtttatgcttttcatcaaatttaggaaatttggaccattatttcaaacattttgtttcttgtttctcgtctcttccttggactacaattacacgtatgttagactgcttgatattgtcctttaggtcactggtgctcttaatttattctcagtcattttttctgtctcctttgttttgtcagtttttaaaattgctatttcttttcattgattgatacagttttctgccgagtataacctgctgttaattccatttttcaattttgtattttttatttttaacagttctaagtatttttaaaatattacaatgctcatgtttttatcttctcgaagacagtgtactgacaggataatgtatttgtttactaattgtgtcatagatgtcatttctgggtttatttctcttgatttttttctttctgttactgttatttcgtttccttgcatattggtgatttttgaaaaatttatttttataaaaattttagatttataaagtacaaatatatttctcagaattctcacataatttgcacccattttcccctattattaacattttacatgaatatggtgcatttgttgcaaataatgaaccaatgttgatacattattattattactgtggtttttttttttttttcagatggagtctcgctctgtcgcccaggctggagtgcagtggtgtgtgagctctgctcactgcaacctctgtctcctgggttcaagcgattctgcctcagcctcctgagtagctgggattacaggtgcccaccaccatgcccggctaatttttgtatttttagtagagatgaggtttcaccatgttggccaggctggtctcaaactcctgacctcaggtgatccacctgcctcggtctcccgaagtgttgggattacaggtgtggagaaatatgaacacttttacacagttgctgggactgtaaactagttcaaccattgtgggagacagtgtggtgattcctcaaggatgtagaactagaaataccatttgacccagccatcccattactgggtatctacccaaaggattataaatcatgctgctatacagacacatgcacaggtacgtttattgcggcactattcacaatagcaaagacttggaaccaacctaaatgtccaaccatagactggattaagaaaatgtggcacatatacaccatggaatactatgcagccataagaaaggatgagttcatgtcctttgtagggacatggatgaagctggaaaccatcattctcagcaaactatcgcaaggacaaaaaaccaaacaccacatgttctcactcataggtgggaattgaacagtgagaacacttgaacacaggaaggggaacatcacaccctggggcctgtcatggggtgtgggtaggggggagggatagcattaggagaaatacctaatgtaaatgacgagataatgggtgcagcacaccaacatggcacatgtatatatatgtaacaaacctgcacgttgtacacatgtaccctagaacttaaagtataataataaaaaaaaacattttaagataattttgcagtgcagcttacctggatacctatttagttgggagaagggtaagacaaaaaaaaggagagaaatatatccatgtatgcagtactttgttcttttattaaatagttcagacataaaatatgtaaaatactcacatgccaccacttagcttaagaaacaaatcattgctgacaaaattatttttctttcatcctatttttcctcttcctctgtctgtgatatagttttaatcaaatattatgtagattatatcattctctctctcttttttttttttttttttttttttgagatggagtcatgctccgtcacccgggctggagttcagtggctcaatctctgctcgctgcaacctccacctcctggactcaagtgattctcctgcctcagcctcctgagtagctcagaccacaggtgtgcgccaccgtgcccagctaatttttgtatttttagtgcagatggggtttcactatgttggccaggctggtcttgaactcctgacctcaagtgatccacccgtctaggcctccgaaagtgctggaatcacaggtgtgaaccactgcacctgacctatattgtatcattctctacataacgttttacaactttcttttgtgattcgaccttaccctcgatttattcacatggatatatttagccccaattaattttaactttagtcttaactgctatatggtatgctaatgtttgattattcataatttgtccagtcttctcatgctggccatttcagtagttttccatttctgttaaatgtaaagctgccatgaacattcttacacatgtaagggaccatacctaggagtggaattgcaggatgatagagaatgcacaacctcaacttagccttgccaacttgttttccaaagagatttcccaatttatactctactggcagtttgagagtgttccactcttcctcttcactgctattggcagattttagatttaatgaacttgatgaccagcacttttggaggccaaggctggcggagcacctgaggttgggagttcgagaccagcctgactaacatgcagaaaccctgtctctactaaaaatacagaattagccatgtgtggtggtgcatgcctataatcccagctacttgggaggctgaggcaggagaatcatttgaacccgggaggcagaggttgtggcgagcagagccaagattgcactccagcctgggcaacaaagagcaaaactccgtctctaaataaataaataaacaaataaacaaacttgatgaatgcaaaatgtcatcattgtaattgcatcattttgattttcagtgaggttgagtaggtttcactggcaatcctcctgaattgcttggtcatattcttcagtagcacatttttcttaagagtgaatataagctgatccatttgaacactttgctattgtgaaagtatcctaccatttcttactgtgaatatattttagacttgtgacatactgtgtctaaagaatatatatataacaatttggcttttcttatctgattgtgaaagactttgtcattttacacactcagtgtgcatttccatagaagatctcaggagctccataccaggcacagcctgtgggggaaagagcacagattttggagttagagatctggattgaaatccttgctctccacttatcagttctgtagctttgaacaggctgctgtacttctttgagccttggtctcctcctctctgtcctcatctataaattgagaacaccccatcatcgtgaggttgaatccgttgttgaccaagtgtcctgtatgattttttgcttagagcaagcctgcagtaaattgaagttgttgtaattaagtaaaggaaatatcttgggaagtacatttccttctttgcctactacctgttacccatatagaactccaagcagggtttccttgtagttaaaagtgtgaaataggtgagcattgtgactttcaaaggcattatcactaccttatgttcgtgaagtcctttatacatttcaaatcacttcagtattttgtcacattatttttttgtttgcagtaaatctgagagggaggcaggacaggtatccttacttatcccccacttttcctgatgaggaatatccatggtagagacacaaaaggaagcaatgtttccccattactactctagggagttttgtcttttattgtttttgctatttggtttttgatgtttgaactgatttttgcccttgaagaacttactagcaaagtagaggaaagcaacttttgggcagtttgcacttacgttacttacttttaaaggataaggaatgttttgggataaaaaatataagaaaatttaagtatattgaaatgttttcattagatgatgtattctttgcctgcaggctctgccagacttgcctctttatcccgagacctcacttaaggcacctcattcccagattagaatrtatgtaaactatatgcattttgaacacgtcttcctgtaggctccctctgcacctgcctcccccatgcacctggtttgtatttgtttggtgtccaatgttccctgctcctctctttgcccttccctcttggtcatcttggttacacctgtgccctcaggacacaggagaggtatcccacaagtgtgctgaatgaatgggtgtaagtaaactttttccttggaaataaatgtcaagcaggatatctgcttgacaccaaaatggtcaataaattgagccagagtgtaattgaagtgtctcatgctttgaagcatccacattgacttattcttggtttatttttatcagacttgttgctatcatatatgtataagctcagcaaggaagagtctaggctagtagtttgtcttagctgaatcttttttccataagaataagtaaaagtgctcagttacattttgttttttccccctttattcagtactataccagcttaaaataataccaaaaaatcagccataatgctactattttgtcttttgtttttctaaattctttcagttcttctgtctgcgtgcatctgtacattttatgccattataatcatagcatctgtgtaagttcgtaccctttccttagtatatcatcttccacacttttaatgactaaatattcttgtatataaataatgtaccaaagtgtatctaacaaattccatgttcttggacatttagattagttttcattgctgtcagtggtattaaagtgttcctctctggtttttattttttgttgtgatttatgcatgtgtgtatgtagttaaacatagggcagtagtagatagcacatggaaagttaagggcacgccgctggagttgggctccctgggtttgaatcctggctctgctgcttgttgcatggactccccggcaaattatgggacctctgtgtgcctccagtcttacaggtaaaaggtaggaggaaagttatagcagtttataaggttgttgtgaagattaaatagtatatgtaaagagtttagaacactcatacaaagtcttgtgaaaacttagctattaaataacccaggtttgggcagggatgttggatggactcctrggtaaaatagagttggccctaattgtgctgataattgaagctgggtaacagatacaagaggatttgctatactattcgttctactttttatgttgaaatttttattcatttatttatttttttgagacagggtctcattctgtagcccaggctgggatgcagtggtacaatcatagctcactgcagcctcaacctcctgggctcaactgatcctcccacttcagcttcccaagtagctgggactacaggcatgtgccagcatgcccagacagaaacttttttcataataaaaataaaagcacatacaatgcaaaaacattttagcttttatatttattttttgatttctgaatttatttcttgaatgtgtttctagaagtgagaccacaaagtaggagatcttacaaccatttttgaatacagccaaattgtttttttaaagaattgtgtaatatacagtgtaatgctcaatctaaaacggttttatcacagtcttaaacaacactgaatattattaccattacatgtttttcatataattttataggtaaaatggtaccttacagttattttaatttcttcttttttttttttctttctgagacagggtcttgctctttcgctcaggctggagtgcagtggcatgatgatagggtctctctaggttgcctaggctggtctcttcctggcctcatgtgatcctctcaccttggcctccaaaagtgttgggattacagatgttggttggccactgcacctgacctagaacgtatttttgattaatggttgctgtaaatatctgatcaagccatgataaactgctttgaggtgacagccaccactgttctcatatagcatccccctcagtgtgcagtcatcttyaytgtggaccatatgccaccggaggctagactgcagatgccccttgccagtgaaatttgacttcggtaaattttcagatgagttttggaagagcagggaaactacaattctgctttaaggtgttctgtttttatatagtgaatatatttatatttgttttttttctttatcatttcccacttttcatgatacaaatcacaattgcaaattccaatacagtgtatgatcaccacttctctctgtagcttttgagatatggtcaactatttatcataaagatgctgaataatctgattttttttgttttactaatttgttttttgagtctcctcttggtgcatttcttttacaatccttttaaaaaatgtaggatgctaagcctaatattgtgtagtggtttacataaattttatagttttctacgttcaaacctataatttgtgagtgatacctttttactatggtttctgatgtacttgagccatgttttatgccatcttctgagtaaccatagggactgagtggcgacagtgtatgaagccctttattattctatattcccatttattacttgacaagtggcaccagaggcataaaattgttttatttgtcagatttgcataagaactttcttacaaaaagcttttatggtacgtaacacatccataaattctcataatcgtccttttgaggtacttcttgtagttttactgttgttcttcctttttcattatttgagaaacttttaaaataagaaatatttgtcatgatgaaaagatcctaccaattatttgaaagaaccattgaaaattgaacataaggtctcctttttctttttgctttttttagaaaacaaactctttagaaaattttttagaaaacaaaatctttagaaaagttaaaataaaattaaagcctgactttgtgatgaaattagttggttaaatttggatgctggttatcagacttaaaaaaaaaaaaaagtaccttttgaaagatctgagacttacttatgaccaagaaaaaatagttctaaaacttttgtataaaaagtagcatgtaagttgtgtctatgaatgtgtatctgtgggtgtgttgtatctgttttataaaacttgaatagagcrtctataaaaacagttctcaagagtgtttgtactgataacagataaatacagatagggatataaacatcatggttaaataaatagcaaaaaagatcagcttttgaatttttctttttttttaaattttttttagtatttattgatcattcttgggtgtttctcggagagggggatttggcagggtcataggacaatagtggagagaaggtcagcagataaacatgtgaacaaaggtctctggttttcctaggcagaggaccctgtggccttccccagtgtttgtgtccctgggtacttgagattagggattggtgatgactcttaacgagcatgctgccttcaagcatctgtttaacaaagcacatcttgcactgcccttaatccatttaaccctgagttgacacagcacatgtttcagagagcatggggttgggggtaaggttatatattaacagcatcccaaggcagaagaatttttcttagtacagaacgaaatggagtctcctatgtttacttctttctacacagacacagtaacaatctgatctctctttcttttccccacatttcccccttttctattcgacaaaaccgccatcgtcatcatggcccgttctcaatgagctgttgggtacacctcccagacggggtggcggccgggcagaggggcttctcacttcccagacgtggtggctgggcagaggggccccccaccccccagagggggcggccaggcagaggcgcccctgccttccagatggggcggctgctgggcgggggcgccccctgcctcccagacggggcggcggccgggcggaggcgctcctcacctcccagatggggcggccgggcagaggcgctccccacatcccagacgatgggcggccaggcagagacgctcctcacttcctagacggggtggtggccgggcagaggctgcaatctccgcactttgggaggccaaggcaggcagctgggaggtggaggttcacaccactgtactccagcctgggcagcattgagcactgagtgagcgagactccgtctgcaatcccggcgcctcgggaggccgaggtgggcagatcactcgaggtcaggagctggagaccagccgggccaacacggcgaaaccccttctccaccaaaaaatacaaaaaccagtcaggcgtgacagcgcgcgcctgcaatcccaggcactcggcaggctgaggcaggagaatcaggcagggaggttgcagtgagccgagatcgcggcagtacagtccagcctcggcaacagagggggaccgtggaaagtgagagatggagacgagggagaggggaagaccgtggaaagcaggagacgggagagggagagggagagcttgagcttgaatttttcaaaatgttgatttttgtcaccttaggaaagatgtgttacttgttatacatccagcatggttaagtcctagtgtcaagtgagccaggactatagtcacagatatacttacctctccttgcaactttagctgtattataaaacttgggggtgataacatttacaaatagacttgttcatgtattagtagtaaattcagagtacttttccactgtgatatgtgctttctgccctaagtatatacaatcttttcagatttatctatgagctatcttgctaattgtttcacccacattctatagcctttccctcctgttgatgcaactcttcctcttccagatttcatgctgaacctaatgcagcatttgactggcttcctacccattcccatagtgtctgcaagtaaacatcagtcaaactctctgccttcttggtctccactactggttgctatgggctttctataccatctttcctttcctggactgggctcctgaaggtcagcagcctccctgacctcggtgctataataagttgccttctcttctgcttgcacacaacatctctctactttattcaaacaattacctggtttgcattgtctcactttttctgaccaagttttcttgatcatttaaaaatttccttggggttcaagccagttcacaagctagacctgatttaaaatgaataatttaaggaaatctggagaacgaactaatagtagatttttcaccctggtctacatttttctgagacggagtctcgctccgtcgcccaggctggagtgcggtggcatgatcttggctcactgcaaactccgcctcctgggttcacgccattctcctgcctcagcctcctgagtagctgggactacaggtgcccgctaccacggcyggctaatttttttgtatttttagtagagacrgggtttcaccatgttagccaggatggtctcgatctcgtgactttgtgattcgtccaccttggcctccgaaagtaaagtgctgggattacaggtgtgagccactgcgcccggccgctccggtctacattttatatctctactcttaagaggcagtatggtacaaggttaaaagtaagggacttctgagccagattatcttcattttaatcctggttctaccagttatttctgtgtgaccttgggcaagttatgtaacttctctgtgcctcagattgtttataagggagataataaaaatccttacagcatatagagttggtgaagttaaatgtggtgaaagttaaatgaataaataaagcatccacactagtacatgacccaaattaagtgtcatataagtgttgccgcattgcagttctcctcagtracggcctgtgacctgccatttctgtcggctcttaccaaggctcggtgccgcccygggcctctgctccattgtcatagtaatgtttgcactctgctagtcacctgtaaatatacatatttaggatcctaaaaccaatatcctaaaatatgtatattagcagatgatgacaaaaacaccagaatttttatcaaagagaaagtagaaagtatatgrgttaatattgtaaggattaggatacacctgtcaaattactctaggttggcttagaaacaaagcaaaacaaattgggtcccatccactattttttggcattctgaaaataactagctcttacctgatgaggtcattcattcatgacctgaccatccaggtcctatctggcaataatagctttttgcaaaaagcaactcttgcctaagtggagatttacatcttgatgagttttgtatgaaagtaaagaagatgcaggaacattatcagtggggcgtacactaaccattggcatttctgagcaacgtgttgcgtagttgtgtgatttggcagcagctggtccattgctgacacgtrtgtgtgttcactgaggcttcactcacacctaaggcttccttggagagaccatgctgccattacatttggatcactacctgcccccaacacacacacacacacacacacacacacacacacacacacacacgaaccaactttccaagcaccacacccaccttttccgggctctgtaccagatctggaggggtgatggctagaagtgagggtttttgctccatcatgagtagcagctggaagtgggcctgtgcccagctctggtggcagtgggccacctgtggctggtgccaagctcactgatggagatctctcattatgtacctacatcaatgatcagtaaagaacaagccataagaaacttttgggtctctgggaatgttatctttttactcctcatataacttcatggtgaactgttttgaaatttgacattaatttagaatttcttgcctgttctgatctctagtaggattctaggctggatgtctttggaattgaaatacttgttggcttctggttattttgggggtaatccataacagtctaccattcctkgtgtttggttttagtgggctgtgaaaaaaatcatttgttcaacactgatgtcrtgatacaaggacgtgaagatgtgagtcattgtgacatcaccagccagaattgctgggattcagtgagatgactcacagtaagaggtcagtgtctggttcagtagttccttcttccacatgtatccctcagtatctagaaccctgaaattggtttctctaagaaaaccaagaggcccgtaagggtaatgtatactgttgatttttatggttatttttcaaaaactaatattttaaacatatcaaaattatttcaaatggtaatgtactcaatgtaccatttggtttaagatgttaacattttgccatatatgtcataaagtcttttcatgaagaaatcaaaccttacaaatatactggtaagacccccctcctgcccatcatgcccccatcccttccgttatgttgttgaggtgtggtgtatgttcttcccttcagctttttaacttttactacatatctgtgcattcataaataacatgtagtgttttttgcgtgttatgtagtgtgtccttttgcaacccatgttttccacccatccattttgaattgatctatgttgatgcaggtgtatacaaaactcatacagctaatttcttttagttgttgtataggattttactgtaggaaatatgccatcatttatttagatactttgtaacttaattatcacaaaacactttgtggtatttttaactcagtttcagagaacatattcaaacctaggtttatccaattccatcatgctttctataaacatttggaaaataaagttgggaaagtgagcttgcaggctgcctcctagcatatctctggggtcttcgtgtaagggaaattgttggctgtgtgccccactggcctggggtggcaagaccagggcagccctgtcttcgtcagtgggtctgcactgcaggaagacccctgggtcttcagagggtgctggtcagctacttgggacactggctcaagggaaatacaagatcctttttttttaaatgaacaatgcagtaaatctgtgatatatttgaggctcaagaaggattgagttacagggagaagtttcaaaggaagtgtaagacatggacccagcctgtaagaaacttaaagtgtagcaggggagacaaaactaacatagaacaattgcatgctacacagcttggtatacactctactgcaccccttgttacctttggcaaaaatgagatattctgtgtttttctttgcaccttgatttctcacccaacaatacttagtggaggtcctttcaaagcacctagtatagaacaaattcatttttcaaagggtgtataatgttccactttatggacatagaataacttatttgtccagtctcttataaatgggtcatcttttgttttgttttgttgtaaactgctgaaaactrtagtaatgtcctatgtgtctttgtgtgtatctatttttatttttttaatttttattttaggtttgggggtacgtgtgaaggtttgtcacacagataaatatgagtcacaggagtttgttgtacatagtattacatcacccaggtaatacgctcaatacccaatagttaccttttctgctcctctcaccctcccgcttcaggtagaccccagggtctgttgtttccttctttgtgttcctaagttcttctcatttagcttcctcttataaaagagaacatgcggtatttgattttgtgttcctgcattagattgctaaagatgatagcctccagttccatccatgttcccgcacaagacctgatctctttcttttttatggctgcataatatttcatagtgtatatgtaccacattttctttatccagtctgtcattgatggacatttaggttgattccatgtctttgctattatgaacagtcctgcagtgaacattcacatgcatgtgtgtttatggtagaatggtttatattcctctgggtatatacccagtaatgggattcctgggtcaaatagyagttctggttttagctctttgtggaattgccatactgctttccacaatcgttgaacaaatttatcccaccaacagtgtataaaggttccctttgtgaccttgccagcatctattatttttttggctttttaataatggccattctgactggtgtgagatggcctctctttgtggttttgatatgcttgttggccacatgtatgtcttcttttgagaagtgtctgtttatgtcttttgctcaatttttaatggggttgtttatttttctcttgtaaatgtgtttaagttctttatggatgctggatattagacctttgtcagatacatagtttgcaaatattttctcccattctgtgccttttaagtggggcatttagcctgtttacattcaaggttagtattgatatgtgtggatttgatcctgacattgtgctgtttgatcatatcattgatcctgtcagctggtgctgtcactgatcctgtcattagctggttattatgttggcttgtttgtgtggttgctttacagtgacactagtctgtgtgtttaagtgtatttttgtatcagctggtagcggtctttcctttctatatttactgttccttccaagatctcttataaggcaggtctggtaatgaagttcctcaacatttgcttacctgaaaaggatcttgtttctccttcacttaggaagcttagtttggcaggatatgaaattattggttgaagattttttttttttttttaaagaatgttgaatataggcctctaatctcttctggcttgtagggtttcactgttagcctaaggggatccctttgtaagtgacctgccctttctctctagctgcctttaacattctttcatttcaacgttggaaaacctgacaattatgtgtcttgaagatgatcttcttgtgtagaatcttgcaggagttccctgtatttcctgagtttgactgtaggtccctctagtaaggttagggaagttttcagggatgatatctaggaatatattttccaagttgtttgctttctctctccctttcagggatgccagtgatttgtagatttggcctctttacataatccattcttctctgaggttttattcatttttatttattttttcatttttgtctgactgtcctatttcagagaaccagtcttcaagttctgagattctttcctcagttaggtttattcagctgttaatacttgtgattgcattgtaaattttttttttttccctgagacggaatctcgctctgtcacccaggctggagtgcagtggaacaatctccgctcactgcagtctctgcctcccaggttcaagcgattctcctacctcagcctcctgagtagctgggactacaggtgcctgccactatgcctggctaatttttgtatttttagtagagacggggtttcaccatgttggccaggctgtcctgaaattcctgacctcaggcaatccatctgcctcagcctcccaaagtgctgggattactggagtgagctactgtgcccggtcataaaattatcatattgcattatttagctctgtcagacccgttaggttttttttttatgctggctattctatccttcagcttctatatcattttactgtgattgttcttttccttagatttggtttcaacatcctcctgaatctcagtgatctttgttcctatccatattctgtattccagccagttctgcctggttacaaactcttattggagaactggtgtggccatttggagggcgtatgacactctggccatctgagtgttatcagagttcttgctggttctttctcatctgagtgtgggtgttcctttaatgtagattgagtacggtcaacagacttcttttctggatgttttcactgggctgatgctttatgtagggtctttatttgaagcttacttgttgtctctggtttcagaggggggtatgttaatgaggtrtttttggtattgaagctttggggtgtgatccagtaggtggcgcttaggtgaattggtcagttgctagactcttgtttggttgcgtggctcccctgtttcctcacagtttccgtcatgctccctttcagtgctctgaaactgtgtgttcctctcccacttgagtgctggctctccttggcactcctgggatgcccactgcagctctggggtgatctcagtgtttatgttcctttctcagcttagaggcagcagaggaagagatcttagcaggggttgtggccgggggttatttgcttgctccacctcagagagatgtgggtcagcaatcacttggtgcagtcagcccaagatgtagggtttgtgctgtgtgcccaagccaggggttccctgtctggtgatgagccatgctggggagagtgggtgtgggacctgtaggagacagactggctgcctctccttgggtcgactgtagcttattggaggtgtagataaggtactcttagagtctttgctcctttgttagtttgaaggtggcaagggcagttccactgctgagatagtggcagagaggctttcagttgcccctggaggctctgttcggggagttgctgagttggtactggctccacagctctggcgggggtggctggaggcccaggcctggaggacctgtccagtgaggagatatggacaagtctgcccacttttccatagggctgctgtggtatgcttggggcctgctccagtccctagtcacctcagattttccagaacctggaggtgtcaccagtgaaggctgagaaacagcaaatatggcagcctgtccctccctctgggagcttcgtcccagggaggtatggacctggtgtcggcccaaaggcacctgtaggaagtgactggagaccctggttgggaggtcccggccagtgaggaggaacgggattgggacccacttaaaaaagtggccacattttgggagagcagttgtgctgtgctaggggtccgcttcagcccctgatcgcctcggatactatgaggctcaaaggctggaacagctaaggcacctgaacagtaaagatggtggcctacctctccctctgggagtgccatcccaggggaaattcaatgtccatctgtcagatggacagctcgggcaggggtggctagaggccccagttggaaggtcctgcccagtgagggaacgggataggtacctgcttaaagcagctgtccggccacgtttcggtagagcagctatgctgtactgggggatcccttctgccctgtgttggctcggactctccaaagcctgaaagctagaatggctaaggtgcccaaacagcaaagctggtggcctgcccctccccctgggagctccttcttagggtggtgcaatgccgctactggtagctggctggaattccaagccagtgggtcttatctsgtgaggtgcagtggaagtgggggctgttgctgcttrgctgcctggattcatcctctttcctaagtgtatgtacaggagtctaacctctcactttgccagagctacggctacttttgctggaaagcctgagtagctaaggctccagggtctccacgcgtgcctgagcrgctgctctgccaagactccacgctgctctgtcagaatgaagactgaaggcactggtagagaggggtttacgtggagagctcctgacctgaggtttgcaaagatctgtgggagaagcatggtttctgggtcgctcattcggtcattgcttctctgggcaggggagkatcccctggctccgtgctgacccccggggggccattgtcctgtcttgcttttctttgttctctgtgggtcaggttgtttccttgattagtcccagtgcgagtayctggctgtttcagttgaaggtgttgtattcactcgccccttctgttcctctccgtgagagtcaggtacmccagctgcttctagtcagccatcttggccactcactcttgtgtgtatttatgctctgatttctgcagaagtttccaggggtgggatggtgagacagggatatgtgtatttttaattttaatagatgcttccatattgccctctaaaaaggcgataattcatatttcactacaactggcacatgagaatatcctctccctatcttgtgaactccaatagttatgaaatttctttttcagtttctgactggatataaagttataccccattgttaccaatttctgtgagcactaggggatgatatgagcatctttccagatattaccttggcaatttgtttttgctcttttgtgtgctgctcatcttttgctaggtttgttactaaccttgggcctttattcctggttagtttctgagggctgtttatacagcataggtgtcaaccctttgtcatctatgttccacatacttggatcagatagagcatttgtctcttggctttgttagtcactgaaggattacagaagcaaactgagttccagcaggtcaartacaaccttattagtttgatatgttaagcagccctttggaagggtcagtgggggtrgtatgatattgatgggcatggtacaatatatgcttgttgaagactgtggtagctcacacatcagctgaattttgtatctctttagcttttcaggggttctttaagcaacagggaggtatgctyatatgtgtgccttatgctcagaaaaatagctcgatcaccaagcagctgtaatccactcgactggtctctcttccttatggaaactgggtcctgaagttcggtgtcattcttttttttagaaatcatgccaccctcaaagcytcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgtaggtgcagtgttgaattgcttgccactttgccttacttcctgattagctggaatgatttctgttgtctctaaaaagccactgcttgtttcaaattaaagaatgagtcagcatcatttgtattcatgctcttttatgaattacaatttttggaaaataggcattagcagtaactttgaaattaaacctctgtacctttgagagcttctttgacttctgaaatattttaatgatatgtatttaaaatccagaatgtagagacagactcaaacaatagcttgatgcaattaggtgagcttcccatcaggctgttgtgttcactgacgtggaatggccccgcatggtctaccctggctagcttctctgatctcatgtcataccattgtccccttgtcaactctcttataccaygctggctgcctctcagcctggacaggccaagctggttcccatcgcaggatcttgctcgttgctgtkgtcttgaatacatttccttctgtttttatacagctggttccttcacaccatgccaatctcagatgaaacatccccccgcccccagaaggccatctgaagtagccatcctttcatgcaggcctcctgtagctcagaaccttgttttgtatgccacatagcatttagctctgytgggcttattttacttgtttacttgtttgcttagtttgtttaccttgttgtttacttgtttacttcttgttcctttcctgcctcctcacccagtattaaactcagtgagagacaaataagacttctgcctgcttaacgctctagccggttccttgacagtgctggctgttatatagcaggccttccaaatgcttctggcatgaacmaataccaccaggagtaatgaagaagtcacttttggccaggcatggtggctcatgcctgtaatctcagcactgtgggaggctgaagtgggcagatcccttgaacctggatgttcaagaccagcctaggcaacatagtgaaatcccatctctacaaaaaatccaaaagttagccaggtgtggtggcttatgcctgtagtcccgggctgaggtgggaggatcacttgagcctgggaggtcgaggctgcagtgagccatgattgtgccactgcactccagcctgggtgacagagtgagaccctgtctcaaaaaaaaaaaaaaaaaaaagttatgtttttcttcttagtcttcatatcatctctgacttatttcttccccttgatagatttaccacttgaaaaatgcaaaatgactattttgtgattcaggaataccaaaaatgagatacaaatatggtttttagtgaaacttttaattttgaaataattatagattcatatccagttgtaagaaagagtgattgtaccttttcccatttctcccctatggtaacatctttgaaaataatagtgcagtgtcacagtcaggatattggcattgatgcagtcaagatgcagaacaggttcatcactttcctggccttttctcaagttygcattgtgataaaartgctgacatgagaagatagatatgtttatgtgtatgtgtgtataaatatctataaatatgtatataatctgtatatgaaagctccaatttcaactgttacttgagtgataatatatctgatatttgagaaatttctctgtaccttaagaaaaatctgaaatgtagttgcaatgtaaaaatagttcttgttctgactactcaaatgttattttaatcatgtcgttttacttattgaaggtatgctttttctatctaaaagcatgaattatgagaaacatttctcttgagaaagaaaaagacatctttctttcccccatcaccttagcaccacaagctgtgttgggcaggtgaatrgggccatcctgcatcgttctttcttccttggctgtgcctttgctgggtggccaggtaggcagcctcagctagagaaaccatagctgcgtgtgctggcttccagcctgaggtgtgtgtctgtgttgtctgcattctccccagagacctggttgctgtcaggctggagaacgcactctcactctgacgacagcctggcattgtggggctggcagtgacatctgtggtccctgctctaaggacagtggggaaatgcctgcrtttctcacagaattacaagtacaaatcttgacrctaggtggcagaattaggctgcattaatcttgacctcttttgcttccttatttctttctctacatagcattaaaactagcaaatgcttttcttgtaaaaagtgattatctagaatacctgatgtttggattgtggatttaagaacttcttcctgatttgtcagtttctgttcccatcagtcatcagtctatctggaaacaatgatattgtctttgacttgggctttcctccatggcttctcatagccagtcagttactgagttctccatttgtagaattgcttctgtgctttccctctttagctgcgttttcccctgcaggatgtaggctttatttctgtctagctcatttgtggatccccagctcctacacctgcccagtgtattttctgatgsaaggagttgactttattccttttttttttttctcatcattctatcttgctgggctaatttccattttaatctttcttttgtcacattgtctttggtgggtcctccattgcttaaaggataaaggccaaattccttagactaacatttaatgtctttcacagtttccctacacctgcctttcttgttgcctcttatttctyagcacaaaccctccagtcagatttcytactgtcctttgaatatgccttgacgttttctgcatgtgtgttcagttgttttccctgtttggacagattttcccctctcaccctattctttcttctrccctggtcagattttacctccactgagaagctctccttactaccctattgtctgtgccctaaattcctgtgatcrttgctgcccatgccacgcattccatttattccatcagcgtgtattattgagtgtctgccgtgtgtcagacactgctccggatgctggggatayggcactgggaaaaaattcctccctcatgatgatgaaggcaaacaataaataagatacataagtaaaaataggtagtcagcmggcaatacatactgaggggcagcagcataggaaaaaytgagggcctggggtagaggtggggaagtcttcaccaagaaggtagcttctgagtagatctgaagcaaggatacctggagccttgcaactatctgggggaagaaccttccagacatagcaaagggcaggtgagaaagcctggcagtacaaatgtacctggctggtcccaggagcattgaggaacagagggaacaaggaggaaaataatgggggcgagggcagctgggtcatgagaggtcactgcctgggccttgagggttattgggagaactctggcttactctgagagaggcggggaaagccactggagattgtgaagctgagaagaggtgtgatccggcttatgttttacgaggatccctctggctgctgagttgggaacaggctgtagggaggccaggcagcaagcagcagggaggactgatgaagaagcttttgaaacagtttaggtgggagacaacacaacagtgtggaaagtgggaggatgcaggatatgctttaaagatggatttaagaacttggtggtggaccgaatatgggatgtgagatacgggatgtgagagagaggatggtcaagggatatgtggtagccagcacaggcccagtgatgctgctggaagcatcagcgtcacagtctcagtggcttatggcagcagtgattccctcctacacaccatgcccacygtgggtcggccagggctccatcctgcattgtcctcctgccacagcccaggccatgcggcagcctctgcgtgaacattgtcagtcactgtagcaggggagagagcatggcatgctgtttcttgaagcttctgcccagaatgacatacttcacttctgtgtatacttcattgctcaaagcaagacatgcagccatgtccgagttcaacagggcggggaggtagatagaatccttgtgggagggcaccttgtgtctctgaacaacaatccagtcttccacaggaggcacccagggtctggcctgagcaactgtaataacagagatggggaagactgtgggtggagtagatgctcagtttgaaactgtctgacgtccaagccgagatgtcagggagggtgttggggatgtcaagggccagggaaagggtctgggttggagagacagactccagagtcatcagcatgaggctggattggaattctgsgggagggagtttagagaagaaagggaagtctggtaactgagtcttggggcttttcaatatttatttagcttcttatgtttcatatttgctcagctcttgcatcaaacatttgcttattgactgataacaaaaacaaggctatgctttaaatttttgtagactttcctctactgtggaagtcactctaagattcatttattttttcagctgtcatgtctaggtaaagttgcgcttctccatgggttcaatgaactgctctcatgagtcctccctgcgcctgtgttgtaatcgctgtagagtaccctggtgggcagttgtgtcctggtccctgctgtggcttttgtcctctttggagccatctctagtgatgcaagaatcttcagcctttgacaagcgtgcttggtaacatctggtttctaacacagttgcgttatttccctttccaggggttatggaggtgctgtttgcttcagggtgaccttatgatatttagcaatactgaattttattgggagcacttctggttttattttggtctaatgctatgctaagtctttgacaccttgcactgaattctggtgaggcttggctattatattctcactgaacttctaaagatcttttcagatgccacacattattgagggctcagtttctatgactcaaatatctaagtattcatggacctattttcatttaacatcaaaatctacctactcataagactactttgtgccaggctgatacattttagttttaaaaaaattattactttttagccctggcggtttttctgaatatttatcttggttttagagcttttacttttatggtaaatgtgtttatatcaatttttaacacttatctacttctcggtttcttgatcgaaaagtttctgtaatgccattggcgttatttcttcattgtctttcctacagtttcttttttgttgatacatactatctcagttatctgctgcatgacaaascagccccagacttagtggttgacagcagaaacaggcatgtgtttgctcatgatctgtaatttggctagggtgttgatggcttgtttctgccccatgtggtcttggccgttgcagctctcttggkgctggaagaaccaaatggcttcacccatgtgtgatgcatcagctgggatggccaggacagcaggagactggctgggctttttcatctcctttgtggtctggatcttccactgactgtcttactaggtggcctctttctctaacagggaagttgarcttctcctccctgcttccaagggaggagaagcagaaacttctgggcatcttaaggcccagacccagagctgtacagattctcttctaccacttcccatcctgttcaaggggagaggaactagactctaactctggcrggggaggaacatgttcctgcggggatggtrgagactgtggaggtcagcttgacttccagctcatttggcttcttttaggtgaagagaaatgtgtttctggcaaagatgatgtcagttaggagactgaatccaccagcacagagcagggaggcagagacacgtacgtggtcagaggtgcctcaatgtgcttagtctttttcttggctctgctggtgctacacccgagaagtcatttagatttggtgtctgaagtaactttgtgatgcaaaaacaggatcaktgaacgttcagtgtttgattttaccttgaaatttcacattttaacaaaggacagaaacatcaagtgaagaaagtctttgtaaatgtttttcagttttcaaaaaaaggttctgttagatgttagaattatgatgttagagttgtctccagatttcacggaggcacctctttcctggacgtgccagactcttctgcgccctgactcrccgcagtgagagtacctagaccatgactttcccaggtgttgtgtgttctttcaaccctactgggaagtccctttctcagactgcctgggagacgtctgcctgtctgtcatggaagtcctttatgccatttctcacttgacatcagagatacctcaaccagaggacactgtcctggcacctcattccctctgccctgtacctgtttctcaggtacctgttcctgccccatgcctgttcctcagtgggggaattacttgtttgatggatgaatttggcggaaggaacttagaccttctggcttctcctttggggatactcctccctctaggacaagtgttgggtctgttctttagccacacactttgtgccatgcctcrtcctttaggagaaagaatccagtgggggctgggagtgagtgggcaaggctgtttgatgattaggtgaggtgttagctcacccacctgatccagatctgamgtcaggttttcaagtgtttattagtgatgctaactccagcactgtcatttcacccttgctcagttgtcccttcttcactgtccttgactgccccttttcttggaccccatcagtaggaagttggggtcaactcagtgttgacaggttcattttggccctgagctggttcaggactacatcccagcctgtcccagcaccttgcaaataatgggcactagatacacttgttgagttgtatggaatggaattgatgtataaatatttagttgcacataaacatcctggaaaaattagttgtgaatcacaaagaatgattctggtatctttggaggatctattgagaataaaagtaaaaactagagacaggaaaaaaaaaaaggaggaaacaatggtaaccttggcatctaaggagctatggagaatggtccaagggaggagaacaagaactggattaagtgttgaagcaggaaagaagaaagagctggaaatgacacacacacacacacacaccctctcaaaaaccaaggctttgagtagaagaaaagaaaaatttagagataagatttgaaaagggatacatggagtttagtyggataagaagaaagaatgttggcagaaaagagaaatgggtaacatggaggttttgggtaatactgggaaatatatacagctctgtcaacttttggagacctgatattgtagaatgcatgccaagtcaaagccaggctcctgggacctgcctcacaagcagaaggtggggtcttatcttagcacttgcgctaggtcccagcatcttctgagcaggcaggcatttcttggtgctgattttgcagactgcaaatgatgagactcagtactacttccctctggaggtgtgtggatttccatcgtgagtctctcatcagatttctatcccagaagtgctcagcatccatttcccacaaacattcctaagatgaacttgaccatggggcatgatgttagcattgtcttctatgtgctgcctgagctcccagctctactggaagttgcttatggactacgagcaatcttgcatgtgacttcttcaggtcctttccctgcagtggtattttgcctgcaatagttatacagccatgtattagccttgcagcccccatcactagatggcccccacttgaaaattacaaatatatgatttgactgcctgtcttatctttcaaatataaaactttgttacttgagggcaaatgtcgtggttaacgtgattatttctccaaagtacaaaacagtatgctggctatgtgtcaggccctggactaggccctatgggacagagtgcacctgctggatagggatggggcgccatgtgggacttgtccttcattctctcggagttcagcaaagcaggatccatcggctgtgtcctggaaatagaaggaaaatcacttccacctgctcttctgctgtcttatcagagagtgcagattaagctacctggtgttatcagcatgtttgtctcctcctgtctaggggatatgcaacgaagcatgttgttgaaggtctggaaccaaggacgctgtacagatttcgcctgaaggtcaccagcccctctggggagtgtgagtacagcccactcgtctcagtgtctacaaccagtgagtattcagaccgtccacactcacctctctctagatcaatggagatgacaagcaatttagaaaaaatattctgcctctcgtttggccttaccagaagcagaaatgatacaatttttaaacactgcartaatatttgctagttgggccttgccataacttgtaatgtcagggaagtctaattatgctttcacaaactgggagagctatttttgtgccagaactgtcctgttagtagccattcagcacaaaagggtggagtcacctttcttaggaaatgggccacaggggtgtgggctgggtaagcctaagcgtccccacacagccaagcaggctgcctgcctgagcgtccttgggcaagcagctccattcagtgtcatatccattttagacaaccccagggtgtgcgtcttaactcgccacacaaacccrattcctggggtcacggtgagtgagggtgaacgaacagtgctgctgcatccacggagaatcctgtgagggagagccccacatggagacctctgagcccttcagccggctgagttttaaggttgtttctgagattggtattttaaagcattttaaagatgctatctatgtccagggccatctctgagcaagagccttgtaaaaattaggatggtcacaagtgttctccacggcccacccactgaaaacacaggcaagtaatttttcagttgcacaaaggaaaccttccttttgtgagtaaagctctttttccgttttattccaggtagcatttggcttggaggtatgtgctttccatggctttcaactgtgtcctttaggcatttcttcattacaagttttgtgtagactaaagttaactcagcttttgagttaactcagcttttgagctgtggtaccttcagttgcagacctggcatgaggggacaggatctgagtttagcaaactgggagtttatctgtgaaaaacacaatttcagaggagacttgtgatatgaaatggtcaactctggggatgcaggtaaaaaaagagggctcgttccttcatccgacagtgttgagaacatttgctgtaacatggaaggtacttacctctggggttcttaagagaaagcaaagacagcagaacatgagctctgtgtgctgaaggaaggcagagggcattgcaggagaaggggcaggaggaagaggtggcaaagggagtcaggcatatgaacagagactccgggcaaccccagccaggatgccgtcccaggctacctttctgctccctcccatcctcttgctgtccccaccgcccacaggcctcctgccactgcacactcccctacctctgcccttcttccctggagcactcacttcattgctgtgctcactgagcctgctccatgggcaagcatggcaggggcgattcctcgtgtggctttcccctcctctgtcacatgccttccctcctccccaggtacagagcagtattcccccacctctatgaacacttcttgcatcttaagtatttgtctaccttttggtctctcacctacattgcgggctccgaaaggatggacgatgggttggccatctgtagcttgtgggagttccttaataaataagtcagtgtgtgtgcctgtggcctgagcaggagtatcgcttcagccaggagttcaaggctacagtgagctatggtggcaccactgcactctccagcctgggcaacagagcaggaccctttctttaaaaaaagaagatycttgatggatggatgggtaatgaattaaagaccagtggcagaattaagagtatgaaaagaaacactgattttctcaggttgcatttatgtttgttggaagatgtattagttttccactggccagtgagagtccacccgaaccttccaggtgagggtgaatatggttggttctgcagccttccatggtgggcttcaggtggcctctagcatcctcttaatagcacaccaaagccagggcaggggcttctggccstcctagcctgagtttacatggggttggagtaccatttggagcaattttaggaagggctgtttattagtgtgttctcacactgctaataaagacatacctgaggctgggtaatttattataaaggaaagaagtttaatggactcacagttccacatggctggggaggcctcrcaaccatggtggaaggcaaagaaggagtaaaggcatgtcttccacggcggcaggcaagagagagcatgtgcaggggaatttccctttataaaaccatcagatcttatgagacttattcactatcatgagaacagcatgggaaagccccacccccatgattcagttacctcccaccaggtcactcccatgacacatgtgaattatgggagctacaattcaagatgagatttgggtggggacacagccaaactatatcaggctgtgcctgtgggccagatgtgccttctccccactgagctggctccagaggcagccatggagagttggtgcagcgcatttgtccttacagcgccatggcttccatgagtaattagatgaggcctcctgcagggatgagtgtgtggtggtgaccaggggtgtgtgtgtgtgtgtgtgtgtgtgtgtgtgtgtgtgtgtgtgttgggggagtgatcctggccatttcactgccagataatagatagcatcactgcctgcagccaggaagccttctcaacctcaggggggctgtactgggtggtgaggatcaggtgtcctcctcctcctagctggggcaggctcttsgctctgtgggctggctgcagctcccttatgctattgtgttatatatttataatatccaaagcagattctcctaaggaggcagatcatgctaaacaaagaactaagaaggtgcacatgatacaaaatgcttctgtgtggtggtaatttgcattcagtttgagagtgttttaatgagtcacagaggcatgcactttgtttgaataaagaatgaacagccttttyttyccccccaggtaaagtacacagattcttgcttaaatgaggcttacaattttaatcagttgggcccttataaagaaagaaaaacagctgctacttgttaattggcaaatatcttctccaatgagctcgtgatttattcactgcttttaataaagacttaaaattccaccaagaaaggtgttagcaccatattataatatctgcaggtacatctgcaactaaatgaccctcttagagaacatgagcgatggcttcctcaagaccactctgccctgctctgcccttctcctcggtgyccctgctcacctggccctgactggtgagtccatcyggctcasgtgagcatgggctaacatcctcaccatgggcagaatcagtttgataattgtaattgcaacactcagggtaaaacactagaaaaacccgcagagcaatggccggccttttaaaaatattcagttgcacttattgatggcattcccttgggccaggcccacaaagtcttgaaggattcaggggtgggaggaatgaaacattctgttcaccctggaatttcctctctgttcctcaggactcctgcctatagtgggagtagaaagaattgctgtgcactgcaaacaagggccttttcatttcttttctgtttctttgtcaaattcaggtaaatggagacgttttcgtacctctgttgcttcacacaggtttcagtgtaatcctcagtccctcctttccctcttggtagtagcgtgaggacgattaaggagttaacactgagaaagagctctcacaccctggaacgatggttactgctcagcaagcaaggactgaggaacaattatgtcattcccctctcttcagtgaggtgtccctttgttctcagagtaagctgtgaagtgctctttacctcccgtggaagctggaattggcattacatttattatatcctaatactaaaagccctggtctttgctacaaacggtccttaagcttataaacatgcagtgaacttgtttcatttcccaacctttgcatgctgcagagcttcctggttaggatgcgctaggaagtgtccccaccgagagagcctttctgttcaggtaagatggaggctgtggagtagaggggtcggtgtagagaggtggttggggctgtgcccttagaactttccttaacatctcaagcagttagcacgttttggaagatttttaggcatcccctttcttttttaacactttgcgggaggatcacatttacttatgatgttcatctgtattcaaaatttggtaagaatggaagcatatagtgaactggtcgatactgcagtgtttactaagtactaaagggaaggagtgggcctcatggaagacttggccttggctctgatgctgccctctcctaactgggcgaccttggacaacttagcttttctgactcccagtcttgtggtttggaggagaattttaaaagcactgggtaaaaagcctacgtacagcttaattcataggatttgatttaggatactacacattgtacaacttagtagaaatagaatgagctttatatgttgttataggtgatttatccaaatgacttgtttttatgtttgagtggcaggtgaagtttcagattaggaaaaagtggggcctgttaatggrataacagagacttttataaacataccasttttcttctcctggttagcaacagaaggggaaacagtctatgggtttagttcatccatctaaagtatagatgagacgcatcatgattttaagtccttattaatctagcccagggttctcaactttggtactactgatatttggggactggatggttccttgtggtgtcctgtgcacttatggattcttagcagsttccttggcctctatcctctagatgccagtgctccatccccttcgttgtggcaatcaaaaatgtcaccagacattgccaaatgtcctctggggtataaaaccctgcctcctttctaagcccttctagtgaaaccactgagcatggcatgaactcccttggaaggccagggacagctgtgagccttggcctttgacaggttatcgtgcgacttttatttgacacttttgatctaaaaaatgtgtagaatgatgaaaaggaagtataatgtagctaaaaaaagtctgtaagagattggctagctctagcagacaaaattgttatttcaaaataatttaaacttggcataaatttatttttatgaaagaaaggaaaaggtatcggctaaagatccttctggtagaaatccttttattctcctgtctcactgttttcccagtttgtacattgcccaattcacttggcaccactgaaaccctccgaggaaacccagagaaaaagtgtctcctatgcccaggaactggcatcccagagagattttctaccataaggagcaggaagagggaggccagctgatctttctgggccggaccataagagggagggtgggtgagccccaggaggyggcgtagggtgcagtgggggaggatggggtaagagggagggtgggtgagccccaggaggcagtgtagggtgcagtgggggaggatggggtaggagtggatattttctttcagggtttagaataacaggctgaaagcaggcactacagtgtaagtgagcatgggaactaatggttagctcttttcatgctaaccccctagagcctagcacaggacttggcatgtacattacttaggtttgttgaatgartaaatgagacctttgaggtttttttagaccagggattataaactcaaactcttgccgtttgcggrtgaggggctgggcgtacagttggagtatgtaagaagtggtggggctgtatccactgaygatggtagctgctgtactgtcacccccaacaacaggttgtgtgctgggtacttacgatgtgtcaggtgctattcgaagtgcttcattggtgttatttcatttaagcttaattgtgatactttttaaaatcagaaggtgtagaataaagaacaaatgaaactagaaacgcctagaaagatgggtggcttctacatagccctttattctccctctgcttgtgctgcccgcctgcctgttggcttcgctgtggagctgatgtcccctgtacaaaggatgccctcctccccggctgtggcccattgttcttttaggcttctggactcctcctgggtcttcgctggttggcaagctctctcccctaattggcttttctcctggtgctccccaccttcctgtgggtcgaagcccttctgcccccagaagctcagagaagacaaggccaatatgtaagtcacattcctgggaagaactgaaaattttaatttcaaatgttaaagcactttgtctttttttttttttccaagtagtttaacatctctttggcaaataaaactagcatattgtgacaattgctgaggttttccttgcttgtaggagacatttattaagtcttatgaaatctgaaaggattatttccaaatatcaaagtaacattcacaaagcaatactgtataacttggaaatgtcccaagctttaggtcagtcaaaatgttctcttaatatgtgaaaacaaggtcattttcggtaaaagaagcaggtgagtaggaaatgtaagatatacttaacaggaatagccaagcgccttcctgaagatgatcccctgaaggccacaggaggacgatggcgggaagcagtctccttttctgatgttctggatgactgccttccatctcatttctccaggagagcccataagtagtgagcacttgcaccgggctgtcagtgtgaatgatgaagatttgctggtccgaatacttcaaggagggtgagagaactctgtcagttgttttttttcccccatgcctataaagtgcatagaaatacatgcagtagtttcattttgttttcctaaaaattcccatggctttgaaactgcctccaaaatggatctcaggtgactggtgtgagttaataaaccacagttaataaagatgctcrtgaagccccatgtaaatgttatattttgtgattgtgtaatagaaattgtaaaaggaattacaaggctgggtgtcatattttcttcccagaaataatttctgtctcttgcttataagccgcagcatttaggcaaatttcacccccaaatgcccacatctaatttctgatgaaacaagggactcgccaaatcaactgctttctaatttagaaggttgatgtaacactagaggggaaatggtgaatatagctgctgcagatgagatgtttgaagttaccttctacatgaaaagtagatgttatctaggttctttttgaatcaatagttttgagtgccctagaagacaagtcatttgtgaattcggctctgtaatttggagctcttaagagaaggttcccacaaaaagccaaagctgctacgctggagtatgtgcgtgaagacctccgaaagggctgctctctacccagtaggtgagatgggaggcaaggataaagcttgagtctccaccaatacagactcatgttcggtagagctgagagtcagyagtgaagacactgtcctcagctatcttaaagagctgtgttcactggagagtgctttatccgatggcctcatggctttgagccgaagcatgtatattttaagtgaaattacatcaattttctcttttatgatacatttgaatctcatagaatattaggtatatagtttagaagattcttagcagtctaagacaagaaaagatttaatggccacaaagaaattggaattttcagtaaaatgagtcattttacccacctaagcccygtgagaaccaccggctttgactctgcagtagctgtactgagcatgyttatctcttttctctgcttttcccaagccgtgttaaggttgatgttcccaataagtttggctttaccgctctgatggttgctgcccagaaaggatacaccaggtatggctcttcttttttttaaatctctcttggggatttaactttttattttattcaaaggctctggtcaggataaggatgggaggaaaaagggccatggaggaaccgtttcttttctatctcccaaacygtaccatatgatggcttagaaattcaactattgtaatcataaagttacacaacatgcaggagagaatgtaaatcatgtgttgaggaagagaggtagccatttaattacatgcaatatattttttatgttcttggaaaactggttattggaattcaattttttttttttaagatgtagagagagggatattctggaaaactttctgctaggttgctaagttataattttcacagatacactctcattrtctgttccacacagagataagtattaataygaatacctcattttcatttatattttaattaaatgccatttgaaaaaaacagaaatgcatcttcattacatgctaccatttaagaatacattaaaaatggccattcaaaggacagcraattattttggtagcccgatttgtttcatgtgctttcatttgattttaatgaataactcgtgtcaaaggtaaaagcccacatttctggaataaagaggtggttttctggtttaatggtgcctggttttaaaaccagctggcttctgaaggtgcagaagmaactgttgaaagatacatcttggatgctgtgttactcatttttactggactattgtgggttctgagtgatcaaggtgacttatctagctacacttaagtttgtttcctttaggcttgtgaaaatcctagtttctaayggcacagacgtgaatctgaagaatggaagtggcaaggacaggtaggaggtggkatatgactgaaattgtgctgatgttctcagaattgtgttgctaggcttgtgcccagaggggttgtgatttcaccaaaacattgtcttgagtttgacagtcctgagaggtgagtgggtcgctgaggaaagatggtgatcacaaaagctggcttgctcacatggtcttgtgcttttgctcaccagggtgcttaggggggcatctgttgtaacgtatggtgacttctctggcatggtccctgtgcccagtggacacgcagtgcacgggaaatggcagctacagagcagctctcgccatccgcgctgggcgtgggtgcaagcgcctgcccctggcaccccgtgcctctctcaggcccccgctgcatttcagcctcattcattgctaagaaatcttygttgtttctaaagaagcagacagaaattaccacaagagagacaccaagagcactttcctgaggtgagaggcacatgtccccttggagggctgagaacgctataggaaaagctcaggggaagaacgtgacacacataaaggacagatgagagtgttcctgaaagacctaaaaacacttgctcatctagtcattcatcaataaattccaactaacccatgtttattgatggattactacttgccaggtgctgtgctttggcacatgggtgaaacactgagcaaaatgccaggccctggcttcaggggctgtggtcacaacacacacagaaccagggcttgrgcactgtagatgacatcgacagacagctgccaaacaccttctgggggaggccttgaagaaaaccccaactaacttctcaaatcagaaggcctatcttctacatttacattctctgaacacaatacagcaatagattttaaataacaatatcttaaatatcacttataaatttaaaaagtatttttccaaataactcataggttgagactaagccatcaaytccaagtttgaaaagaaaaatagcaatctgaaaagggaaaagaaaaaaagtatgaggagagtaggaaaaatgaaagaattaaaagtagacattgattaaaaaatagaaaggttattgagaaatgagagttgcctcttaaacaaaaagctatctaataagatacaccaatcttttgtaaatctaagaagaaaaaaattagaagtttgaaagagaagaataactggttatagagaaaatgtaaacatgaaaagaagtttgtgtctataatagtagataatttcattgaaatggatactttttttctgagaaaatttaaaccgccaagtcaacccaagaagcagaaaattcgaaataaccaatatccatgcaagaaactagaaaattcatttaaaaattacctccaatgtaggctctgtggcttgactattcgaccagtgaacctgttcagattttctaggcactgataataaacttgggcttttccagagcagagaggaagctggaaagctccagaggacaaccttattgctaaaatttgatagaggaaaaaaaagctatttgtatgtttgtttgtgtgtaggtatttataaatctcttccatccctcctatgagggccataccagagggtaaggtattaggaaattttttaacgtaacaytttccatcagtcgattaaaggtgaaaacctttatttgtgtagatgcaaaacaaaaattgggtgtaacttggcatgtatgttaaaaagtatctttttttttttttttttttgagacggaatctcactctgtcctccagattggagtgcagtggcgcgatctcagcccactgcargctctgcctcccgggttcacgccattctcctgcctcagcctcccaagtagctggaactataggcgcccaccaccacacccggctaacttcttgtatttttagtagagatggggtttcaccgtgttagmmaggatggtcttgatagaagtatcttattttttaaagtgaaggwtactttcagcctttgaacagtgtatggcacatgggaggcaggaagtgtctgttgaatgaaggattcctttgattgcagcataccaaggtttcttttattttttaaatcatctcaatcagccagtgtcattcttagtattggcaaattcctttccaaaattagtagtgaagcccaggagagtggtggagagcttgatgtgaaatctgcatccctctgaggatgtggcgtgaccttgggcaggctacctaacctctccgtatctcagtttcatgtctgtaaaattcgaataacagaagtacttatagcttgtaggcatttaatgagttaatatgaaaaatgcgttaaaacagttcctggcatatggtaaatacagatatattttgttatttcatgattagacagtattttgaaggctgatctacttaagaagatgtgaactgagataagaggtatgatttatttcctgtagaacccaacagaatcaacttgaaaaacttagacttaataaggaggctcagtaaagtggacagctacaaggcaaagaaaagactttcttaaatccctgcaattactggttaataaatataatggggaaatagaatgaaaacaagaaaggtaggaaatctgaattaaaaaaaaccctaaaaaccttactgagagatataaaaatttaagaaataaagacatgtcatatgccagaatggcaagattgactattatacaatttttagttcttctcaaatactgcattgaggttcaatggaccctcaactggaattattcttgggaacctgtcaaaatgattgtaatttatctagaagaacaaatagataatatctactaaaactttgtcaaggaagaatgtggaaggacttgccttgacagttattaaaatgcctcataacgttatagtaattaatgtagtatgatactggaacaaataatcagaaaaaaagtagaatggaatggaaatcctcaaatagatccctatctacgtaagaacctggtatatgatgatggaagtaacataaaccattgaggaaggtattggaaaaataggatgtttgaaggaaaaagtcaagttagatcctggtcttatagcgtgtaccaaaataaattccagatgaattaagaattaaatgtaaaaaacaaaaccataaaaaatgaccagaaaacacagaggcataattattttatcttgtaatgtgaaaggaayaaatgcattgaaaggaatcattaagaaaaagattgagtgtattatatatttttaaaaacttaattacaatgttaaggayattccagggaaatatttacaaatgtattagagacaaattaccagcatctttaatgtacagaacacacacatgcccatacatatactccaaaaaagcctccacacacagtagaaaaaagcagtttacacaagaagacaatttatagcagaatcaatataagcaattcatataaagatgtttagcattactagtaataacaatttttctatcaaattggtgattaaaaaatwcatgttggtaaagatgcagtgaaataacctgtactttcaaatatagttgatagaaatgtgaattggtatcatctttctggaaagcaatttggaaatgtgcatccatattaagccacatccatggacacagtgatcccattttaggaaataatcagaaatgcaaatacgattagtaagggtgtttgttgttgccttatttaagattgtggaaaatgtgaaacaactgaaacgtctgacaataatggactgattgaagttatgatacattcatatgatagaatatttagtatgtgttatgatatattcatatgatggaatatttagtatgccaatgctgttttcagtgcttaagtaaacagggaagtatatgaaataataagaaactgaaataatacttttaaaaggcagggagaagagaaaatcatacagaacaagagagaaaagacgggattttgtgtagagctaggaatgtgaccctgagcaggggactcagcagcaggcaagcggagcgggtcctccatttctggtgggcttgtactagggcacagtgggatgccctgcagggctgtgctcaggagtgtgctatgtcctggccactctccccttctcccaccttgtgaaccagagaggggaattcttatagagcagcagataacagaccccatgggtgccaggcagtttgagttcagatggcagttgggctggtggctgactccagctgcttggcccttggaggaccttggtggctttctgccagtgggaggtggtaagttcagggctgtgcctatccctgggaaggaagagcgcctggtctcaatgasctcattgctgggcaatccagagcctccggggctggagtctctggattgttaaaataatccaggattattaaacaatcctcctcaccacctagagcaaattcaacagaatcttaagagtttgttctctgtgaggtgaggctatgggtgactctgatatgggattttttttctaggtaccatgccttactttataatcagaaaagaggcattatttaaaaatcatgcagataggctgggcgtggtggctcacgcctgtaatcccagcactttgggaggctgaggcaggcggatcacgaggtcaggagtttgagaccagcctggccaggctggtgaaaccctgtctctactaaaaatacaaaaaattagccgagcatggtgttgtacgcctgtaatcccagctacttgaggggctgaatcaggagaatcactagaacccaggaggcggaggttgcagtgagccaagattgtgccagtgcaatccagcctgggcgatagagtgagactctgtctcaaaaaaaacaaacaaaaagtcatgcagayaattagagttctrtttgaatataatttaaaaaatgaagttttcttcccttagcaaaggtcattctaaagacctttgagtgcttgggaaagcagtatgaacaccctaaacccagcaggcaggtgctgcaccatgctgactgtcttctgggggtctccaagaaatgagggactgtgtgaggacatgcagctgcagagttctggcgccatctcagctcggctgtgccttgccttgggggctggatattccagttatcactcagaggctttgcacgtttccctattgagaagatcttctgttttattttccaactctctattttgaaatatttacayatttagaaaaaatgaaagaatagtacaacaaacacctgtataccccccacctaggcttggcagttgacatttggccatatttgcctctccttttttttttttttttttttcattcttgctgaactattctgaaattagtagatagcataacccttcacccctcaatacgtcagaaaatgtttcctaaaaacacagtcattaacctgcatagtaatcgtgtcatatcacttctaagacacttcaactaattccttaatatcactgatacacaaccaccctgcaggtctcccaacctgttccccaaaggtcttccacagctctatttgggaggtggtgtggggttttgggggtgttgtggggtgagacgttcccacatttcatctggccattctctctctttatagtctctggttctagaccagtcctctctttaaatttttttttttttttctcatagcagtgactctttgaggagagcagaccagttatcttatagaatgtcctatgttctggatttgcttgtctcccggttgtggggcaggcatttcacttgttcatctatccctttattaacaataaagttaaagacaggcttaagggctctattaggttgggtgctgtggctcctgcctgtaatcccagcactttgggaggccgaggcaggaagatcacttgaggccatgagtttgaaaycagcgtgggcaataagstgaaattttttaagaattaaaaaaaaattaaaggcttaattagactcaggttaacactttagcaagaatgcttcagagctagtgttgtgacttcatgttacatccattgggaggcctgtgatgcaggttgtctcacaggtagtgattctaggtttcattattttttttagaatgatgacagcaaattttcttctctgtaaagatacagttttcccattgcacttagaaaataatttctgggataattcattgccatgtgaatattccattccccattaacttttattttttatttatttttttttattttttgagacagagtcttgctctctctcccaggttggagtgcagtggcatgatctcggctcactgcaacctccgcctcctgggttcaagtgattctcctgcctcagcctcctgagtagctgggattataggctyttgccaccactcccagctaatttttatatttttagtagagatgaagttttgctgtgttgctcaggctggtcttgaactcctgagcttaggcaatccacccacctcggcctccaaaagtactaggattacaggggtgaacctctgtgcctggcctccccattaacttttacccaatcatttcagtgccaataattttattgcctgaatcaattatttaattgggaattgcaaataagggtttttctaactctatggttccttttatatttattagttggcagtcttctgtgaaaaacagcttccccccaccaactggggatggactacattttatccttaaaaaaaaaaaaaaaaagaaaatatttaatttttaaataccaatttttagagtaagaaattggtttgatagttatctctaatagtgtcaaatgagtattttttttcctttttctcttttttgaatatcatggactttggatgttttaaaatccaatattttaccctcagttacagtcactattcattttttattgagatataattcagataccataaaattcaccttttaaaacatacaattcaacatctaaaaatgtattcacaaagttgtggaaccaccactactatctacttccagaatattcatcccctgcccccctgaaagaagccctgccctcttcagcaatcacaccccattactccttcccttcagccgcaggcaaccgctcacctgctagttctgtcttgcagatgtgcctgttctggacatttcgtataaatggaatcagacaatatgtggcctttcatgkctggcatctttcagcacagtgtttcgaggttcatgcatgtttgtagcacttcatttctaatattccattgtatggatataccacattttgtacatcagttgatggatacgtgtacgttttatatgaacagttcccatggcttttccactcaagttaggatttcttggtttaagccaggtagggtaaaaggtggagctgagtttggtgactgtgcttattgtcaaatgcygcttcttccatatgttgcagtctaatgctggcgtgctrtgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtaygggacctgccttgttaaccacgcacatatcgttaagaatctgaaatgctgctccatggggtctggcagaagcagggcctttgattagctaaccttagaaatgctggagaaarttttctgacttagcaagaaagcccctgaaaccttagaatggacatgagagkgagctttccgattgtcatgggggtttatcttgtgtagggaaaagaaacaggtctgaatccagagctggacctgatgcttctactttctttcttttttttttttttttttgagatggagtctcactctgtcgcccacgctggagtgcagtggcgcgatctcggttcattgaggcctccgcctcccaggttcaagcgattctcctgcctcagcctccctggtagctgggactacaggcacatgccaccatgcccaactaatttttgtatttttagtagagacggggtttcaccatgttggccaggctggtcttgaactcctgaccttaagtgatccacccgcctcagcctcccaaagtgctgggattacaagtgtgagccaccgtgcccagcctgatgtttctactttgttcttttgttcatttgcttctctctccattcagtctgtcaccaaagctttactaagcatgtaccagatattatttcaaatggtggagatacaaagatattaagagagcccttatagccattgtgcttcttgttacttctaaaattaggtaatttttattcttggtttgttttaaagattagtcattacaaaaaatttccaaagaggaaactgaccatatcaagaataaaacatttcagttctttgcatctttacctggaaacaggcaagtggtctacttttgatttcacgttatcagaaactgcaaatttgatttagcaaatagaagcagtgttgttggacgtctatagatatttgaagatgggtaattagaattagatcaattatggaaattgctggtaactttgaaaactttatttcaagactttgaagaaattagctaaaaatttcaaagcatggaactaaagaatgatggacaaagttctgtgctatctgtgactgccagatggtgtgtagagtgctgagaaattaagtcgatgacctggaaaatcaactcaaattgagaaaagtcatgtctcctggaagatgtcagtagatttcttctagtttgtttctgaagggtaattgagggaaagtgagactgcagttatgggatctatctggttcctgctgctgcttttggagaattaagaaaagtgcccccttataggaaaaatctcagtcattaaaaatttattacatttcttattttccttatgttttagagacaggcacagaggcagaaggctgagtcagtgggcttccatagtagagccgggcccacgtgccatgtgtggtagtgacagccacrcactccttgattggtttatgatgaattctgggcaggttttgcacctagtgaaagtctgtggttgaaaaagaaggttgtactttgctgaaagaagtcaagcatckgggccgggcacagtggcttatgcctgtaatcccagcactttgggaggccaaggcgggtggatcacttgaggtcaggagtttgagaccaacctggccaacatggtgaaaccctgtctctactaaaaatacaaaaattagccaggcgtggtggtgggcacctgtaatcccagctattagggaggctgaagcaggagaattgcttgaacccaggaggtggaggttgcagtgagccaagattgtgccactgcactccagcctgggtgacagagtgagactccatctcaaataaataaatcattcacaatagggcaaatctctgctatcaacatttaaatactggagttttggaaatgtaggctctctgggcttcagatatgaatatacttatttgggataaattccatctttctttgaagcactggaactactttgcagaggacagaacaataagcatggatgtgtttactatagatttccacatgactggcctggtggcggatggatgatgtcaacatgagtctttccatattctggcaggtggctcacctgatgcttctgaagcccatgggaaggacttgagagccaatcaccaccttcttcccaaatgtaatgatcatatactaagagtgacttatttacttggcgactgacttattcatttgtgcatttaatgatccatgtgatctcaggaaaggcacttctctgaggtttattttgattgtttgtaaaccaagaataaaaatacctacctctgattaacgtttaggaccaaaagagaaagtgtgtgtaaagagggttgaaagctgtgtaaagcatcatgtaatatgaggtgcttattttattattctttaaatataatggagtgtgttgcccacaggttagttctttgcatgaagaagagctgcaaatccaaatcatgttacagtggataatcttatatgtagaaataccctgaagtgctcccaagatctcctggaaattccttgtttgtttttccattctgatgttttactaaagctatggatcatctttgagtaattcttctgtaacagattgtgtgtgtgygtkcacgtgctcatgtgtgcttatgtgcacatggtatgcgtgtgtgcatacacacgagtgtgtgtgcgtktctgagcacaaacacgtatctgtctttacttcagcaccactcttcatggattggcgatgtcttcattggaattggaagcgacaatatttacattttcttaatctaaaatatttattttaaaacactaaattgagagatttcagtgtagagaagatgatcaggaaacagccatctgattactgggcacactgttttggagaagcctttagtcagacttttcagacagagtttgtgtaatgaatctggttgttctgtattttacctgtaggtctcctgcctaaaattgataagyattagtaagtataagtgtgtatatatattattactgtcttgttccagaaaggatgtaaagctgcttacaacaatacataaaagtaagaaaaatgaatgctargtgaggaaagttaggcaagagaaaataagaactccccaggggccaagtggaaagtagttcagttaacttttctagcccatcttttttccactttaaaggatgtagatgaagaagccggtggggagaccctggggcctctcagcaccaaaatgtgacttaaattagcacagtgcaatgaaccaaatatagaaagacggctatctaagtccgggtgttggggcaagcaaatattccttttataagtttgaatcattttaagaaaaagaaattgggctcaacacagctgtttctctggcccaacaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtaggtcctcctcccgaaaataggcagttttctacgtggaattaakgtcagagctttttctgtaattagacaattcttgtgagttcagccctgcaccagcccttgggtttgactgtgtgtgtgtgttccctgtcggcttgttcataagggcatgaggctgtcactagaatactttcgttgtctttttacaactatttaaggactaaagaacccctgtccccaggaccactgtgggatcaaaacagaactggtgaaacaaagaacaagctgctttctgttctggttttagtgtggakagagggagtccattttccattttcyctggagttgctaccatayagctgcagaggaagcgctgtgcctgcaggccatgcaaagccacagtggtcttttggggttgcagggggrytgytgggaccctgcatgtgcyaggctcatgcccyctgctgtgtgtgccctggagggagaagytcatgcacaccaccctgggttttgttttctaggtggctgtgttaaataatcatgaagagttagttcagttacttcttgacaaaggggcagatgcaagtgtaaaaaatgaggtaaatgagtccatctttatgtaaagattttcctyggagggggagaaaacatttataagcatgtaaaatttttgttgtttcctgtttcagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccktattagaagaaaggaaaaaaaagcagaggccaaagaagtcttktgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaagcatgtgcgtatgtggtaccatcattgggtgtctgtagaatggggatgttttcttgcacttgcgccttttggagttagacatgaaacaaaatatttatgcaccggagctacacaaacacacatggggtctcccactcccggctcctgccccgcaagctgtccttctaccatgctaggccttgttggaattctttccctcatgtgttttcaattaaatcctcccctcccaacttagggcttccaggctggttgtcaggccgctgctccctcctggagtggcgctcctccgaaaagcccaggagttttctcttcagctgttggcctcacatcaaagctcagaatacatatttcaggactctgattctgttctattggaggtgtctgattgagggtcagcctttttggccacagacaggtctaatgtgtttgcatatactcatgccctgacaatggaagactcagcctgctgatgggtggacgatgtagccaaagggtagtatattaaattttgtcttcagagcagaaggttttctgatgctgatcatgcagttcctagacaagtaggaattaactgcaaccatgtctgctggttgggagcttaaagacacaaatgtggtagagcttcaactcagcaaacacacttcaaaatcagcaaaaaagtgagcacacagaccacatgagtttatgtctccagagagacactggttaacttgaccccatgggaaaaccagctacataggtctgtagaggagtggattttttttttcctgtagggaaagcctaataaaaggtaattaaagctccaaagcttttgctgaggggcatagagaaaaagcacacaattttattgacgttagcaatcagctttattccaaagagcccacagaatattcgttttaggaattggatttgtggaccatatatagtccattccttagatatttcatgagtgttttaccttttgtacaaatgcaaattcctttagatttgccagattaggtttttaaaacctctttaaaaattggagcacatttacaactctccagaggtccctcctttggttggtggtcaatgttgatgttcaccttagtttcattttttggtctgttgtagactgtattcactagcctgctcttatggtaggagtgtgcatcccttctggttgacatcaagcttggcaaaactgcccaccctcccgatcgatattgaaccatccttatattcttgagatcatctccctgggttatggtggactgcaggattcttcatgctcatatgctatgtatgtttgctctttttcttctttttacttaatgagattagaaagtggcgtatacactgttagaattttcctaaagagcaactcatagttttattagctctactgtattctaatgaacttatccttaggtctacaaattcatttcttctattttttcccctgggtttattttattgttccttttataactttatagtagatattaagttccctttttcatcctttacaaattaatttatagatttagggctatgaattttcccccagcagtgctttagttacattatcatagaagttttctaaacttttctaatgaaaaattcaactgggagaacttgctaagtacacatttcgtagccccatctctgctctctgaattggaatcttcagggaaagggcatgagcaatggattttaatgggtttgaacaagcatcacaagtgaggtcttctaattctaagatcttgagaatccctaccatcacatgtgctattagaaatgttttcacttgctgttttctaatctgcaattcatctttgaaaactaatgaatcaattcatttctagggtatggaattattttttgagaatttttattcctccaaggcacttggaaagatgatatattctgtatgtttggagtatcctgtttgatatatatcaattatgtctgaagttctgtatgtactaatttttgccagcttgtgtgatcataggtggagagtggtaagaataaagacttcttcggctgggtgccgtggctcacacctgtaatcccagcattttgagaggccaaggtgggcggatcatgaggtcaggagtttgagaccagcctggccaacacagtgaaacctcatctctactataaatacaaaaattagccaggcgtggtggcacgtgcctgtaatcccagctactcaggaggctgaggcaggagaatcgcttcaagccaggaggcggaggttgcagtgagctgagatagcaccattgcactccagcccgggtgacagagtgagactccgtcttaaaaaacaaaaaaaaaaagactcctttattcttgttagcattttgtatttgtatttttgtattttctgtagttttattaagttggatgctgtgttttttaaataggtatctatttacacttagatttttcataccaaataactccgatattgtctctaccactgcttgcttgctttttggatttcttatgtaaatagatgagttttaaaaaattaggttatacattcacattgttcaaaaaccatatcatgccccaccccccgtgttgtgtgtgagcatcttccttcctgtgccgtggtctcacacgttcatgaggttggtagcacacaccccttatgcacccccaccctgccaaccattcttcttagtttcttatgtactgctccaaagttttctcaagcatctataaatgaatgagaatacatttttctacatgaaggccttccgccaatttttgtaacattctcagtaacaaatgagagacacattgatatttacctttatacaatttattgggtttaatattcataacaataactttttctactgaaatagcagtttgtgtttacctgtcgaaccccaatatgagaaatgtgtacaaaagcaacagactgtgatagaaaaaggtatgtgaaaaaattagcaaaccaaagcatgataaatggatgaagcactataaaattactttgctgtttacgtaactgtatctttaatctgtactgtgctaaacagcctatagccaagttttaaagagttacaggaacaactgctacacattcaaagaacaggcattcactgcagcctcctgatttgacctgatgggagggacaggagaatgagtcactctgccaccacttttcctgccttggatttgtagaggatttgttttgctctaatttgtttttcctatatctgccctactaaggtacctgcttataggccatgaaaataaaacgccattcaactttttttttgtaaagctaaaataatcacatgatacttattctttggaggatttaaaatgtgctaaatggaggactaaagagttaccttataggagaatcatggggaacagagaaactgctttttgaagatgatgtggaaggtcagggtgggttacagggcattcaacctggaagagctgaatagctttacattgagaattactttgtatgttaaatcttctggccatcattatccattattggatattttaacaattttatagttattcttaatttttctcatatgaaactgtaatggctgtactagaagctgccattactgttccaaaaagtaaaggggattttctctacaaaaggaaagaaaatggcacattcacatgtaggtaagtagcttctggaaacatcctcactgcacagaaatggttctcagcatggggctcccaaactttcttagagtgtcatttgttttagtatcagagttttcaaataggtttaaaagcagtagatgtcaataggaactttaaggtgagtcaagagaattttgtaattatagataagttgattttctgtggctaacttccccttctaattagaacaagacattgggtgggaggtcctctgctggacttaggctggtggggttgctctgggctgcagccctggagaaggttgggctttgggcatcccttgggtgggccttgtagggatagccacacactgcagcagtcaccactttggctgatctaaagtagcaatggaagtagtgatttgactgtcaaactggagatgcatcggcctgtggtttgacctgggaaaggggcttgtgtctgggtgatagggaaaggtaaacagatgtattagccactggctttgtgtgggcagctgtgttgaatcagcctgctgctgagtcacagggagtaactgcagctgcctagggctggcttctagcatggagaggagaggaaaaggggtcctgcaatgtcccccagcagcctgtcattgtgtgtgaaactcctagcctgagagccccacctctggtcagcactagtgttgggagacttctgggagggattgtgactttcagctgggtaactggtgtctggctgaggccatcttgagcgcagtgaggaaggatctccagcctgagtgtgccgtgggccccccgaatacataggggagccctgcaaagcagttttgaaatgagtagtacatctcacgaagaaagtctgcaagaggtcgaggtgcatgagaaagatctggccctgctgccctggcgccaccttgtgccctttctgctgctgggggtctcattggctcagagtgcttagtaaacatcagtggcgagggggcaggaggatgctcagccctgccagtcggcccagcaccaggctctttttagcaccgtggagaccataggctccttaagaacattttgacacagttttagccggttttttttttttttttttttttttgaggatgcattgatgtattgatttgcctgggaacaatggcctatagttcagcctgagaattctcataaagttaagaaggcataaaaatgcccccccccgagactcgtcaggagtattgactctcctacagtttaatttgctgcttttgtggtttctgtgatgtcatcccacatgtgtaagctggaaaaatccacgctgtgaaatgtaacctcctgtgtgtatttccacaatggagaatgttaggcttcgtttccctcggttgctacacatctgattacatgtgtcaggaaaacaaacttaaaaaatttcaggagacaaacctttcagcggaattgcctggaacccatgaagtgaggtcatagaacctacaactataataagctgtaggaagaaaagtagcctctgggctactttgtgtctagtcacattgactttccaggtgatggccctacaaaactcaaaccacctctattattcatgcctatacagtcttttaaaaaaatactagattgccattgaaatataagtattgattttttttgttttgaggatataaaaaagaatactccaccccgtgcctcccccaaccacaaaacaccctggttattggttcctaagttatgttaaaatggaatttgctgctaaatatgcttcacttgataaatactgcatcttggaaggattaatactgtccatattgtaagggaatattagtttaaatatgttcttattcagaaataaaatgcatggctctataataacacattagtactgtagagataagaatgtgtcatcagccatggcccctaagtggccattgatgacatggcataagatcacagttttaacctcctttaatatcaaactctcctggctctctgaaatagaagcataggaattacagctaagaacaaacaacaaaagaaaaactcagttcatatcctcttataattggaggaagggctaacatgccagatctaaggatttgggcatctaaaaagacaatgcccacgtaatgcaccataaaattctgtaaacctttttaatagtatatatatgtttggctttagtacaattaccaagtgtaatcagttacagtaattctgtatgtatctcagcagtattattttccagcatggctttacattttaaagaacttaataactatagaataaacagatgcatgctatacgagttggaatgtattagagctgggttcccttttgtgtgtgtttgtgtcacgtgtttagttt

SEQ ID NO: 18003 - DNA, 23037 bp, Homo sapiens
gcaggagtgcagtggcgcaatctcggctcactgcaacctctgcctcctgggttcatgccattctccagcctcggcttcctgagtagccgggactacaggtgtctgccaccatacccagctaattttttttgtactttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcattttttttgtatttttagtagagacggggtttcactgtgttagccaggatggtctctgtctcctgacctcgtgatcttcctgccttggcctcccaaagtgctgggattacaggcgtaagccactgcgcccagcctttttttttttttgagacagagtttcgctcttgttgcccaggctggagtgcaatggcatgatcttggctcaccacagcctctgcctcccgggttcaagcaattctcctgcctcagcctcctgagtagctgggattacaggcatgcgccaccatgccctactaattttgtatttttagtagagacggggtttatccatgttggtcaggctggtcttgaactcctgacctgaggtgatccacccacctaataaaagtttcaaaacaaggcaatatgacaattagaaacatttatgtgcctaacggagccccaaaaataatgaaacaaaaattatcagaattgaaagtagtcagctctacaattatagttcatatttcaaccccccactttcaataatgaatagaacaggcaggcgtggtggctcacgcctgtaatcccaggactttgggaggctgaggtgggcggatcacctgaggtcaggagttcgagaccagcctggtcaagatggtgaaaccttgtctctactaaaaatacaaaaactatctgtgcatggagacaggcccctgtaatcccagctacttgggaggctgaggcatgagacttgcttgaaccaggaggtggaggttgcagtgagcctagatcacaccactgcactccatccaacctgagcaacaagagcaaactccgtctcaaaaaaaaaaaaaaaaaaaagctgcgtgcagtggctcatgcctgtaatcccagcactttgtgagaccaaggcaggagaatcacttgagcccaggagttcgagaccaagctgggtaatgtggcaaaatcccatctctatttaaaaaaattaaaagtaaatttaaaaaataaaaagaaacatctagaagaataaataggtgaatgtatcaaacagagtaagaagggtaagttgagtgccagagccctccctacagaacacagcctgcatggacctggtacaagtttgagaatctatgggatgatagagggaacaacagagatgggtagggaaacagggcctcatcaagaaacggtgttacaaaatttagtttgccttttagggggagagaggatattttgaccttacctcactctatataccaagtaaattccagagaatcaatgagtcaccaaacactgttgcaaaattattgcaatgatcactgcttgcacttaaccttttagtaatatttcctgttttgaccaaccccttgaaacgcatcgttcccaaccagcatcagacttcctagttgtctcctacttcaatggccttcccttcttagcccagggtagcagtgggtataggtagggaggctaggtgactgggtttaggaatatttcatttgggaggctgaggtgggaggatcacttgagcctaggagttcaagaccagactggggaatatagtgagaccccatctctagaaaaatgtttttaaaaattagctgggtgtgatggtgcatgcctatatagttccagctactcaggaggctggagtgggaagatggcttgagctggaaggttgaggctgcagtgagccatgatcacaccactgcattccagcctgagtgacagaaagccagaccctctcaaaaaaaaaaaagaaagagagagaaaggaagggaggaaggaaggaaggaaaggaaggagggagggaaggaaggaaggaaggaaaggaagcaggcaggccgggtgcggtggctcacacctgtaatcccagcactttgggaggccaaggtgggtggatcacctgaggttgggagtttgagaccagcctgactaacatggagaaaccccatctctactaaaaatacaaaattagctaggcgtgatggcacatgcctgtagtcccagctactcgggagactgaggcatgagcatcgcttgaacccgggaggcagaggttgctgataagattgcgccattgcactccaacctgggcaacaagagcgaaactcggtctcaaaaataaaaaaggtcgggcgtggtagctcatgcctgtaatcccagcactttggcagatcacgaggtcaagagatcgagaccatcctggccaacatggtgaaatcccatctctactaaaactacaaaaattagctgggtgtggtggcacatgccttagtcccagctacttgggagcctgaggcaggagaatcgcttgaacccaggaggcggatgttgcagtgagccaagatcatgccactgcactccagcctggcaacagagcgagactccatctcaaaaaaaaaaaaaaaagagatcacgtccaggggcggtggctcacatctgtagtcccagcactttgggaggccaaggcaggaggctcacttgagcctggagtttgagaccagcctgggccacatagtgaaatcctgtctctacaaaaaatataaaagttagctgggtatgatggtgtgcacctgtgttcccagctactcaggagcctgaggtagaaggatcacttgagccagggcatggtggcgtgtggcgtcccagctacttggaaggctgaggcaggagaattgcttgaatccaggaggctgaggttgcagtgagccaagatcacgccactgcacttcagcctgggtgacagaatgagactctgtcaaaaattagcgatgttggcatgtgcctgcagttccagctactcgggaggccgaggcaggagaattgcttgaacctgggagatggaggttgcagtgagcagagatcctgccactgcactccagcctgggtgacagaatgagactctgtctcaaaaaagaaagaaaaaaatagagatcataagactgagagaatgaaccctttgtagcaataagataccaaagtataaacaagacattaaggccatgccaggcaagagttaagccgttcaccaaagaataaactatgttctaactgctgcaaggtttttctttttctccagcagctaaacaagcactggccttgagataagcaatatagaaacaattgcagttcatccatcaccagacactgaccccacaagccataactatagctttgattgcacaagagatggattttggtgactttttcctaataagagaccactgaccagggactggcttcagttggtttatggaacctgtgcactgagtgcttttgtatccttcattttgacatatggtgctaattgtatttcttttcttttttttttttttttttgagatggagtctccctctgtagcccaggctggagtgcagtggtgcgatcttggctcactgcaacctccgcttcccggtttcaagtgattctccttcctcaccctcctgagtagctgggactacaggcatacgccaccacgcccagctaatttttgtatttttagtagagacggggttttactgtgttggccaggatggtcttgatcttctgacctcgtgagccacccacctcggcttcccaaagtgctgggattataggcgtgagccaccgcacccggcctgtaatgtatttcaatgttaagtctccaccccaaagtgaacatgggtcatatacaacacacatgtttattcagtatacttgcattaggacccccttcatgagtatctatagctcttcctgtaacctgttgaatatggtattttttgtttttgttttttcttttttgagacagagtctcgctctgtcacccaggctggagtgcagtggcgcgatctcggctcactgcaacctccgcctcccaggttcaagcgattcttctgcctcagcttcccgagtagctgggattataggcacatgccatcatgcctggcagattttttgtatttttagtagagacggggtttcaccatgttagccaggatggtctcaatctcctgaccttgtgatccgcccacctcggcctcccaaagtttgggattacaggtgtgagccaccgtgcccggccgaatatgtatgtttagccaagccattcgacataaagctcctgcctctttttaagggtctgtctctggttttgaccagaagcccacctcccagcctgcaggttgtaaccctttataagaaataaagtcagcctggcacggtggctcatgactgtaatcccagcactttgggaggctgaggtaggaggatcacttgagctcaggagtttaagatcagcctgggcaacataatgagacccccgtctccacaaaaaataaaaaaaaattagctgggtgtggtgtgagagcctgtggtcatggcatctggcatgatttttataaagatagttttattttaagtataagagtagtttttgggtaaggtgtggtggctcacccctgtaatcctagcactttgggaggctgaggtgggtggattgcttgaggccaggagtttgatatcagcctggccaacatggtaaaaaatgcaatgatcctagcccttgcctcttcctgtacttaagatactgtctgacaggattaatgattatgcttctgtgacctataaacagatgtactcttgcacccaaaccttgatgagatttatgctctaatgtaacttctgagcacatttgatgtaatttctgagcacatggagagccgccaccaccagtgtataaactgtcggaaacactgctttggagcagtctagcagaaactccctgaaaggctctcccgggttgcaattcttggtaagacttctgaatagaactaactttaaatatttaaaagcttgtttttttttttctttagttgacataacaaagcataccttagaagtctttttttttttttttttttttttttgagacggagtttcgctcttgttgcccaggctggaaatggcgcgatctcggctcaccgcaacctccgcctcccgggttcaagtgattctcctgcctcagcctctggagtagctaggattacaggcatgcgccaccacgcccgtctacttttgtatttttagtagagacggggtttctccatgtcggtcaggctggtctcaaattcccgacctcaggtgatccgcccacctcggccttccaaagtgctgggattacaggcatgagccactgcacccagccagaattctttttcctcttacagaaaaggaaaggtttcaccatgttggccaggctggtcttggactcctcgcctcaagtgatccacctgcctcggcctcccaaagtgttgggattacaggagtgagccaccgctcccggcctgtacttagttcttttaaagagaaaactggcagggcgcaaaactggccaacatggagaaaccttgtctcttctaaagaaacaaaaattaccgggcataatcccagctactcgggaggctgaggcaggagaatcgcttgaagccgggaggcggaggttgcagtgagccgagatcgcgccattgcactccagcctgggcgacagagcgagaccctgtctcagaaaataaaaaataaataaagagaaaaaaatactgactttcagcaccaacttgtggtcccaggtaagtttccacgctggtactttagccctgggctcgaacctgcggacacgctgtggctgcaactccccgcccgccagacctcagtacgcagcgcggctggtgagaaacataatgcactctgacttccacgcgtggaatggggagatggactgcacggcgggcggacctgctcgggctgatggacggcaggtggactgatgtgcgcagggactggcggcagcgcggtcagagccagtcagccaaagccaggccagcacaatagactgtcccggttcccgccaggagggcagcccagcaccaactgtacggtactgcgcctgcgccgcgaccgccaacgcgcccagtctacgcttgccggcgcaacagggccgactgcagctggaagatggcggcgtccgtggtctgtcgggccgctaccgccggggcacaagtgctattgcgcgcccgccgctcggtgaggtggtggcgagagcgcggggcttcgggacagggcttcgggaagcggacaggtgtgggctgttagcagtggcaggtcgaggtggggaggacgcggggtcagggccgtgggaaggtcacggcggagggcggggaaaggtatctcgccgcttgcctaggggcggggttcgggggtcctcctgaggacctgggaggtggggagcgatcccctgaccgagtcctcactcgcggctgttcccttccacagccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgagttggggacgcttttggggagagggcctccaggttgggcctgccgtcttttccctggttggggtgtgaccttgggctcgagtcttcccgtttgtggtttgggttcggacccaggaccactcaccccgagaatggccccattccctaccctagccacgccttggcttcacgggacaatcttcactataagccaacattatttagcatataatgcccgttaagtaggcggccaaattcttttccagccttttgttaaggagcccatataagggaagtgatcatgtctcctcttataatgcggaaaatgggattcagacaccttaggtgacttgcaggggtccaggtctgtcagcctcactgcccaaggtcataatctccaggctagaccagaaatacattttaggaagcaaatgcattttaacagtacaatgaaatgtgtgattttccaaaaaatacaaattctctaaattgacacaagaaatcttgagtcacagatagatatatgaataggtgagaagattcccaagaaataattatctcctcctcctttcagcccccagccccagggccagatgtttttattgacacatccttttagttttccagaaacaatgtcctgcgatttaaattgttactaagcataggaaaaggtggcctgcaacttccttgttatatgtcacttgttatagtaaagaatgctatattacatgaactctaaaatgtgctagattgtaaggagctgtctgtgctccagygccagagaaagaatctcaagaatcttgccaattttaatcaaaggatactatagattgtaaaatgcctcttgcattccaagatgttagatgtgaaatacatgttcatctaagattgtgtgatatatggtatatgcattgacatctcttaggaaagcaaatatcacatgttctcacttatcagtgggagctaaaaaatacgtacatacagatgtagagagtggaatgatggacagtgaagacttggaaggatgaaggggtggatgatgagaaactacttaatgggtccaggcctggaggctcacacctgtaatctcagcactttgggagaccaaggcaggcggatcagctgaggccaggagttcaagaccagcctggcaaacatagtgaagccccatctctactaaaaatacaaaaattagccatgcatggcacacgcctgtaatcccagctcctggggagactgaggcaagagaatcgcttgaacccgggaggcagagattgcagtgagccgagatggagccactgcactccagcctgggtgagagagcgagagtccatctcaaaaaaaaaaaaagaaattacttaatgggtacaaggtttgttattctggtgatggataattcagaatccctgatttgactacttgtgcattctgtgcctgtaatgacatcacacttgtgggcggggcacagtggcttacaccagtaattccagggctttgagaggccaaagcaggaggatcgattgagcccaggaataagaggttgcagtgagccatgattatgtcactgtactctggcctgggtgacagagcaaggccctctgtcttaaaaaaaaaaaaaaagaaaaaaatggagtttcaggtgtggatagaaatttctaaaaattgtgcttgtaccccataaatttatacaataaaaaaaagtcttggctgggcgcagtggctcatgcctataatcccagcactttgggagaccgaggcaggcggatcacgaggtcaagagattgagaccatcctggccaacatggtgaaaccccgcctctactaaaaatacaaaaattaggctagacgcggtggctcacgcctgtaatcccagcactttgggaggccgaggcgggcgaatcacaaggtcaggagatygagaccatcctggctaacacggtgaaaccccgtctctactaaaaatacaaaaaattagccgggcgtggtggcgggcgcctgtagttccagctactcgggaggctgaggcaggagaatgccatgaacctgggaggcagagcttgcagtgagccaagatcgcaccactgcactccagcctgggtgacagagcgagactccgtctcaaaaaaaaaacacacacacacaaaaaaacaaaaattagctgggcgtggtggtgcacgcctgtagttccagctactcgggaggctgaggcgggagaatcacttgaacccaggaagcagaggttgagtgagccgacatcacaccactgcactcgtctcgtgacagagtgagactccatgtcaaaaaaaaaaaaaagtacttaggaaagtagatgtgaaaaacttaaatcagctgtgaacaaatagtaaattaaaagactagaccgtgtgaccaagtggggtgagtggtacgtrtttcttttacattttttttttttttttgagatggagtctctctgtcacccaggctggagtgcagtggcacgatcttggctcactacatcctctgcctcttgggttcaagcaattctgcctcagcctcccaagtagctaggactacaggcacgtgccaccacacctggctaatttttgtatttttagtagagacagggtttcactatattggccaggctggtctcgaactgctgacctcgtaatccacctgccttggcctcccaaagtgctgggattacaggtataagccaccgcgcccagcctgtggtgcrtgtttcacagcaaccaggaggctgtcaagaaaattaatattaccttattgggtgccaaggcaacactgtttggtgttcagagctgattaaaaacaacaacaaaaaagatattataggaacaatatttagtgtgataaaatatacagtctaaaccaatagtcccttccttaatgatgaaaggataaaatcattgccagaacaaaggcagcgtgtaatttttagaaaggaaaaaataagttgttrtttgcaaatgatatgttgtatgcttagacaaaaacaaataattaactgaaaattgagagtgaatttaaggatttgtatgctggtgagaccaggtaaatgtgcacagttagaagtgtccctgtgggtccttgatagccaatcaggagagcaatgatgtggtgtgacgagtcattcggctgcccctgttttccaagcatgactgtgtccccaagcacaggggtcctgctggggcagctctccctgactccaggattcataagtccctgcctggggcttgtactgagtcactcaggtggggtgtgagtagggggctggggagtggtttgtttgtaaccttttctggtggcttcttgaccaggtgggagtgtggattgatgttggcagccgttttgagactgagaagaataatggggcaggctactttttggagcatctggctttcaaggtgaggctcttaaagtctgtctcctctgggcttagggctgcctgttgtccctcctgaggatgaaggtcagaaaaattagcctgattatgggcctcagttgcggggctgatgtctggctggctttcctaaaaggagccacatgagcttaacctctcctgagtgggcacgtatctgatgagcccctgcctgaggccctcagagccaagaggacccaaggaaccataggagccccacttttcaccagagaagccaggcctgtggaacacacgtagatatgcacatgcattttaacaaacccacagacatgggcatgcatgcttgcttatgaaatgttcttctctggtggaatatctaggcatcccttggttgtaaagacccatgttttttaaaggaatgaaaaacatggagaaggattatggggtgggcagggccatggagccatagtaggcaacctagccagctgcaatgtcacaggtatgtgtgcagaattaacgtgtgtgtgcacaccaagagatagcaccactgttctccacacacaggactaggattgggtcccacagaggccactagcatgtattcacaaacatacagtcatgggaatggcatgggaggagtgggttctatcacttgaacacaggtgtgggcttacctgaccatggctgtcaataaggaggggggaggtgtactggtaatgatccccacagcttgttggtaagctgttacaggagctttaggcaacacttgctctggccatgcccttcagtcctggccctggctatctctgttctgttggcgcatgatgccatggttttggtcacctcaaggcctgcttagtgcttggtaaacagactctgggatctgtgtccccagagtctatgctgagggaggtacctgtggaccagtggtcctgctgggtgtttagcctctgaggacagggttcttgggttcctgtgtagctcctgattgttctggttgatatctggttccagggaacaaagaatcggcctggcagtgccctggagaaggaggtggagagcatgggggcccatcttaatgcctacagcacccgggagcacacagcttactacatcaaggcgctgtccaaggatctgccgaaaggtaacacctggaggaagaggcggggacagagggcagggaagcagaggacagctacctaggagcccctggctgaccacagaatcatattacccttagcgtatggctttgcagcygggcaactaggggtgggcagcaggagatgccaggcctggggattttgtgctgtcgttggtctgcagtggtccacctggcacctaaacatgtcctccttgcatctagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggtgagagttggctggccttgtggggggatgcttgctccattctggcctggccagaccctttccaggtcacatttttagttggctagctgtcggggttattttcctgagttatgcaactggagacagtttctgtatccatgtggtccagtgagtcttttttaatggctttgtgggcttcacttgaattttgggctttgttttaaggtatgttttggtgcatgtcctgacagtccaagggcgaagtgtctgggtgtcccctccatgtggtctcttgtctcctttgtggatggctccgggagctttgatgctgcccttttgagagtcccacagtgttggctcacgccttctcagagaagactatgagcctgtcctgaagtcaggcatgaggcaagggcagacaagggttgccctctgggccctggaggggtgggtggcagagacaggggaagggggttgggsagtgtgctagggcccactcttcggagaaaccatgcctctcctagtctgcctcctcagtcccattcatgcatgtaccccaactcactccagtgtggtagaggtgttgacacactgaccatatgtcttgtaggaagctgtctcgtgcagacttgaccgagtacctcagcacacattacaaggcccctcgaatggtgctggcagcagctggaggtgagtgatggaatcactgaagtcctgggtagtggggtcccagccttggttatcaaagccgaggkcctggttcccaccataggggacctttcaccccaggggactctgctcccaccctaaccttgaggggaatgaccttcctcctgtgctctctraggtgggataggattctaccctgccgccaccactgggactggttacacaggatgctgtccctctggtacaggtctgtcttagccccacctggttctaggatactgagttcatgggctggtaggggatrtaagctcctggccttgttccttgtggccttgcccttgggagagccagccattagttgtgtgttgatgcatgcctgataacaaaccaagaagtgccttgaaaggaaggcacagaagggtggggaagatttcactggggactcagagttggagtttgggggaggggctttttaaagcacctgtagtttgaacagaagcctgaaaggtggtgagtgttatttaggtggggtgtggggagctgagcgcaggggaagagcagtgtcatggtctaaggtttgctctgctgctgtgtggggtcacagtgcaggtaggctggctagagaggggctgtggcagggactgggcaggagatggcaggagcaagggggagcagtagatggactccaggtggttttatagatggaacctggttggggtctggacatgggtaaggaactgaggtcaaggtgcttcccatcttggctggtcgtggtggctcacgcctgtaatcctagcactttggaaggccgaggtgggtgaatcacctgaggtaaggagttcgagaccagcccagccaacgtgacaaaaccccgtctctggtaaaaatacaaaaattagccaggcttggtggcagttgcctataatcccagctacttggaaggctgaggcaggagaatcccttgaacccgggggacggaggttgcagcgagctgagattgtaccactgcactccggcctgcacaacagagtgaaactccatctcaaaaaaaaaaaaaaaaacaaacatgcttcccagcttatgaccttggcggctgagtgtgcagaaaagaccaataggaagagcatgaccaggggctttggagctggggaacctgggggcaagagcaatctgacgtgtgtgtcagactagcagggcttgagctcatggaaggaaggaatgaaaggccaacgcaggccgggcgcggtggctcacgcctgtaatcccagcactttgggaggccgaggcgggcggatcacaagatcaggagctcgagaccatcctggctaacacagtgaaaccccgtctctactgaaaatacaaaaaaattagccaggcgtggtggcgggcgcctatagtcccagctactcgggaggctgaggcaggagaatggcgtggacccgggaggtggagcttgcagttagctgagattgcaccactgtgctccagcctgggcaacagagcgagactccgtctcaaaaaaaaaaaaaaaggccaatgcaactggtggcaccacagagccctcctcttgtggaggtgaggaggcaagatccaaggagtcctagggtatacgtttgtaacattatttgcaaatgtccccagctctcaggggacccaagagctaatcacagccctgtaatagctcctctttctgccccctcacttgccaccccctgcagggccagcagccagaaatacttgagggagagctagagggaaaaggcaggccaggtggctttgtgcccaggagtaccagtcttgtccttgatgtaggtggaatgcatcttctcaagtgagaacccacacttggatcacatggcagcccattttgaaactctgaacgcttttgctctcctgggactgaggccatgggagctatttggccctgaggtgcctgtcctgtccacaaggcagggtctgtctgaggaggaccttctttcctcaccctgttctaatgtcacatactcctggtttctcccactaagacaggacatgggggtcctctgcctgtctgtgaatcgccccaccctgtgccttgggccctggctggtcagtaatgccactgtctgtctcagcaggagtggagcaccagcaactgttagacctcgcccagaagcacctcggtggcatcccatggacatatgcagaggacgctgtgcccactcttactccatgccrcttcactggcagtgaggtatgctgccttttgggcaggagtagtgctcagctgggggcctgtgggaggacccccatgtgcatggttatcctggtgactccagagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtggtgagtgccagcgcgagcatgggacctcgccttcagggaagagagggtgctggggctgtgtgctcctgtgcgtgggggtcacagtgtgcgttgaagacaagagggtgggtgctgaccacctatccccctggcagcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggtaagtggcagcctggtattcctaggtgggatggcggctttaaccagcacagtgggaggctgagagatgacacactggctcagaatgaataccacccacccccccactttaggatgcgcctgtgtaccagtgccacggagagtgaggtggcccggggcaaaaacatcctcagaaatgccctggtatctcatctagatggtgagtcctacagctcagcggggaggggtagagtacatcttgccagcgacagcaccaaggtggccactgctcctaactaaccaaggttagaaaggaaaactttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctggagattgtttgtgtacctgtgggtccaggattgggctgggtggacctctgagccttctctcacccttaaaggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatarcgcagcctgctcctataggcatccctggtgtcctaggcagctgtcacctgcaggggtagcatagtgggagggcagggcataggtgctgatggctgtggagatgggcggggcccatggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttctctcctctctttccactcaaagcctgtcttgtgctgctctgggcagcatctccgagctgggtgcggcacagggccaggtgtccctgtgcaggccaggtaccccaccctgacgctccaccctatccccacaggccccattgagcagctcccagactacaaccggatccgtagcggcatgttctggctgcgcttytaggcgggaagyctatgtaagcaagagggcagggccggggtttgtggtccccccycmaccacaaacacagcacttcggctcctctaacctgtgccacaggtgaccaccaataaaatcctctgctgagaagtgtgtcatccctcttttggcattggcatggagtccatggggcagtagatggggagcaaggacttccctctagttctgtggctcctggatcctcctgccttcccacaggctgatgtgtcctcagccaggggcaagcgtgggggttgcagctgaggccggaagtctttgatgcctacagggagctgagcccagatgtttccactcagccacttaggggagttcctcagccagctggtcccaagattgggctgtgggagtccataggaagtgtaaacccagcctttgcccctgtaggagtcccagcctggaatccctgcaggctcaggtgggaaacccctcactgtggaccttgtgccaagtcaccccctggtggtccctggtggaccagaaggggccaaggggtgtctccaaggatgcctcttgtgtgtgtttactctgcattctgggaggaggatagcctggggcatagtgttctcatttggtttctaactgctgcctggacaagcagggcaggaatcctttgcctccgctgactcaggctccaagaatagccctgagctcagtggggcccgagccccctccctctactacatttgtcccaggcaagtccagagctgctggcctgacaatcccctccccattttcctgaggcagccaggacctggtacagctcttagctacctagtccctctgttatctcttttggctctggtccccatggtgggtgcgcaggtaggctgctcctcctgcaccccccagtgcttccacagtcaggttctctgggatcccagggggaagttgaaagcgaggggcccaattttcctttgaggaagtcgctgcctggcagtcacaagcagggtgctgggacaaggtcttttagaagatggctgttcagaagtccccccagcatcgtagcttggaagtagcccaaggaacccttgtatcactatcaccctgccccactgcctttccctcaccattggttgccatacgttgccaattcggagacatttgttaagcaccttctacggcccgggactggggcattgcgcagatcattctactttgtgaacggctggagagaagatgctgggcagcgcagaaccctgacaggcccaaccctgggtgctcatggaggtgcaacacccaggcaggggaacaagtgccaagtctgttgtcaagtttgagctcctggaggatggggcttcatttctaagcccagcctggcccttagaggctacaggtgtgctggacacgagagcttgagttgctgggagtggtctggttctaagggaccttgcgtaccaagccagggactctggtctttaccctggagccatgctggggaggtgtgttggaggttactgtgaagagaagtgacttggtcagagttgagattcagcatggggactctcaggccatatttctgtatcagtcttggtgagctgtgctgtggcagaacagaggtcatggccacacgaactggagccagctgtaggggacacaaagaggactacattcccagcagggctgggagacgcggaggcacgagtgggttggaggagggtaatcttccatagtccagtgaggagtttggtggtgtccagggtacagtgggatgtgtggggctgggacctgataaagaggccctggttggaaacagatggggtgaggtagtgactgaggccagggaaggaaatgttcagggaaagcttgggagggagaaggatgtgctctgggggctccaccgccctgatggggttgcaggtaggcactggcctcgggctgtgccctaggctgtgttcctcccaggaggccagagctggggcttcagagggccacactcctgctcgtgagtctcatagaagctccagacgtggagtcattccaaccttactcctaccttctcaacagcctctcccagcaccctttgagagaccctctcacagcagcctgtcctttcttttggaggcacctcaattctgatgaggtttgcctgagcacccaccctcccagctgggcctcctgtctcccctaagactggcccacgtgtgcacatatgtctgtaccgtactgtccatgccactggcctgctcttgcccgccctggctgcacgggaggaggtgacagtcttagggggaaggggctgcctgtgtgataacatacctggttctctgcagccccccacctggagcacaccttgcagggatggggggtcctgggacatggctgaggagaccctgaccttggaataaggtcatagcactatgccccaggatagtttggggggtcagtaataagggatagagccccagccttccttgggcaataggaaagcaggcagcatggatggtcttcactgcctccagctctggccacaccagagtcctcgggctgtggaggagtccagccagtgctgtccccatatctccctgtggatcccaggggaggctgtggggccgggcatattagaaggggcccagcagccttggtgagtatagatgtgctttctgggctgcccagagttattcaggattagcaggaaaaaaagggggagcaggacccagatgggggcctgcccttcttagcagtgcctctctgccttagtgtcacccatctaatggagagatatgcatatacagagccccacctccttcggacagtggccctggcgtggtgtgtgttggaggactgtccacagcctcagaagcgaagctgggggagggtgtgaagtcagcctgggtaaggggacaggagtaaggtagggggcagttatgaagctggaagctacaggtaccatgagggcagtgaggaaaggaggaaggggcccaaggggacctcggcctggtaggggagatgggtggcagggacctacaagaaaagtagatggaaggagaggatgcctgtgggtgaggacatgtaggtagggggacctggcctggggcatggagggctcgattcctgagagatgagctgtcactgtgggtggtcccgccctccacagatgggcggccccctccctgcaggcacagctggattgcatctgcctgtgacatggtaggggatgtgggacactgggatgtatgcataagcatgacacaggttctctcctccttccggcttatcccctacaaagagggggtgagttacttggatccaggccaaggggaccttggtttccctaagaccggcccagagtcactcatttgccagggcttcttgcctgtcaaggagatccgggtggggcccaggaggcccaccagacagatggctgaatcacaggagtggccggcgggacccatggcctgagggcttgtctgggcacccccactggattgggggtgagtcatccccaactgcagccccaccccccacggcgctgctgccttgtggctctgcaggaacctgtccactcctcagcctggtcactgtgattgacctaaagcagccaagacctgtgaccttagatggagttaggggtactccctcagcatctgcccatgcagaaccttctgggaaattcccagaagccacggggggtcggggggtttatagttaagtgcgtcatatcgtttgtctgggggaggggtggggggggcggcgacctctcagggatatgggtgagggcgggtgcctgggttcccgcctgccgctccgccccccgagatcagggacttttctctgctctgcccgagagactgcagcggcggcggcgggagcgggcggacgcgcaggcaagaccaggactcgggctggaggggcgctgggctcggacctgccaaggccacgggggagcaagggacagaggcgggggtcctagctgacggcttttactgcctaggatgacgctgcggcttctggtggccgcgctctgcgccgggatcctggcagaggcgccccgagtgcgagcccagcacagggagagaggtgggcaccgcaagggaggacccggcccggggcactgcaccgtgccaccctccgctccactcggccttcatccccaacaccccccgcccacaacccagccaactccacgacgccccgcggattcctcctaattctgggactccccgaaccctccgcgatcggtgctgggttccctaaaccgcctcctatcctgttcctacccaaattctggctccctggatgcgtgcggggtcccctgccttatgccaatccacgccggcccctagaggctgacctcagtcccaagtccacacccgtgctggcgactctccctcccccgcacacccccaaccctccgcgggagtctgctctgggacccaccgagctcaactccctccaaggccctcaggctcaggccgattcggccctggtttgcataagatgaggcctactctccccaccatcccaagtcccagtgaggccaccgtgcgggtaggcgggtggttggcctcccagaagaggccctgatctctcctgcccgccccagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggtgagtaggggccctgggggctggggaccacgagatccccaccaagactccttccccagagagggaggagaccctggaaaccccaggccaggtctttgcagaaacaagttttggggaacctagagaccccctagccaggacctcctttggagacagaggtaaggattccctaggtagaaccttcgtgccctgaggcacctccaggctactgcaagacaggaaggtgcaagacagtgaggctgtgttttctgatctggagatggggagcccaggagggggcccccacgcctgttggattctccacgttctagccctctaacccttgcagccgttcaccagaggtgctccatctggccagcatccactttcctacatctggacccctcctcctgcaattatttaattaagcagcatcttgttccccacagactgtgagcccctaagggctccttcaggtctgcccaggcccacctgcagatggtgcacaaaggagcccctggggagtttgttaacctgggggttccagaggcaagtgggtgtggagaatgacagaacgaagggacccctcaagagagcctgatacccgtaaccctcaccctagaggcctcctcaaggccagggccagaagagatcctgagtcctagcctgttgccacccctaccctccaacaggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtgatccctacccctaccatgcctcccaagatgaccccaaatgaagtgtccaggggaaccgtgatttgacccctgcacctgtcccaggtctgcatcctgatcacagacgggaagtcccaggacctggtggacacagctgcccaaaggctgaaggggcagggggtcaagctatttgctgtgggtaaggaccgagcaggagtgacaggtcagctggggggtgggggcagtcagagagcatgtgggtgactgagtcctgatgggtcgtcacttcagggatcaagaatgctgaccctgaggagctgaagcgagttgcctcacagcccaccagtgacttcttcttcttcgtcaatgacttcagcatcttgaggacactactgcccctcgtttcccggagagtgtgcacgactgctggtggcgtgcctgtgacccgacctcgtgagttcctgcccacacggtgtaccctgacctagaccccggaccccaatccccacttggcagtgctgattccatcctatgtgctcctgaccccgacccc

SEQ ID NO: 18004 - DNA, 51138 bp, Homo sapiens
  misc_feature (1)...(51138): n = A,T,C or G, or insertion/deletion polymorphism (see Tables 1-2)
gctgcccagagccactgcagccccacccgccaccctggctcgcgcattgtcctatcgctggatgtccccatcggcctcttgcagatcttactggagcaagcccgggccagggctgccagggagcaggccaccaccaacgcccgcatcctggcccgtgtcggccactgctgagcctgagagagggggtcacagtgatagggccaccctggatgggaagacctggagggcagccacacagctggacggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtgtgccccacagacctaatatatgtccggacagcttggatgctgccacgtaaggtcactgctgtggcgagtcttgctatgtctgggtgccccatagtcacagaacacctggacaccgccacatgcagtcatcatcatgttactttcaggagcctcaacacgagagctcaacactgcctccgaccagtccctctgaggcccacaggtctgtcatcccataggccaccacacagagaaatgctggctgagggtcacttgcttgctctgtgccccatgaggcagcacctgccccagatggacggggctgtgaggggtgtctccaggcacaaaggcccgaacacaggaagcctgtgaccatggcagccttgtcttatgggcgcatatgtgcgtgtgtggctgagtctctgacagctgtgagtgtgtgtgagcagggtaagggtacgtgaggggtctgagaggagtgggtgcttgtcccccaaacctgcatgaagcaagaacaactcctggccaggccctgtcctccccacgtacccctgcatccccagcctcgacccagggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatatagcagacatggaggtcctgcagcaggaggtgctcaataaacacaaagcgactgaaggatgggatgtgcgagaatcccagtggtgtgcacccaggccgcgacacatggtgggtgagtcatacctggcttctctgccttcctccctagctccccggttaactgacctggtcccttggtttggaaggactaggttttgcctgatttcacagcccaactccattgctgggccagagacagaactgactttccaggcagtgtggacgggcttgcccgcagagggggcaggcactctgggctgtgcagacaactctaggtggacatgaaggcagacgctgggtggcatgggcagctctggcgggagagggagactgtactggccacagcgtggccggctgactggagtgggggcactggcgctgccctcacagttgtaagcagccctgtgggggcgggcctacagtgggctggggaggcggggctgcaggagccgcaggagtcgcttctctctcttcagagtgctaggcggggttaccccactctggagctgcagggggcagtggccctggccagtttggttgcaggatggacagaggctcgttaggaggcagctccctgaccgacctggggccggggagcagcaggcggggtaggcacgggacagcgtggggagggtggagggttagggaaagacctggatgaagtcagggtggtgctggaggggtgcgagagtgttggggggtctctcctggtttaggggtgctctgagggccattcatctgtcagtggcccgaaggagggggaaaactgtcgccctgcaagggagagggggctgggccaagggggaactataaatagtgtcttcctccagcccagggggagggaccgccagctggcgctgcccaggccctcctgctctgctctttgctggcctccaagggatcatgtttgtccaggtttcctcttggggtcacaccagtttggggaagtctagaggctcatttaggatgggtttcacatgatgtggctttagcccttaaaccagcacttctagggtgtctgctgtgtgccctgtgccagtcctgagcttctctgaacacctgctgtgtactcagtttggtcatgaacctctctgaaccctttctgtgtgcccttgctggtcctgaatccctaagcacctactgtacgccctgtggcaggctggaaggaggaagtgcagatcagggttcccaggctgcttggtgacatggttctataacctgaagtcagaacttcacactccttgtgagccctgggcccagggagacacaggggacaatcctttgctggaaatggccagaggaagctggaattcctggaaactcctgaacctcccagtggacagcagggctgggggtggagagatatatgtgggaagggaggcagcagagagcagcaggccccactgcagcctgcctgtctctgcacatgctggggtgcaggacttgtgagtgtgtgtgcgtctgtgtgtgcatgtgcagctgtgccagtgtctctgtgtgcatcagtgtgtgggcctgtgtggcatgcactgaaacccctgggtctttatgctgcaaagggtggtttgtgggccagatgtggtggctaatggctataaacccagggctttgggaggttgaggcgggaggatcgcttgaggccaggagttcaaggctgcagtgagccatgattgcactatgtgctccaggctgggtaacaggagcgagactgtgtgtgtgtgtgtgtgtgtgtgtggtgggatggtttggcagttctgtcaggactggccagtagatacagggactgggaagagtttgagctttgagaactggccaccacatggcttctaggctgggacactgggaggaagtccagtggtcagtgcagagggcaccctgggagccaaccagggtcaggccagccaggttcatggtgggcagaggctgagcagaacatgttcacacgtgtgtacagacatcccagcatacttcccacgcctgggacagaacagctggctcactttcggatatactgaggaggaaaaagccatgagggccagagattctaccgggcatccgctgatgctgagagagcagacgctgggacagcatctccatggagaggacacaggggagtgggagcacacatgtgaaggtggactgtgcgattccactgtagtgtggcaggcaaggtctggaaggctgggagttgagctgagtccatgctgcactgtggactcgctttgtgatcttggacccttctccctcttcctgaccctcagtttcccacctgacaaacagggccatgggaggggagatggagaatatcctcagagcagatgtggacggtggccttggggaggaaccccaggcatctcctgatgttgacctgtggccttccagctggacatagggccttgaaggagggtgcctgggtcagccacgggtagactttctggggaagagaggaaggtgcagagctgttgcatttcctgggaaccaggctcatcctgtctgggtgtgaggatgccttcccagagatagccctggccccctgcccaggccagctgtcctctacccccagcccttgattagcatcccaggaggtctgggaagagaatggacaggccagaggaggtgctgggtgtctgtagatatcagaggagatagcttttgcaatgagtgctgcgggttagacagggtgtgggcatgtggtaatgaggtctcagaggccacggtggccccaagatggccttggcagtggccagaagacaagagggctggctgtgtcacgaacagaatgagtggctttggagaagtagggagcaggtcacgaggggcacccagctcatcaggagccgcccatggatgtgctcagatctgctgggactggggtggaggaataagcgggtagatactgcaaaaggaggatgaggaaggaggaagttgttgactctgcctggggcagggtgttcccagggcaagcagctagagctggtttgggggagggtccagatgggcttccagcatgtggacctttggaatcttcagttcctatgaagtgggcaagacatctgtgtcagtcatcttaagggtccttgccaagctttaaagagctgggtggacttggactgatccaaggcagggctgtggcagggagggcatgggagggggtgctacacctatagcccacgaggccagtcttgttgccagtcccatgccctcaacacctggctcctggctgggtacacactgggcagagagaacctgaggatgcagggcacctgccaggggtgttgtggatgacatcgctagagggcagtgtggctcaggttgaagccgtgttggtgggggctggggcagagagtgtacaaagcttggagaggcggggctggggatcccgaggaggcgggaaactgcaggagtccggtgggggccaaacaagaaagtgagccaggggtttaggaacttctggatctctcccttgttccttgtccccagtgcattttcaaagacaagagggagatacaaatatagtaaaaggcaaccataacgtattttaaaatgaatttcttagagattgacatacttaatttatactgtaatactgtaagatagacaatgtgcacatcccattttcctgaagagaaaatgttattaacatattagtttcaaaaaatatgtaaaactttagttaaaaaaaccaaaatactaaaaatcaaaaaaaaattgtaaaaaatgaaattctggaaagacgattaagatactcccagggcttagtgagtacccaaagtacttggttactaagtgccacgcacggccgggcgcggtggctcacgcctgtaatcccagcactttggaaggctgaggagggcgtatcacctgaggtcaggagttcgagaccagcccggccaacgtggtgaaatcccgcctctactaaaaatacaaaaattagcagggcgtggtggtgggcgcctgtaatcccagctacttgggaacccgaggcaggagcatcccttgaacccgggaggcggaggttgcagtgagccaagatagcgccattgcactccagcctgggcaacaggagcgaaactccgtctcaaaaaaaaaaagtcccacgcatttgctcccagcagccaaagcaaagaaagaggaacaatattgaaatgtgttttgagtctctatccatgaggtaaaagagcttttccagcgtggttgagcatgctcctatggacggcggaagagtcccggggctcggagcagtcaagggggaccccgaggaggggcaggagggcgcagcggagttgacggctgggactgcaggcctactggcccctgtcggctctgaccaacctggccgtgcgggtcacgtaggcctcgtcccactgcatgaaaacccctccctcctgggggccctgggctccctagcaaggaggtagcagaattcacgcgtgccgctgctcagggatgcagcgccagggcggagcccgtaggtggggcctatgcaaatcagcgcgggcaggttgggagagctgagtttgcgcatccggggcgggcctgcacaatccgggccttgaactggggcgggaccagtacaatccggagttgagcatgcgcattctcgatcctggcctgaagaactgggcccacttgttccaaaacgggcgggtaggtgagttgggcatgcgtggtcggaggccgggcccctttcagctggggcggagcctactcactctggggcgggacctgcgggaagatagacatgggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtggtgaggcggggtcctctgggaggaggtgggaggtgcaccgggatgggtgggtagggcggcctgggcgggggtctcgcatggagaaggggcgggagacagatggggaaccggggacaggtgaggttgccgtgactggggaggctgctggggacaggtgaggcggtcgtgacagtggtgggccagagacrggtgtggcagagcagggggcggggacaggtgtgtgggggcatatcggcttggcggtggctaggtctggccaccatcacctcggggagggctctggccccctcgcttccctctccaatccccatcgcccccagtctggggaggaccctgtgggcaccccaggcccttccctctctcctggccaaggagtgtgggccgggttgttggactggaactgagctgtgtggccctaggtgaattacttggcctctctgagcccagaactttcaaaggtgggctagttttccaacaggaggaagggtgcctcttggccttaaagctgagcttgggcaggaacttcagcagagatgtgctcaggatagagacagaaaagtatgccgtgtgggcctgtgtctgtgtcccgggacatgtaagtatccacctggggtcatgggtgtacagtaaaactggagagtgaaacagctaggagaatgctgaaattcatggaattgttaaggggctcacctctcctagggtcccaggtgtttaaaccgcttccttgagtttctgcctgtccttaaatgagctggcagttttttttttttttaagagatgagtctcgctcagtggcccaagctggagcaagtgcagtggcgcgatcatagttcactgcagccacgaccttctgggctcaagcaatcctcccacctcaacctcccgattagctgggattataggtgcgccaccacacccagcttttttttttcttttttctttttttttgtagagacagggtcttgctatgttgtctgggctggtctccaactcatggcttcaagtggatcctctggcctcggccttccgaagtgttgagattacaggcgtgggtcctggcctgcaacttttttattaccaggaaaagaaagatttgttttaggagtaactgaaacattgtaatgaatttgcagcttgtccagcacctcagagaacatctagtttaacagacagtgaaatggagatcaggagattgagtgacatgcctgggtctccctgtgatcctgcctctgcttatgtatgataagcaaggggagagttctttgtgctcatcctgctgcagcagcctggagccatggctttgatcatgatatgagtcctgggggaagggtgtgtgtatttctggccacactgtgagtcctggcaggggaaggccatgtttctgaccagaccaagtcgtggtaactcatggctttgattgtgatgtaggtcctggtggggctgtgctgtctataatgcacactcagtcctgagggctatggccacccctcctttgagactcttctggaggcggggaggctgagccagtctgtgttattagggctgtgtggtcctgacttaggggggtggctgctattactacataggggaaaggagtgaggacctggacttttttttttttttttttttgagacggagtttcactcttgttgcccaggttgtagtgcagtggtcctatctcagctcactgcaacctctacctcctgggttcaagcaattctcctgcctcagccttccaagttgctgggattacaggtatgcgccaccatggccggctaattttgtatttttagtaggatggagtttcaccatgttggccaggctcgtcttgaattcgttatctctaatgatctgccccccttggcctcccaaagtgttgggattacaggcatgagctgccatgcctagccaagtctgtgagcctttaaggagtaggtcctcaataagcggaggcagggtattctgtcatcactaccattctttctttgcttctcactacgtctgagtcagggattgatgcatcagctccaagccaacccccgttacaggtgagaggaagctgaggcccaatgggaaggtctcatagctcctgaggcagggmttgtgtttctccaggctctaagtgtggaactgaaatgtggctctggcctgagctgaggggctcgtgccatcacggtgtctcagggtgttggggtaggctgggttctaggtccgcactttttcctggaggaggaggtagcacctgagaggccaaagatgagacctgcaggttgtttggggatttgggcctcagggttcacagcagggagtgggtaagcagtgaatgaacatggaacccgcccatgcagcacctccagctcccagtgcctgcatttgggcaacactttaccctttgcatagtagacttgtaggttgagtgactgcaaggacagtctggacccggagggtgtgggtggggatggaagcggatttggtcccagggctttgtggggaggaagaagcaggacccactgctggtctgtgctttgtactgggttttctctggagtctagtccccagctcctcagggcactaggggctggtggactgagggatgtactgcacctcctccactcccacaggcacgcccccrcttgataaaatttaaagccacacctgagggcttgggaggcttttacctttcccatcattggcctccgagctcagacctggaggaactctgagggcaggtggggcaagagctgactcaggaaggactgcagaaaggacggtgtttgatggcttttctcagctgaaaggtggcaagactcttcctgggtaaggacatgactggtgtgtgcacagggcaacaggagagatgactttcagtcccctctgaaaagggcctccatggcacgttactttattttaaagagctcttccttccctagcctggcctaaggaggtgagagcagttgcagttcaggagtcaattctggcaccccctccagggacttgtggctgctccttgggtagaagtaatggaacatagacactgcccattgccaggcacgtctcaggccccttgggccccttcgctcctagagctcatggggcctgcagcgaatttacaggaaaggaacccatgagggaagttgggctgacatgtcttcacatttccttccgcacatgctcaatgttataaacagtgtgttcttttttttttttggagacagtcttgctttgtcccccaggctggagtgcagtggcacaatcttggctcactgcaacctctgcctcctgtgttaaagcaattctcctgtctcagcttcccgagtagctgggattacaggtgtgcaccaccacacccggctaatttttgtatttttagtagagacagggtttcaccatgttggccaagctggtctcgaactcctgacctcaggtgatctgcctgcctcggcctcccaaagtgctgggattacaggcatgtgccatcacgcccagctataaacagtgtattctaccatcctgtttgctcagtgtcagggtcctgtgggctcagagccacaggtgcagccgtgcacccagcccgcttagtccacgtgctctgtttygagagctgcaatgtgttccctccttgttgtgcctcagttggcaatttcttatggctggaatttcccagtgttttgctatggtaagcagagctgttgtgatacacttgaactttggttttcttttgggtcatttccttgggagcttatcttggggagcagaggagataggtaatttattgccttgttttgcacccaggcctgatttgctgccctgcctgcccaccttgtgctgcgcatgtgggtggaaggcgggaagggaaawgccaccaaatgccatgggaggaggctggagctgtctctgggaaaataggagatgtggagagggggtgcagatccccagtcctgaggttttgggagtccctgaaggagcagttggggggtggccccatcagcgggagcagggtagatgcaggatttcctcctgcttagcagctgtcgcactgcccttggttgcttgagagcccggccacctggccgggaactatgcaaacaatgcacaatgcgggcctcagctgtccaccggccctgaggaggcaaggccttgcctaacttgttttcctctcaccttagctaatactgagagttctctgcaagtttctccactctcactcagtcagcctgtttcatggggtctcctccttcccgcccctgaggctcaccatttgggtcacctttaaacaaggggaatgcacaggagtgatggagcccccactggcaagcaaggccctttgtttctctgcagggcctgcctggggccaggccaccgcctccatgccctgagtcccaagggcagtcggtgccgaggtacacctatggctttagctcagtatccgccagggtaggacagagggcacagcttcccagaagtgcccaggctcttggatagcactaggcttctctgagggatgactgccccattttacagctggggacaccgaggctcagagttcccaatgagtgtcagactcaagatggcaacccaggcctgactcctgatcccctgcggaagtgcttctggggcctctgtgctctgagggaaacaacttgttggtggggacagtctgtctaggcaaccaggtgaaggcacttgcagaaccaagaagaggggcagtgacaggtccccacatctgttcatctgcctgtctgctatggttttacctgacccaggtcctaaggatgaggaaaaggaagcttcctgaggcttctgacgtgagaccgcgtttgatggcactggaaactgagctgagggctgggctcacgcctgtaatcccagcactttgggaggacgaggcaggcagatcacctgaggtcaggaattcgagaccagcctgactaacataatgaaatcctgtctctactgaaaatacaaaaattagccaggtgtggtggcatgtgcttgtaatcccagctacttgagaggctgaggcacgagaattgcttgagcccgggaggcagaggttgcagtgagctgggtaccagtgtcctccagcactccagcctgggcaagggcgacagagcgagactccctctcaaaaaaaaaaaaaaaaaaaaaaaaaaaaaaagaaggctggaggtgatggctcacacctgtaatcccagcactttgggaggcccaggcagtcggatcacctgaggtcaggagttttgagaccagcctgaccaacatgccgaaaccccgtctctactgaaaatacaaaaattagccaggtgtggtggcaggtgtctgtaatcctagatacttgggaggctgaggcaggagaatcgcttgaacctgggaggcagaggttgcagtgagccaagatcgcaccactgccctccagcctgggcaacagagtgagactccgtctcaaaaaaaaaaaaaaaaaaagaaaagtgagctaggtcccataagatgaagctggcagttctgctgccttggtatctgttctagccagctgggaatatagggggctgtattcagatccttccgtgcctctagcctggcatcttctctggctggcacactgacctgtggcacatggatggtggtgggtgggctatcagagggactgtccttgtgggcatcagtctgggtctctggtctcaaccccttgtggtccttaccctgagagacttctagatgcctccctccctgatcctgcccacagttcctgagcaccagcgctgtgccaggccccagggccctaaagggctcagataccacagggcttcttctgctgtaagtgatcagtctagagagaagagtgtcattagtgaggtgaccaggattgagggtgaggggtkttcccggtggccatggagatgccttggggaaaggactcattgaggaagtgactttttagctgggctttgtatgatgaaaagaagttcaccacagggagggcatgcagtggggctatgtgttctgggagcactgagtgatggatggggtgggagagatgtaaaaaggttagggtatggattcctggatgacagaggcagggtgttgattaccctgctgggttttggtcctgtccttcatgcggtggggacccccctagccatgtttagccagtggcaagttcggttgactttatgcctggtggtgcacatcaggatgaaaagggctggagagatcccactgtgtctgccagagcccaggcgggcctggggaagggggacatgccaacggtggcttgaaaccagcatctggggccactccaggagctgtgtggggatgctaggaagccaagaagatacgtctgatgccagtcccatgccctgaggctgagagaccacaggctgagagggaggggtgcgctgggagggtcccagccctcatctgacactgtgctgcttgccttttagtgtgcatgaccaactgcccaactctcattgtcatggtgggcctgcccgccaggggcaagacctacatctccaagaagctgactcgatacctgaactggattggtgtgcccactcggggtgaggcttggccccagctgtctaaggrgagctttgtggggcatgacgaagagaatagagaaggcctattctctattatttggcctgggrttgggtcaaggtcagggttggtaggggttgctgttgctgtgaaagctgagcckctccttccctccagagttcaatgttggccagtatcgccgggacgtggtcaagacctacaaatcttttgaattttttctccccgacaatgaagagggcctgaaaatcaggaagtaagtatatgtgttgggtgtggggggagaggttgctgggggacccagtgtggagaaagctaacacattactgaccatttactgagaagcccctggagtggagctgctggtgaatgactgagctactcctgagccctggccttgcccagccctgatggctgtgtgacagggctgtgtgacaaggctggtctctggatctctcaggatgtggtgggggtgggaggtgatgggtttggggatgagaggagagggtgtgttgtgtggcctcctggtggctgggccattcctgccctggggttaaggaacccttgggaaggacagagcttcagggaggtaagaggggctcagcccatgcaggtcgttggagctgctgcctggaggtcacgctcgctcaccccagcgccccgtggggatggctgctgctggggaagggaacctgagtgagtgcaggcatacaggccttagggatggagctgggggtggggggcttcctcccttgccccaggataagctctctcctgtgtatttggagcatgttcttggtgtgtgattgctggtgcgattggctttgcattgacatctcctagatgctgctgggtragtcgttcacacttctgctgttactctggagatagaaatatgtatatgctaccgccccaccctcaacaactttcagacttgaactgagtcctttcttcaaggaactgagcaccagctggtggtctgagcagccatgctgtgcttttctcaggaggtgttagctgtggtcttgagaagccccttatcaacctagggtggcagagacttgctcttggcccagccatcaggatagggcagtgagcagaggttgacccagctctagtgacttccccaaatcaagcccagtggctaccaggctgccactggggtccacactaggctacccgttccttctctggccaccagggggcaggaactccctgctgtggggcttggaccttcagactggagactgcctttgttcttgcatcggtgtggctgggccaggctgtggcaccaagaagggaaggggagcctgatattcaggtttctatggccaaattgtgggtaaaaatcaaggctggaccctctggttatattgagccagataaaaagtagaggactaatgtctgaacctaccgtgtgctgggttcttgatgcccattgtcaccccctacttttacagatgaggaaactgaggctcagacaggccaggagtctcgcacaaaatagcaagtttacatcagcgcccagacttgaatctaagcccatccaccgctaaaaagtgtccatcattccaatattcctcaataggtaggtcaaggaacatcaaatgcaaattttatttatttattttaaaaattattattatttgtgtgtgtgtgtgatggagtctcactctgtcgcccaggctggaatgtagtagtgcaatctcagctgactgcaacctccgcctcccaggttcaagcaattcttctgcctcagccaacaaccccaagctgtggacgctgatagcctactgtctgatcttcccagcagcttctgtggtgggcggtgcctcacttttccagatgctgggaccaaggccagaaagtgatgggggtgccttgggtcactcagggtttgaatttgaagtccgtcctgcctgaatccatagtgtttgtggggagagtctgccagctgttccactctggctgtccccctaaggtagggatatttgggattaattcaaatgaagagacctagactcagagaggttgggaagctagtccaaggtcaccctgcaacagaagctggggacaggctcattgctgcctttctgcaggcataccctctggctgccctagaaaccctctctgctgtatccgaatcctggctctggctgggccacagggccatctcctattaatcagcccaaaatttcccaattagcaaaataaaaggaccagagtttttaaaatggaaaacctgggaagagacagctgcatttcccagaggcccagttactcacacagtgttgaggtccatctctgacactggacacagcagaagatctagaaaagtgcgtgcaaggccgggtgcagtgattcacgcctgtaatcccagcactttgggaggccgaggtgggtggatcacttgaggccaggagtttgagaccagcctggccaacatggcaaaaccccatctctactaaaattacaaaaattagccacatgtggtggggcgcctgtcatcccagctacatcaggaggctgaggcatgagaattgcttgaatctgggaggtggaggttgcaatgagccaagattgcgtctctgtgctccagcctgggtgacagagtaagactctgtctcaaaaacaaagtgtatgcaagggcataagtacacatattctaaacaggcacactcatactcctgcacacagtcctataccacacacaagccccctatgcacacacacacgtgggcacatgcatgcatgtgcatacctcataggcacacatccggacatgcgtataccatatgcacagggtacatacacatgcacaccccctgtgtacacagtcacgttatacataagggtatatgtacatgtgtgggcacctacacatataaatacttgggctcacttaagccacacgtaattcaagggccattacacacacgaaggcgcacatgttctcaccctgtatatacacacacacctgagcacgctcatacatggtgtgtagggggtccccaagactgccctcaggttcagtgatttgctagggtgactcccaggacttggcatatagctggactcatggctaagacttagtacggcaaaatgacacaaagcaaaatcagaaaaaggggcctggggtgaagtccagaggaaaccaggagcgagcatcaagattttctcctcatggagtcacacaggacgcacttaattcctcctgcattgaacattgacaacatgtgtaaaatgttgtctgccagggaaattcatcagagactcaacgaccaaggtttttactgggggctggtcatataggcaccctgtgcctagcatgtaccaaaattccagactcccagaaggaaagcagataatcaacataaaccatgttgtttgtataaacagtctatgcacagtgagctcctcttataattcagggaaagtttcatatcactagagggaactgtttaccatcaagttccccaaccccggccaagggccaacctcacaagcaggcctttcgaaggggaccattctcatacctgctgtgttaactcttccacacacatgcagtcacccactacacatgaaggtgggtgcacacacatatgcatacctcagagtcatgtgtgtgggcacatatacgcttgtgttcacctgtatgcacatgtggatctgtgcacatgtacacaccaagcatgatcgcatatgttctcacacagtcacatggcacatgaagacgtatacacacacaccatgtgtacacacatggtcacccccacatgcatactctgtatatgcttggacacacacacacaaacttatacacatgggtgcatgcacacacatcctgtgtgcacacatgtgggcacactcactcatacctgtgcccatttagtcacatacygcacacaggggttgtgcacgctcgtgtgtgtgcacctgtgctcatacatgggcccagggaatactcacacaggtacactcacagatttacatgtacacacttgggcacaacacacacataaccacccacacgtgtgkattcatgcacatatgcatctcttcaccccatttgcactctcttatacacacacacacacacgcacacacacaggctcccaggctcttccctcagcatctccaccggggccctgaggtctctcctgcatggtggtgtcatggccagagcagcccacaaaagagatcttagcccagaacgtggggctctaaggagaaatgtccctaccaatgccagttacctggactctcagaattcagatgtttttggcatgaggaagaaagcactttgaggctttaactggaagacccattggggcacagaaatggttacaagggctggacatagtagctcacatgtgtaatcccaatattttgggaggctgtggcgggaggatcactggaagctaggagttaaagaccagcctggggaacatagtgagaccctgtctcttaaaaaaaaaaaacaaaagaaagaaaagaaatgtcacaaggagccgtaagagtagagctcttttcagtgccctggactcagctctaccactgatttctttgtggttctcagatcagcttctgccgctgtatttcaggcatatcgtcctgatgagagccctttgactttgacatgctgggagtttaaacacaaaatccaaagatcaacaaagccaggagggctgggcactgtggctcaagcttgcaatcccagcacttgggaggctgaggagggtggatcacctgaggtcaggagttcaagacccacatggccaacatggtgaaatcccatctctactaaaaatacaaaaaattagctgggtgtggtggcacatgcctgtaatcccagctactcgagaggctgaggcaggataattgcttgaacccagaaggtggaggttgtagtgagctgagatcatgccactgcactccagcctgggcaacaaagtgagactctgtctcaaaaaacaaaaaacacaaagctaggagatctagctttacccttacatagaaaaagggaagataatagataaaaaggtaatttatctatctccagacctcataggataaattgatgagaataatcctggctgggtgcagtggctcgcgcctgtaatcccagcactttgggaggccaaagtgggcagatcacttgaagtcaggagttcgagaccagcctggctaacatggcgaaaccccatctctactgaaaatacaaaaattagccagatgtggtggcacgtgcccataatccctggtacttgggtggctgaggcacaagaattgcttgaacctgggaggcagaggttacagtgagctgagattgcaccactgcactccagcctgggcaacagagagtaagactcttgtctaaaaaaaaaacaaaccttctgtgtcaatccactttgcagcaataaatgaaaaagctgagaacttaaaaagattgtgtaagcctgggcaacatagcaagaccccatctctaaaagaaatttaaagattagccaggtgtggtggcatatccctgtagtttcagctactctggaggctgaggcaggaagattgcttgagcccaggagtttgggctgcagtgaggcatgatcccactgctgcactccagcctaggtggcagagcgagaccttatctcaaaaaaaaaaaaaaaaaaaaaaagatctgaaaactgtatagtcagtgttcggtcataggtgggggattcccattctggagggtatggatatgatagaagaagagatgcagaaccctccctcagaaggggtggtttggggaactctctttcaggaaagaaagttgagcactaagcctaacactgcccgagggccagccctagtgttcctcccatccccaccaccaactcctgacatgcacacaagaaaacggctgcttttaaaaatgcttattttgaaatataaaaattagctgggcgtggtggtgcacgcctgtaatcccagctactcagtaggctgaggcacgaaaattgcttgaaactgggtagaagttgcagtgagccgagatcgcaccactgcactccagcctgggtgacagagcgagactcagtctcaaaaaaaataaataaataaataaaaggcgggcgggggggggcttattttgataatcagggaaaatatatgacaattagaaatcatgaatgtggcacaatgacagcatggatttgtgcacaatgagaggatgagggaaaatacagaaacgtagtgcttaaaaaatgttcctaatagccaagagtgtatagccttccacctcacaggagcagagttagccaaacactgaacattatcctaaggaaagagaagggaaactttgaaaagagagcaagagacctcggggctgttccttctcctgtcatgtctcctcctgttgtgtgtccctggccaccctcctggagccagggtcgggtgctgggctgaccctgtgttttctctcctgaaggcagtgtgccctggcagccctccgtgacgtccggcggttccttagtgaggaggggggacatgtggcggtgagtgtgacaccctggtgacagctgggagtgacacatgggagcccatccacatctgtgcctttgctcgtcaggcatctggaggggaaggcagggtgtgtgtgccccagctgctctgggtgccagcccttgggaggaagtctgcaacagctatgcaggaggaagccagagactggatatgggccaggagtttccctctgggcatgtggtggccgcatttgaccctgcaggacttccctctggatgcttgtattcttggccaccccagaagttacaggtatcaggttgcctaagtctttagtaaatgtgatttctcctggtgtggggagaatcctgcccagcattactggttgttgtaggaacccactgaatcctggattaaggggattccacctgtgtgttggcccttctagtcagacggaagagcagaacagggctaaactggggtgtctgtgggaaacggctctaccccarccttatatagtcaaacacaggggctgttctttcccttccttcttcttcctggagtcatgccttctggagttctctgtccccagctacaatctgtgcctgtagcacagccattgcccttctctctcctgggttgaatgttctgcctgtggatcccacatcatcctctctttgacttactgatttgtttcattgaagcacatcctccagtaacttcctgagaaaggtgcttggggaggtaaattgtgtgagaccttgcacatctgaaatgtctttttttaatcctcacatttgatggttgggtatagaatttctaggtggaaagtgcttttcccttagaacttctacaacatcactctgatgtcttayggcttctagtgtggctgtggagaagtctcatgtcattctgatttgctgatcttcctaaaagcttcatctcttagagggagctgagagtttctcatgccccttccgcttgggaggcctttarggtcttcaaggtgatgtggtttgtggtgggtcttctctccaccatacatggtcctagggggccccttttcatcataacactcttgttctccaggtcagggaaattgtcatgtattatttctttgacaaatcacctctgcccctttctggcaactcactccatccctactcccattttctgagctgctttttctagaacttctggtggctacatgctagcttgattctgagattctgattttatcttttttctcttaattttctttctttctttttttttttttttgagacggagtctcgctctgtcacccaggctggagtgcagtggcgtgatctcggctcactacaagctcctcctcctgggttcacgccactctcctgcctcagcgtcctgagtagctgggactacaagcccccgccactgtgcccggctaattttttgtatttttagtagagatggggtttcaccatggtctcgatctcctgacctcgtgatccgcctgcctctgcctcccacagtgctgggattacaggcgtgagccaccacgcccagcctttctctttattttctctgttttttttggttgtttgttttgagaaagacttcttcaacattatcttacaagtatatgagtgttgttgttttttatttccttgagacatggtcctgctctgttgcccaggctggagtgtagtgtctcaatcatagctcactgcagcctgtctcctaggcttaagtgatcctcacacctcagcctcctgagtagctgggactacaggcacgtgccaccatgcttggctaattcttgtatttttcacagagacagggtttcaccttgttgagcaggcttgtctcaagctcctggcctcaagcaatttgcctgccccagcctccgaaagtgttaggattacaggcataagccactgcacccggcccaaatttctttttttgtttgtttgtttgatttagtttctgtttttcttgttaaaggttttgctggagtgtccagtgagccctggctggatgccctttttaaaaaagtgatgctgggctgacatggtggctcatgcctgtaatcccagcactttgggagtctgaggcaggaggactgcttgagcccaagagtttgagaccagcttacatagcgagactctgtgtctacagaaaaatttttaaattagccaggtgtgggccaggtgcggtggctcacacctgtaatcccagcactttgggaggctgaggcgggtggatcacgaggtcaggagatcaagaccatcctggctaatatagtgaaactccatctctactaaaaaaatacaaaaaattagctgggcgttgtggcaggcgcttgtagtcccagctactcgggaggctgaggcaggggaatggcctgaacccaggaggcagatgggagactgaggcaggagaatggcgtgaacctgggagacagagcttgcagcgagctgagatcgcgccactgcactccagcctgggtgacagagcaagactccgtctcaaaaaaaaaaaaaaaattagccagatgtggttgggcacagtggctcacccctgtaatcccagcactttgggaggccaaggctggcagatcatgaggtcaggagttcgagaccagcctgcccaacatggtgaaacctcgtctctactaaaaatacaaaaattagccaggcgtggtggcacaagtagctgtaatcccagctactcaggaggctgaggcaggagaatcgcttgaacccagtaggcggaggttgcagtgagccgagatcacgccactgcactgcagcctgggcgacagagcaagactctgtctcaaaaaaaaaaaaaaattagccaggtatggtggtacatgcctgtaatcccagctacttgggaggctgaggcgaaagaataacttaagcccaggaggttgaggctgcagtgagctatgattgctccactacgctccagcctgggcgacagagtgagaccctgtctcaaaaaaattttttttaaataaaaacaaaaaaatgatgctgtaaccgaggtgtggtgcacacttgtagtcccagctactcaggaggctactcagaggatgcttgtgcaggccccaggtacttctcaaagagctccagatgggtcagtgcctggctggatggggttgggaagggggcctgggcctccagctcttctttatcagccagctagtcctcccatttcgtccccacctttgtcccttttcttagcaatgccactgcaccctctggagtgctctggtcctgcacaggtggtgtgctctggttggccagcacctgtgtttggtttcctacatgactctgagtccgtcaccgtggatctctctgacagaattgtgttgatgtctccatctcctgttgtctcctttttctcctgtcatctctttttctctttatccttctgttcccattttactggggtgtcaggatggagtagaaataaacataggttcagtttactaggtttaactggtttcactgcaattcctgttggtcaaacacaaactgagtgcccactgtgtgcagagcagcactgagtaggttcttctgtgccacgggtctgctcccctgctgggagcacaggcatcctctccttctaacttccttggggcattctctccaaggaaggggagggccagcccagccgttgcaagtctggaggagactggccaggcaggtggacctggcagcagctggtccttatgagaaatccagtccccagagagcctgtgctgcggccctcactgcccacttcagggcccactctggccccttccttccccagggccagaggctgagttaaccctagtttggtcctaggtttttgatgccacaaacaccacccgagaacggagagcgaccatctttaattttggagaacagaatggctacaaggtgaggcctccttggctcctctccttggyggaactgtggcatgtcccctgccctccagggctcctttcaccgcctgcttatgcatgaggggcatggggctggcatggctcctgagtgtaatttgggatgagaggggctgtctccacttggggtttgctttccagagggaagggggttttcgtgggagagtctaggagagggcagcacctgctttagctctggactccttgacyccgcctccagccctctgaagcagggtttcagggcctggctgcttgtcagcatgggcctcaggggatggagagctccgaggagcaaggcgggaggccctgaacrtgtccgtgttcctccctcccaccaccccggcgcttctggtcctgccgcagaccttttttgtcgagtccatctgtgtggatcctgaggtcatagctgccaacatcgtggtgagtagtgcatctgaccttgtcagaaggtcgtgtgtgacagggacatcccttttcaggttttggctaaccttaatttgatcttgaaccttgtgggggtagggaggaagtgtaacttcaaatgctgggtcaggtatgcctcgccctctgtggatcactgtggaaggctgggtggctggtggacattcactcaccccacctccccctcgtaaccacctggacactaggagagcaccttcagcaggggtggaagggtgggtgaggggcatgttttatatttcagagaaagaaagactcattctttccttcccctcccccagtttatctgaggaatgggcatctgggtctgggaaaatgagagttcagggtggggaacggcctccaggcctccccctgtaccacaaggatgagggacttcaatccctggaccctcagtgataccctcttggcactggtgtgagaactcagaccagggagctgctggaccagcccccacctcagcttccagcctcaggttcccgcactggtctccggtgcaacctcctccagccccctgcccagcagtctccttggtctctggccccgcctggctcctgaccctgatatgtcctttctctgtgcctggctccggcagcaagtgaaactgggcagccctgactatgtcaaccgcgacagtgatgaggctacggaggacttcatgaggcgcattgagtgctatgagaactcctacgagtcgctagatgaggacctggataggtgagtcagggcagcgccaggccctgcagctgtgatggtgggcggcaggggtcatacttggctgcctcctatggctccccatggtggtggctggaggaccaaaaagcagagatggtctgacctttcttgtttatttccttggggcagaaatgtttggtcagaggtgacttgcagaacaccggttacctcatccaaaactctgcgagtcaggattttatactattccatcatgaaatcaagccgaatttctatgcaaggggtcttaaagcaggggttggcaaatattttctgtcaaagatcagagagtaaatattttatttagaccttggaggatgtacagtctctgttgcaggcactcactctgctgtcacagtacaaatgaaacatagatgatatgtaaatcaatgggcatagctgtgttccagtaaaacttgataaaaacagcccacggctgagttcgactggctggccacagtttaccaaatcctgtcttacagaacacatggggcagtggctgggtaaataataatgtagcccttggtgaagtattacagtcatcattacaactcgtcattgtggagagacatgggaaaatataatattgcattcagtgaaaaggctggaatacaaacttgtgcttaggttctgtaattctataagattgtgtaatacgggccgggcagagtggcttatgcctgtaatcctagcactttgggaggctgaggcgggaggattgcatgagcctaggattttgagaccagcctgggcaacatggtgaaaccccgtctctacaaaaaatacaaaaattagcctggtgtggtggcgcatggctgtagtcccagctactcgggaggctgaggtgggagaatcacctaagcccagggaggtcaaggctgtagtgagttgcagttgcaccactgcattccagcctgggtgacagagtgagaccctgtctcaaaaaaaaaaaaaaaaaaaaaaaaaggatgcacatgaaccaagaaacacaagcaactctgagatgaatgcttttggggtgtgcatagagcagggtcctcagctgggttctagagccagcccaggccgggcctgagctgaatggcayctgccacctgggcctctctatggctttcatggtcccccagcacagcatttctcttcatggttctgtgatgtgatccatttgtctggagcrgcttctgttggatttgtcagtaagcgttgctcttgcttttattggtggtgtcatcgtgacacccccaaaccaaggtcccaaggtccagacagtgagagctcaactgagaatatccagaggactctcagcctgaaccagagcccaccctgcacccccacacccagagactgatcaatgtgctgtccaagctgcagtgccacataggtccagagtagggaaagtggctgagctggacttatcggctgccaccaccagcaccatcctcctgtgcttcctgtctcatccaccagctgcccaggatggggtgtggcagctgctcagcacacttggatgaccaggactgggctctagtgggaggaggtcactggggaaggaaaggccaggtccttgtacagctgaccaggaagagtgagggcgtggagcgtttgccagctactcccaagtcaacaaccctcgggaaaactgtctcttggttcaacttacagacagtgtattgagagtgcggagataggccaacaggggccccagggacacatgagcagcggagaaagtcatgatgtggtatggcggaccccccactttggatgtcacctttgggaagcatgatgagtgacgagcacctcccatctcccgtctcccacagggtttgcctgtgcgtcacacgcactgtgttgctcccgcctcacccccatcactcgcacaccagctgacggtcctgagggttgtaatctctggtggttggaagtgcaaggcctcgcagctagattccgtggctagccagatgtgctctgtgagaaccctggccacgctcacaggcctctttctactttctctctgsacagggacctgtcctatatcaagatcatggatgtgggccagagctacgtggtgaaccgtgtggctgaccacatccagagccgcatcgtatattacctcatgaacatccacgtgaccccccgctccatctacctctgccggcacggggagagcgagctcaacctcaagggccggattggcggggacccaggactgtcccctcggggcagggaggtcagtgcatgtgtccctgcgtgcgcacacgggcctgcatttgtaccctgcgtggctgggtatatgcatgtgtgagtgcgctggggctaggctcccattcttttaatgtgcagtcgaggtgaatgaccttcattcaacctagaatcttcccatcatgtagggaaggtcatcaagcaacaggcaaatgcctggatctctggtttccatgtgagctgtcactcactgagccccttttgtcagaggcatgccacccttagagcgacctgagtccatacagtgtagcagatagctgtgccacagtccaggggagacctcagtggtcacgtagcacagggcacctggttgtggggaggcagtggccctgatgagtctcagctataactgtgctgctgtgctcagggtctgggagggtgcacaggaacagcacttgtgttcttgtgtgtcagcatgtgtgtcatcgacaagttagttcatgctttttaccaaacctgtagtgagtgttcaaggcgagggtgatctcatggaccctgcggctatgggatgctttaagggcagcccaagacctgtgggtctgagtttgcttatgatgtatttcagtttgccaagagtctagcccagttcatcagtgaccaaaatatcaaggatctgaaggtctggacaagccagatgaagaggacaatccagacggctgaggcactgggtgtgccctatgaacagtggaaggtcctcaacgagatcgatgcggtagttaccgtccctccctccctgtctacctcccagataccgcagggctgctgcatcatattgtaacaacagtgaccattgctccccttgggcaaaggagaggagagagaaaggatacaggaacctaggggctgggagcagagaggaaaaggcagcctaacaggatgggaccttgggtgagccctagaccattctcaggagtgagcctgggagttgacacctcaacctcactctcctccctccctgtggcctcctgctagggttcctcatggtctagctcaacaagaaatcagcggccacgggagcttggtagctgcagtcagccatagccaacctcccagggatctggagacacaaatgaggtgaaccagcacggcctttgtctctttaaagatgctgttctcgccaggtgcggtggctcacccttgtaatcccagcactttgggaggctgaggcgggcggatcacctcaagtcaggagtttgagtccagcctggccaacatggtgaaaccccatctctactgaaaatacaaaaattagccaggcatggtggtgggtacctgtaatcccacgtactcgggaggctgaggcaggagaattgcttgaacccaggagacagaggttgcagtgggctgagattgtgccactgcactccagcctgggcaacagagtgatgttctgtctcaaaaaaaaaaaaatgctcttctgctgacttctgggttgcattgtttctaagagaagtctgttgtcattctcatctttgctcttctggatataatgttacctcctttttctctgactgcctttaatattttcttttcttcttttttttttttttttcaagacaagatcttactctgtcacccaagctggagtgctgtggtgcaatcatagctcactgtagcctcaacttcctgggctcaagccatcctcccatctcaacctcctgactagctgggactacaggcacttgccaccatgccaggctaatcttttctaatttttgtagagacggagtctcatgatgttgcctaggctggaatattttctctttattgctgatttttagcaatttgattatgatgtatctcagtatggttttctttatgtttatcatccttggggtttattgagattctcggatttctgggtttctaaatataaaatgtgaagaattgttggccatcatttcttcaaaggtattttctgccaccccttctcccatcctggactcccactctgtgtgtgttagactgtttggtatcatcccacaggtcactgaacttctggttttttaatttcttctgttcatttcttctctgtctttttttccttccgagctttaatttagatagtttctactgctatgtcttcaaattcacttatctttacttctgcatttttattaaacccatccagtgaacttttcatatcagatgtggtgttttgaagctccaggaatttcattttgttccttttttgaatcttccattatttcttcattatgcttggctctgcagtccaggaagtgcctctgggcagtaagctgctgcctcctcccctcagcttgcttcccttctctcaaggatcacagtcctgcctagtctcgtgtctaaaaacagttgtttgatttgtccctttatttatttatttttttgagacggaggtttgctcctgttgtccaggctggagtgcaatggcacgatctcggctcactgccaccttcgtctcccgggttcaagcgattcttgtgcctcagcctccagagtagctgggattataggcacccgccaccacaccaactaatttttgtatttttagtagagacagggtttcaccacgttggccaggctggtcttgaattcctgacctcaggcaatccacccacctcaacctcccaaagttctaggattacaggtgtcagccacagcgccctgccaatttgtccttttttaataatagttgtttttgttggggccagagcaaatctggtaccagttgctccatcatggcttggtctttattatgggtggttcccatttcaatatgaaaagctttttctgtggatatatactttgactaatttgaatattaccacccctgcttttgtttttccatttttttttactgtggtaaaatatgcataacataaaatttaccatcatagctgttttgaagtgtacgtttcaggagtatgaagtacatttacattgttatgcaactctcaccaccatgcatctccagaactcttttaatctkgtaaaacagaaactctgtacccactgaacaataactcaagccagatgtgctggctcacacctatagtcccaggtacttgggaggctgaggtgggaggattgcttgagcccatgagtttgaggctgtggtgtgctatgatttcattcacgattggcccttgcactccagcctggacaacatagtgagaccccatctctaaaaaaattttaaaaagaaaaacaataactctatttgctactcccagcccctggcaaccactttctgtctttatgactttgactactttatatacctcatataagtgaaatcatatagtatttgtctttttgtaactggttactttagttagcataatatcctcaagsttcatccatgttgtagcttgtgcaagagtttccttcctgtttattttttaagacagcatctcactctgtcacccaggctacagtgcaatgtggaaatcactgcagcctcaaactcctagactcaacgattctcttgcctccctagtagctgggactaacaagtgcacaccaccatgcctagataatttttttattttttgtagagaagggaggctcactatattgcccaggttggtctcaaactcctagcctcaagcgattctaccactttggcctctcaaagtgctaggattacaaatgtgaaccatcacacccagccttaagaattttcttcctttctaaggcagaataagattctattgtataccacatttcgtgtatccattcatctgccaatggacacttggacagcttccactttttagctattgtggataatgcagctgtgaacatggatacaaatgtctctttgagaccctgctctcaattcaattctttttggtatagacctagaagtggaattgccagatcctatggtaattctgtttttattatttatttatttatttatttattttgaaacggaatctcgctctgtcgcccaggctggagggcagtggcatgatctcagctcactgcaacctccacctccctggttcaagcaattcccctgcctcagcctcctgagtagctgggattacaggcccacaccacgatgcctagctaattttttttgtatttttagtagagacagggtttcaccatgttggccagactggtctcaaactcccaacctcaggcaatccacccgcctcggcctcccagagtgctgggattacaggcgtgagccaccgcacccggcctctgtttttatttttttgaggaactgctgtactgtttcccatagcagctgcatcattttacatttctaccagaagtacacacaggttccaatttctccacatccttgtcaacacttgttgttttcttttcttttctttttttaatagtagccatcctaatgggtgtggtattgcatcttggttttgatttgttattcctgctttctgtccatatattttttcttttttttaagtgacagggtcttgctctgttgtcctggctggagtgcaatggcaccatcatggctcactgcagccttgacctcccaggttcaagtaatcctcccatcttagcctcccgagtagctaggactacaggcacacatcaccatacccagctaaatttaaaaaaaaaatttttttttggccgggtgcggtggctcatgcctgtaatccaagcactttgggaggccaaggtgggcagatcacctgaggtcaggagttggagacctgggaggcggaggttgtggtgagctgagatcacgccactgcactccagcctgggtaacaagagcaaaactccctctcaaaattaaaaaaaaaaaaaaaaaatttctgcttcccgggttcaagtgattctcttgcctcagcctcccgagtagctgggattacaggaatgagccaccaagcccagctaattttgtatttttagtagagacggagtttctccatgttggtcaggctggtcttgaactcctgacctcaggtgatcccacctcggcctcccaaattgctggtattacagtcatgagccactgcccctgtcctaaatttaaaaaatttttagagatgtggtcttgctgtgttgcccagggtggtcttgaactcctgggttcgagtgatctccttccttggcctcccaaagtgctgggattacaggcatgaaccaccatgcccaacctgtccatatttttttattatattttttcccttttatttttaacatttttgtatcattttctttagaataaagagcataggccaggcgcagtggctcatgcctgcaatcccagcactttgggagactgaggtgggtggatcacttgacatcaggagtttgagaccagcctgtccaagatggtgaaaccctgtctgtactaaaaatgtaaaaagtagctgagcgtggtggcgcatgcctgtaatcccagctacgtgggaggctgaagcaggagaattgcttgaacccaggaggaggaggttgcagtgagccaagatatgtcactacactccagcctgggtgacagagcaagactctgtctcaaaaacaaaagaaaagaaaasaaaacaaaacaaaacaaaagcatatacttgctttgagttttagcctagcccaagagcttttttcatcaaggcatctgcaaccacttaggtttattattatcattactggtatgtttgatcttgttttcaataccttggaattttctctttattccaatttttctgtgtagatatgatcttttttgttatttgaaaggtaggcaatgtttttattccaatagtctttaccttaaagcttttcaaagacattctcaggctggatgcacataattgaaatatacttaacaaagctcatactgtcacaggaaaataatttttgaccttctgttgggaaagatgatgttgtattattgccattcatttcctttttgctctgttttttcgatgtaattgggcagagtacagcatcatggttttattttattttatttttatttatttatttattttttgagaccaaatctcactctgtttcccaggctggagtgtagtggtgcaatctcagctcactgtaacctctacctcccgggtttaagtgattctcgtgcctcagcctcccgagtagctgggactacagttgtgagacaccatgcctggctaatttttgtatttttagtagagacagggtttcaccatgttggccaggctggtcttgaactcttgacctcaggtgatccacccgccttggcctcccaaagtgctgggattacaggtatgagccactatgcctggcctattttattttatttttgaaacagggtctggctctgtcacccaggctggagcgcagtagcaccatctcagctcactgcaacctccgcctcctggactcaagccatcttcccacctcagcctcctgagtagctgggaccacaggtgtgcaacactacgcctggctaatttttgtattttctgtaaagatggggcttcaccatattgcccaggctggtttcaaactcctgaactcaagttgtggttttattttttatctattctttctcttcagaattgataatctctttcaaaaaagtaagcaatttttataactcattttgtagctcatttaacccattttgtgcttggtgggggttatccagccactgatttctttctcacacaaacagcagctacctgaggcaggttataggacagtgtcttccctccaaatatatagatttgatgctaacattcagttttgcagagaagcctgcagccaccccagtttttttcctttgaagttaatctgattattttccaagatgcttgtggatttccttcatctttcaagttttgaaactattacagtttttatgatccattaatcatctttccatgtttatcttctgataaacagccttgagcttgtcttctattccaacattatgactttttcttagtttaatccacaatttattgccttatagttcctttaaaaaaatgatagctttattgagatataattcatataccatagaattcacccatttaaaatatacagttcaggccatttgtggtggcgcacacctgtaatcccagctactcggggggctgaggcaggagaatcacttgaacccaggaggtggaggttgcagtgagctgagatcgtgccattacactccagccttggagacaaggcgagactcagtctctaaaaaaataaataaataaataaataaataaataagtatacagttcagtggtttttagtgtgttcagagttgtgcaaccatcaccacaatcagttttagaacatttcatcaccccagatagaaatcctgtgcccatcaacagtcacttcccatttccctctaacccttccttctgccttaagctaccactaatgttttcaaggtttattcgtgtagcatgtagcagtatttcattcctttacattgccaaataacatcctattatataaatataccacacattatgtatccattcatcagttgatgggcatttgagttgttgccacttttgggctatgtggataatgctgctgtgaacattcatgtccaaggtgttttctatgtttgtttgtttgagacagggtcttgctttgttgcccaggctgagtgcagtagcacgatcttagctcactgcagcctccatctcctgggctcaagcaatcctcccacctctgtctcccaagtagctgggactacaggaactcgccaccacacccagctaatttttgtatttgtttgtagagatggggtttcatcatgttgcccaggctggtctcaaactcctgggctcaagagatctacctgccttggcctcccaaagtgctgggattacagacatgagccaccgcatccggcataagtttttgtgcggacttatatttttatttctcctcactgtacgctaggagtagaattgctgggtcatatggtaattatacattcaaccttttcagaaactgccacactgtttcgccatctcacattccctcccgcagtgtgtgagggctctgatttctccacatacccgcctgcgcttgttaccatcagtcttggttgtagccgtccaacatgggaactcagtttagccacattctctgccactttataacatggattaccttttctctagggtccaggaaaaggtacctcatttccccttgtgggctcacagaggcacctttaatgttcatatttctatcaacgttcttttcatgatgatatatgtgctctttacgatggtggaagctggccgggcgtagtggctcatgactgtaatcccagcactttgggaggccgagatgggcagatcacatgaggccaggagttcgagaccagcctggtcaacatggcgaaaccccgtctctactaaaaatacaaaaaattagccagccatggtggcctgtgcctgtaatcccagctactcaggaggctgaggcaggagaattgtttaaacatgggaggcagaggttgcagtgagctgagattgcaccactgcactccagcctgggcaacagagtgagaccctgtctcaaaaaaaaaaaaaaaaaaaaagatgatggacgctttctctgtcatcctcttcacttccttctgtgccttcaccagaataatctttaatgtctaaatttctactaacagtctcttcaagacagtctaagctttttatcatgcaccacaaaattcttccagcctctacccactatcccatttcataaccacttccacatttttagttctttattacagcagccagcagcacttcacctcctggtaccaaaatatgtgttagtattcaagtgtggtggcgcacacctgtagtcccagctacttgggaggctgaggtgggaggatcacctgagcctgggaagtttgaggctgcagtgagccaagatcacaccactggactccagcctgtgtgacagagtaagactgtctcaaaaaaaaaaaaaaaaccactaaatgttaaaaaaaaaaaaagtattagtttactagggctgccgtaacaaagcactacaggtgagtggcttaaaacaacatgaattgattctctcacagttctggaggctagaagtctgaaatcaaggcgtcagcggggccatgctccctctgaaggtgctaataaagaacgcttcctcacctcttcctagtttccagttgttgccggtaatccttggtatttcttggctcatagcctcatcactccaatcccacctctgtccacggtcatcacatggctttcttccctatgtatgtctgtctgtgccttcacatgacattctttttttttttttttttgagatggagtctcgctctgtcacccaggctggagtgcagtggcatgatctcagctccctgcaatctctgcctcccgggttcaagagattcttctgcctcagcctcccaagtagctgggactacaggcgtgagccaccacgcctggctaatttttgtatttttttagtagagacggggtttcaccatattggccaggctggtctcaaactcctgacctcatgatccacctgcctcagcctcccaaagtgctgggattacaggcatgagccactgtgcccggcctacatggcgttcttaaaaggacaccaatgactggatttaggacccactctaatccaatatgtccccatctttttttttttttttttgagacagagtctcattctcttccccaggctggagtgcagtggcgtaatcttggctcactgcaatctccacctyttgggtacatgcgattctcctgcttcagcctcctgagtagctgggactacaggcgtgcgccaccacgcccaactaatttttgtatttttagtagagacggggattcatcatgttgaccatgctggccttgaactcctgatctcaggtgatccacctgcctcagcctcccaaagtgctgggattacaggctgtgagctgtgagccaccacgcccagccaacttttctttttttttcttttcttttgagagggagtctctctctgttgcccaggctggagtgcagtggcacaatctcagcccactgcaaccactgcctcctccaccatgttggccaggctggtcttgaactcctgacctcaagtgatccgcctgcctcagcctcccaaagtgctgggattacaggcgtgagccatcgcgcccagccagctttttttttttaatggcatttgtagaagatgatctatgctctgtgtgtgtgtgtgtatcccaaataacacaagtgaagttttccttcatagtttgcataacaacctacactcacaagtactatttccacagcacagaaaagaaaaaacacatagcatctctgtgtgtattggatgggtgatggataggtggacaagaccatcctggtagctttttacaagcaaggaaccaccaatgatcagtgttcctagaggtcctcccctccttagacaggtttctgttcccttcacccaggaaatgcccgtgaacttggtctcttctgcttgatgctgcctcaccccacatgtccccaaggctcatcttctgggcctgtaggaggtgtgatgactgtggtatctccctagggcgtctgtgaggaaatgacctacgaggaaattcaggataattatccactggagttcgccctgcgggaccaggacaagtaccggtaccggtaccctaaaggggaggtaggtgggatttggggcttagtcccagccacctactgcccgcctgggagtaccacctgtggctgagggcctgtggggctctgcaggggctgcgtgggtagcagaaggggcctggtctcagaggcctgccagcctgggtgtgtggttcatctccaccccttcccagctatgcagcccaggccttagtcccttcctcaggtgtggagtgggcagtgccatgtagggcaggccttcaacctggagacctttggctccctgctctccattcttgtctttccccttcccaggggtggagaattcggaagggcagggcctgaggtgggggatctgcggagttaggctttcctgggacccctgtagacagtgtgcggtcccctggcattcccaggccagctcctttcccagcgagttgtcagccctttccggggcgctcaaatggctggggagttggggagaccatggcaggcctgggactcgggtctcagctcactcgagtccctgtctcgggcctcatccttcctttggatgcttcctcttgtcacaggctgagcccatcctgtccttcctgtggctccaggcaccacccccagccctggcaccagacccagggagaccttccacacatgagttggctaccacaagccactgcacttgtcaccttctctgacacagttcagcccaggccccaggtcagaaactgagggtcacctttgactgaggcatctccttccacttccaggaggtggcctggggcaggggccaaataaaaatacaccccgtcaacacacatatgtacacatatatatacacatgtagaagcacctccacccagaagccaggctgacaggtctctacactgtaccatcctcaggatagtatagctcttgggaacattaattattccccacattatgttaggccaagttcagatttagaaccaacccagataacggtcaggagaaacaaagcagctggctgctcaaacatgagaatacagtgaggagaattggttgagaaattcatgttaccaaaagaaccggtctaggattttctcagaactaccaggaactggcacaaatcagcgtgtcatttttgcttcctaatcaaagcttggggcacgttcagttctgactgctggaggccatttttgaaggaccactcattgtgtgcagaaggatgaaactgatgaaaatctctaaacctgccaggttgagaggcccagcaggggcctaaaccgtacatcacggcaggcatagggggaagatactgggcaggtagactgaggatagttcctggggaccccagctgtttctgatgagtcacactccagaaagttccaggtctttgctctcttccccttcgctcttgtcagtgcactctgtttgctgtgggctggaagcaggcgaggtcttctccaccagtcacatgaattctatagctgaggattcagtgcagagccccatgggtgggcactgaggtggaccctgggatggagcctgaggcctagctctgcgctctcaatcctaccaggacctagccctgaggtgggaaaggtggcccctttcctcagctgcccacccccatggcctcagaaggctaggctggaggaggcccagccacagcttcccagaatggtgagtagctgcaggagtggaaggtggcccagtgtccaggatgtgtctgtccctcccccggagccaggcctgagggacccctctctgcttgcccttgcagtcctacgaggacctggtccagagactggagcctgtcatcatggagctggagaggcaagagaatgtgctggtcatctgccaccaggctgtgatgcgctgcctgctggcctacttcctcgacaaggcagcaggtgtgggctgtgccccgggggaggtgggaaggttgtgtgagaaggtaggcmctgtcaccaggcatttctggtgtgctagccatccccctctgtgtctacagaacagctgccctacctcaagtgtccgctgcacacagtcctgaagctgactcctgtggcatatggtaaggaagcttcctgcacattgaccatgggtagccatgaccttggatctctgcacagttccatgattttctccgaattccttgaaaattgtgttaggagcccattcctccacctactaccccaccacctttcccaatttgctttttttctttgagacggagtctcgctttgtcacccaggctggagtgcaatggcgtgatctaggctcactacaacctccacytcccgggttcagatgattctcttgcctctgcctcccgagtagctaggattacaggcgcctgccaccatgcccagctaatttttgtatttttagtagagacagagtgtcaccatgttgtcaggctggtctcgaactcctgaccttaggtgatctacctgcctcggcctcccaaagtgctgggattacaggcgtgagctaccatcatgagctaccatctgcggccctaatttgcttttaaaaagtttgttctggggctgggtgcggtggctcatgcctgtaatcccagcactttgggaggccgaggtgggtggatcacgaggtcaagagatagagaccctcctggctaacatggtgaaaccccatctctactaaaaatacaaaaaaattagctgggcgtagtggcgggcacctgtagtcccagctacttgggaggctgaggcaggagaatggcatgaacccgggaggcggaacttgcagtgagccgagatcgcaccactgcactccagcctgggcgacagagcgagaccctgtctcaaaaaaaaaaaaaaagtttgttgtgaaaaagtttatgtggccacagaagacctccccagtgactttgcttaaccattgcctacctgcatgaggggcttttctactgatttttctgaacccccacaaggccccttggtcctcagggcctggactttattctgggtgcagggcagtgtgagtccccaccctgcctcttgctataccagcagagacttcaggcaacttcttcatctctcaggtcttagctcttcacctttaacacaggtgctcttgggggaatggctgtgaagcccagtggcagctgatgtcactccagtgtgtgacaatggcctcatcccccattgcactgtgcacctggcacacggttgactgggccttatatggtagagttggaatgtgggtggtttgggggccctgaagactttgagagtcagtaacctcaacttaggcctgctgttcccccgatccctctcggtcctggggttggggagcctggggcctctgtgtggccctgtctgggccgtcacatagatatgcgtgggtctgacagcgtgtctcatccttcctcccggggctccccagagctgcctaaagtggaagaactagagtgaggctgagatggctgctccattccacacgcccagacccccctccaagagaagtttctagcatctgcagctcagctgcctttcaggagtggggatggatttgcatcttccctttggcaggttgtaaagtggagtccatattcctgaacgtggctgctgtgaacacgcaccgggacaggcctcaggtagcaatggggtcactgctggggtagcggggtgttcctgatgtgggggtgtccagactgcacatcctccagggccaggcccagctgcggcacctgccagagggagcttgagtcttctgccaagactgttgtcccatcagcagggcggggccctggctctgggtggggcctgcatcaggccttcccaaggcacctgccctggggatggggaaatccctgactctgggccaccaggctcaggagtgcctgaacttgggtgtggttggagccccaggacttgaggagccacagggctcccaagcagcaacttggaggtctaagtcaagggggcccttgggctcagtgagaatgaggctggaggctaagaatgaggcttctggccttctgagggcaggtgggcactcttcccactccccatccctgcagccgaggcctcatgagcccctttcctaaccccagcacctttaaaaattaaaatgggatcatgtacttttggggaaagggccatgcagatactgaaggggcctcagcatggggtggagaccttggtccagaaaagcagtcaccacctgtgctccccaagtgccttgtggaaggtagaagctcctcagagtgtagctcagaaccactcttagtcccatgtggggtccctccacaatgttggctccctctcccactggggccaaggataggacctacacttctgggagccccggtcccagttcctggaggccactgcacggagaaggctcttgggcctcagtcatgcctcttgccatccatgatggggcctgcttgggctctgggtccctgctgaggatgcacgtcttgggctggaccaggacatctggccttggacctcacagcacaggtgtgtagatgtgtcctgtcccttcccaacaccactgcccccaagcaggaccagttaccctgcaggcctctcttcccattgctctgatagttcgtgcatgtcttggccaagttcagcccaggcccaatttggtacccacaagtcacaggggaacgtacctcccaacgggcatcctttgggccaaggaaggcccagatggcactgggcccccagcgctgacagagtgatggtaagagaggcccctgggttggcagggtgatggtaagagaggtccctgggcctggcagcccttgggagctgaccctaccagtccatcaccatagtgtggctggcggtcattctgcccactatgggtgggtgcttctgagaggcaaaccgctactaaccccaggttcctggatggctcccttctggcccatccattggggcaggctgtggtggaaaaggggcgcctcaggaagcctgcccagcagtaagaattatacctgcccctacaattccaggggccggtcctatgagcccaggctgtgggccatgggggccatgtctctctccctgaagatctgggcatgtcatgttgcatggggcagcagctcaggtcatcagtgacctgctcctgcaggtgatggttccggggcccacagctgggaggaggggccaccaggctctggggcacataagacagcctcagagagctaagggaagtttcagattccctattcctcaggcctgagactccctgagcccgacaggccaaggatgggactgagctctgcagtttggtggggtccttctatagctgagggcttcaggaggccctgtaccccagttctgaggggacagaccaggctgcagaccaggaaatgcccataggcttctggggcacctctgacacctgcgtgccaacactttaaactaggaaggaggcacccccaggagttgaaccccttccctgccccacagatgaggataaaatccccaagccaggggttcctcctcaattgactcagccctgagataggaggtgggagtggccttgctttgggtattgcctgacctggctgcagtggagcaggaaacgaggtggcatcctccaccgcacctttgttctattgtccatccacccgctatgtggcacgaagctcttggccatgtattcttagggaagcttgtggtctagagtcttgcggctgtggctgctacagtgagaatgtgaagcctgatgaaccacagtgatgaggacggcagacagcaggcatctcatctattcctgccatggagtgaacgctctgtgtttttattgtacagaacgtggacatctcaagacctccagaggaagcccttgtcacggtgcctgctcaccagtgaccatgttcatccacygtgaccactaggcaggcactgctctctgcagagggggtcattccaggccctccagtgtgtgtgatagtcaccatgccatgcagggatattcttgaagccacacatggctggcggaacccagagcccccaccccagcccacctggctctttgttgacagtcggcgacaaggttgtgcgtggctcctgacctgctgctaagagtcacttgaccagactgcatctgcatgggctgcgcggaggttgcccagccccagtttcttccggcgcagctcttaggtgttcactctcgccagctcagttggctttgtgaagtgtgaaaccctacaatgtgaaaggaaagtgcttgctgtgatgttcctactgtggcccagctgcccagcatggacctggtgactctccacagggcctctaccatcctctctgtggccacttcctgagccagaggccaggtcttcatggggccctgagcttctgctgcctctggtgagagggagagcccttcccatccttacccaccaggaactagagccccaaccacagcagatgcttcctgggcagccactggccaggccgttgtatccatgtcacccttagttgtgggcattcatgaaagcaatgcgcttgcttcagcacattgggatgcacagaaacgtgagggcaggggggcagttgtggtcgcccctccccagttgtgcatgtacccggctacttaggtatgcttaggggagctggtggccaggggtgccccttcaggcctgctctcacagtgaaaccacttcaagacagggcaggaagttaccttcctggtgcacacaccgaagtgctygagggagaggctgccgccccctctccccttccctggctgtggacactggcagccaatggggaggcggcctctcccctgttgctgcccgtgtccacacaggaatgtactctggtggcagaaacatgcatttgccataaataattcagaaacacttgtatggtcctgtaaaacttctctggtgtttgttgacttctgcctgtgggtctgaggaagggagaaggcagaacccataggcagtccctgggcaagggaggattttcccggccgcagcacagccttccattcatgtgcacgtgagtctggtgaaaatggccttgtgaagtccagtgtctgtcatgcccctgagttcttttggtcccagagaggcagcctgggcagtctgtttacagctggcaaacagactggctggcaagttgtggggctgggtcagaaagtgtctggacttgtaatcgggtgccctgctgtccacaggtggactctggggaagccaggcccctggatcccaagtcctttgtgtccggagcctttcctggcctgtgcctggagggtagcacatctttccagcctcccagggctttgcagcctgcagatgccacctgtccctgagagaagttagcgtccctggccctggccggtggtctctcatccttgtgtgctgctctgctaagagatgtccaaggcggagcyrgggcaagatccttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtaragggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatactttttaaaaaataatctcaggttgtatttggtagccagttctccatttgtgaagtgttttttttctggcctgctctgtcgacacctggtgctgtggtcttcctcgcaggtctgtgttgggatccttcgttcagcttccacccccatgttcactctcactgaagaggaattatgctgccctggagtgagtcctggcctggcatacatgggcaggcggcctgggtcttccctgggctgacctggggtatggggcccttggccctgaacatgaggcagatgtggagggggcagtgcagctggagtggagcactgttaagggaaggattctggggtccctgggaatgtgggctccaaatgcggcattcttggggaggaggccccgggagctgggtcaaggatgtagtggctgcgtgaggctgtggtgacagtatgctgaccagtgttttggtattttctttttctttttttatttttattttttggagacggagtttcactcttgttggccaggctggagtgcaatggcacgatcttggctcaccacgacctccgcctcgggttcaagcaattctcctgcctcagcctccccgagcagctgggattacaggcatgcaccatcatacccagctagtttttatatttttagtggagacagggtttttccatgttggtcaggcttgtcttgaactcccaaccttaggtgatgcacccgccttggcctcccaaagtgctgggattacaggcgtgaaccactgcacccggcctattctggtattgtctttgtcacctgcatctggggtcgggaaggtggagacaaggggctgggtgttctctttcccatgcctcagaacatcatgggctgtccatacttcctgccctggagctggctttccgggaagtgggttgtaggcggggctcctctgtgggcaagatggggcagggcattgccgggtgttcgcctgtgctcctcccagtgtgtcagggcagaggatggctgtcgctgggctgcttctgggtggtttggggtggccagcagctatgtttctgccttctccaactatgccaaggtgtctgagggagaggcaactttgcaggattcaggtggtgactaacctctgcctggtgagagcctgggggacagcttcgggggtcctcacctgtctcttggctctgagttcctagggtggacacctgactccctttgaggcttctcagcacttttggaagaaggttttgaagattttagtagaaaacaataaaaggaatgaaatataacaatatcagagtttttcttcaggtccagtgttgtaccataacctagaaagggcaattatattattatgttgagtagcattttgggttactgggaaataatagccatcatatagggtcacaggatatttgttttttattttattttatttttttgagacggagtttcactcttgttgcccaggctggagtgcaatggcgtgatctccgctcactgcaacctgcccctcctgagttcaagcaattctcctacctcagcctcccaagtagctgggattacaggcatgcgccaccatgcccagctaattttgtatttttagtagagatggggtttcttcatgttgttcaggcttgtctagaactcctgacctcaggtgatctgcccgccttggccgcccaaagtgctgtgattacaggcgtgagccactgcacctggctattttcattttttcttacaccaataagaatgagcttgaaaggatcagataatatttggatagaatcaaatattgttgcaaagacataggtaggtttcagcaatattggatttatatctaaaaatatatatataatacttcttacttgcagagaagagtgttgccatatttggtttagactgatcattactgggtacattattgtttaaacgaaactattttatcttatttttgtaaaaacggggtcttgcaccgaacacagtagttcacacctgtaatcccagtgctttaagaggccgaggtgggagagttgtgtgagcccaggagtttgagaccagcctggggagcataatgagaccctatctctacaaaaaaaattttcaaatgactaagtgtggtggcacgtgtctacagtcctagctacttgggaggctgagacaagagaatacttgagcccagaagttggaggttgcagtgagccggggtcaggccactgcaacctgggcgacaaaataagaccctctctcaaaggcaaaaacaaaaacaggatcttgctctgtagctctggctggttatgaactcatgaccaagcgatcctcctgcctcagcctcctgagtagcttggggattacaagcacgtaccactgtattggcaaaactattttattaaaagtgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttagctgggcatggtggtgcgtgcctgtaatcccagctactcaggaagtctgagggggggaggaccgcttgagcccagtaagttgaggctgcagtgagctatgattttgccactgcactccagcatgagtgacagagcgagactctgtctcaaaaaacagaaaagtgaaaaatggctttgtggtagaccacaagtatatctgccacacctggcttgtggccacaggtctctttggggagattgtgaggaaaatgccaggatgaatctgtgctgtttttacagggccctccttaagggtgcatgccccacctcgttcaggggcccctgagtttgcaaactgatttttatctagaaaattggtgagggtttcctctctgttgcagtagagtctctgtcagttggacctcacactctcttgttatataggtgggactctactggcctctccatctattttggtactaggggtctggtgatcgggtccctattgctaaagattcctgcaggttgctaaagatccctccaggtctgaccattcagataacctgtaaatcctgcattcccagtctgtgctcctctctctcctctggcagctcaacactgctgcttgacccttgtcaccccagactccttgtatctgcattgaaatcaaggagctggcttggtgcggtggctcacgcctgtaatctcagcactttgggaggctgaggtgggtggatcatttgaggtcaggagtttgagaccagcctagccaacacggtgaaaccctgtctctactaaaaatacaaaaaaattatctgggcctggtggtgcatgcctataatcctagctactggtggaggctgaggcaggagaattgcttgaacccgggaggtggaggttgcggtgagccaagatcgcgccattgcactccagcctgggtgacagagtgagactccgcctcaaaaaaaaaaaagcaatcaaggagccatttcaactctagtgtctcccactagaatccctaacctatggagaagagtctagaacccctaacctatggagaagagtctagaacccctaacctatggagaagagtgaccatggtgcttactatgcaccccccaccaatttatatgttgaagttctaacccctagtacttcagaatgtgaccttatgtggaaataaggtcattgcagatgtaataagttaagacaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtatttattttttgagatggagtcttgctctcctgagtagctgggattacaggcacccgccatcatgcccagctactttttgtatttttgtagggatggggtttcaccatgttggccagtctgatcttgaactcctgacctcaggtgatccacctgcttcggcctcccaaaatgctgggattacaggcgcgggccaccgcgcccggcctcaacatttattttgaatgaataaaaataaatacatcttcttaaggctttggattctttcctctgtgttatatcagggaacttttggcaccttaactgcattgagtgggatccagttttgttgtggagtctcgctctgtcgcctaggctggagtgcagtggagcaatctcggctcactgcaagctccgcctcccgggttcacgccatgctcttgcctcagcctctggagtagctgggactacagtcgcccgccaccacacctggctaatttttttgtgtttttagtagagacgggatttcactgtgttagccaggatggtctcgatctcctgacctcgtgatccgcccgcctcggcctcccaaagtgctgggattacaggagtgagccaccgcgcccggctgggatccagtttttattcagccaaccaaatagacgtgtggaacaacccccaacagcttgagctggtgcatggaatccaaatccttgctaagtgcacccatattgataaattcagcccaatataaacttatgttcttatctccttggtctaggacttcagtctgttcccacacatattctctatattttggccaacataaaataacagtcttgcaactcttttgatatgtgagcctcccgctctgggcttgactttgtgaaagggtctccagacatgctgaaatatctctctagttaaaagctctggaaatcataaggaattgggaggaggggccatgagaagagttagcttcctcttacagggtaactccttcatgatgtccatggtgtctttcaggggaggacacattgcttcagcaggcaaaggaggtgcagaagaggctaggggttggtgaggatctaattcctctnnnnnnnnnnnnnnnnnnnngtgcagtgatgtgatctcagcttactgcagcctcaacctcctgggttcaggtgatcctcccacctcagcctccctggtagctggactacaggtgcacaccaccacaaccagctaatttttttttctttttgtagaggtggggttttgccatgttgcccaggctggtcacgaactcctcggtggaaacaatctgcccacctcagcctcccaaagtgttgggattacagttgtgagccactgcaccccgcctgttttttttttttttttttttttttatttaaaatattgtttttgtagcgatgggggtctcactttgttgcccaggctggcctcaaacccacggcctcaagtgatcctcccaccttggcctcacaaagtactcagaatacaggcataagccacaatgcctagctgattcagcacatttattaagtgcccaccatgtgccaagcagtggggatacaggagtaagcactaccctgctgtcagagagagaatgttctagtg

SEQ ID NO: 18005 - DNA, 27185 bp, Homo sapiens
ggctgacttgcagccaggctcgggccatttttattatgcatcctcagaacttctcccttccactactagactgccctgaaatgggacagaaagtttgagagtcaatcccagagcagacaggcgcggtggcttacatctgtaatctcggcactttggaaggccgaggtgggtggatcacttgaggtcaggagttcaagaccagcctggacaacatggtgaaaccccgtctctactaaaaataaaaaaactggccggcatggtgatgcacgcctgtagtcccagctactcaggcggctgaggcaggagaacagcttgaacccaggagacggagattgcagtgagctgagatcacgccactgcactccagcctgggtgaaagagtgagactctgtcttaaaaaaaaaaaaaaaaaaaaaaaaatcccagagcaaaacctggaaatctacctgctcccaatttcccttagcctttctcccccagccctcgaagatgggcaacttaaaggggaagggctgaggctggggacagggtggtgggggtgccagatgacctgggcttatattctcaggtcgttcattctcttcagattcttttactcaacaaatatttacagatgagtgggtaccaggccctgctgtcaaacagtgaccagtgctttgaggcaaaagcaaacaagagagaagaggctgctactttagatgagggtcaggaaacctgctctcaggtgacatctactacggaacagatgcagagaggcagcagatccctggggcagatgacaggcatctcagcagaactgaggggctttggatatattcggctgcacttcaggtccccattgagcctatcccagcacacctcaaacacttacatgtctttaaaaaaagctcacctccagaataaggcagcagtctattaccagagtgacccttccagctacctttaacaggaggcatgaaatgactcactattctgatgcaagtccagacccactttttgggtaacatatctgggtattgcagccaatcgtttcctccagttgaataaggtgaaagaagaaaactcacgcagttgtgctccacaatgaagctaagtatttaattcctttttaatgtttacattattaacaccagcattacaaaacgatattttttacttgcaagcgatttaaatgtgcaattcggtgtctcgattactgggatcattataacttgaaaaaccgaagaagtgctccctccctcctctctcctccccctgatggtgcctagtttctataaagagcaatcagcgttccataaagcccaaatacccattccaaatgacttgggaggtgaggccctggtgggggttttcaatgaggcattcagtgtggaatgagtgacagccggcaggtaggtgttaaaatggtcatcaactccccaaggtgctggcaccacccagctgcattccaggcagtgcctattaatgtgctaggaatggcgctgggtgattgacaagcgggtcagtccagactggctgaaaccaccttcaggcacagggaaaggaaaagggcctagaaaatgatcaataagagccactgcgatgtgttggcttactttgtgctggcactggccaaggctacaccaggtgtataaacacaccacgcacatggtttacgatgataatgctgcaagggggcctgaagaggtgcctgagggagtggccaagagcacggctctgagccacccagcctgggctcaagtcctggctctgccacttaccagctggtgaccttatcctctctgtgcctcagtttcctcagtttctgtaaaaatggcaggataacagtagtacataaatctgagagccattgtgaggactaaatgagtccatacatgtaaggcatttagaattgtgcctgggctgggcacagtggctcatgcctataatcccaacactttgggaggccaagcccagaggattacttgagtccaggattcgagatcagcctgggcaacatagcgagaccccatctccacaaaaaataaaacaattaactgggcatcgtggtggccacctgcagtcccagctactcaggaggctgaggctgaagcaggaagatcgcttgagcccaggaattcgaggctgcagtgagctatgattgtgctcctacactccagcctgggtgacagagtgagaccctgtctctaaaaaagaaaaaataaaaataaaaaattaaaataaaaaaaattgtgctggcacatagtaaatactcggtgttaatttatcatcatagttctcattttaagatgaagaaactgaagcttacagcaattaaataacccgcctggggttggctgctctgaagacctttgcctttgctgccctgttcctggaagcctctcatgcccatcttcccgtggctgccccctcaggtgactcacaagctgctcagggatggcctccagaccactgacccctcccctgccccaatcactgtggacccagcaccctgccttgatctctccttcgcacttatcacatctgaaattatcttgttcattcagcaaatgagctaatacatatagagcactattattattatatgtttgcttggttgctgtctgtcctcataggggcagggccctcacctgtcttgtctaccacatgacaggaactcagagccagcttcatgggtgtgtggcctgcacagtcgcccagggccctgcactcagaaggggctacatttgctttaatgctctgctgttattgtcttgaaattcttaacaatttttttagagacaaggtctcactctgtcacccaggctagagtgcagtggtgtaatcacagctcactacagcctctgactcctaggttcaaagcagtcaagccatcctcccacacagctaagactataggtgtgcaccaccacattcagctaattttttaaatttttggggagatgcgggtctcgctatgtggcccaggctggtctcgaactcctgggctcaagtgatcctcccgcctccaagtagctgtgattataggcacaagccaccacgcccggccttaacaattttttaacaaagggctttacattttcattttgcactgggccccagaaaattatactgatagagtgatcagggctatagatcagtgagtaagtgaatgaatgaatgaatgaatgaatgaatgaatgagcaagcctacattccaaacaggtctctcagactccataaccctactacttaactaccatgccaaacaacctccatatggaggaagagaggtgggcagggcagtcagaaccagggacaaccacagcctgacggagaagctagggtacaggggaagggagcaccttaggaggaagcatctgtttgcgcttcctctggagcccagcattcttctcaacctctcattgtccttgtacctcaagcagcatgaaaaccatttgctgccacctaatgttactttttggttgcctaagacagagggaccttggctctgcctcctgggacagatgtggaccagtcaggtgctcttcaaagccacggctatgacagcgcctcggggcacccagcacagccctaggtgcctggaccttggtaagtaaatagatacaatccttgccctttgtgccttaggggtgtcatcaaaactacatggctatgaggtgaggatggagcaaggagggactgctgggctgggaacctggtggggttaatcaggggagctttctggagaaggtgcccttgggcgcctcattttccactccccctgaactctccttacctcagcgggcatcacacattctggtccccagaggttttcctttaatggtcttgactcctaacatcttcggaacagttaaagccattccagttaaaatcacccattgatctttcctcaaattaaactcctccctctctttcccattgccaccccaggcctgcctctggctgttcttggagccatccctgatcttctcccactctcccctgaacagcagacatctgtttctccaaactctctagcattgtctaacacttcagttaaagctctcgtcatctgtaactttgtgtcctggttatgtacacattcccagacttggccatcaacttcttgaaggcaggactctcctagattcacctttaaaatgtaggtaaggcaagaaggaaaaggtttggaggaagcaaagttttgtacacattggatggtcttggctaaatacaggatagtggagatatacggggggctgaggctttcttatgaaaaatgcagatggtgggacagtcttttgagaacaaaaattagtccacatggtgatgtagctagagacatataagagaagacttgataaaacaaacacattttaatgggagaaaatattctgaaatcacatagctgtgaagggagtaatatctggaatatacagagaactcctaaaactcaataacaacaacaacaaaaaaaaaacccgattaaaaacaggtaaaggacttgaatagatatttctctgaagatatacaaatggctgataagcacataaaaagatactcaatatcactaatcattagacaaatgcaagtcaaagctacattgagatacagccctcacccattatgatggttactatcaaaaaaccagaaaataacaaatgttggtaaggatgtggagaaattggaacccttgtgcaccggtggtgggagtgcaaaatggtacagctgctgtggaagacagtatggcagttcctcaaaaaacttaaaatagaattaccatatgatccagcaattccgcttctgggtatataccaaaagaattgaaagcaaggtcttgagatgtctgtacatccatgttcatagcagcattattcacaagagctaaaacatggaggcaacctaagtgtctatcaatggatgtgtaaacaaaatgtggtatatacatgcaacggaatattactcagccttaaaaaggaaggaaattctgacatatgctacaaaatgaatgaaccttgaagtgaaaatattatgctaagcaaaataagccagttgcaaaaatactgcaggattccacttacatgaggtacctagagtagtcaaaatcatacagacaaaatagaatggtcgttgccaggggctggggggagagggggaaatggggatttattgtttaatgagtatggagtttcagttttacaagagttacggagatggtgcgatggctgcacaacattattcagtgctatttcatacccatgaactgtacacttaaaaatggctggctgggcaccgtggctcacgcctgtaatcccagcattttgggaggccgaggcaggtggatcgcctgaggtcaggagttcgagatcagcctggccaacatggtaaaaccctgtccctactaaaaatacaaaacatagccaggcatgatggcgggcgcctgtagtcccagctacttgggaggctgaggcaggagaatcacttgaacccgggaggcggaggttgcgccattcactgaacaccagcctgggcgacagagccacagagcaagactccatctcaaaataaataaataaataaataaaaggttaaggccaggtgtggtggctcacacctgtaatcccagcactttgggaggccaaggtgggaggatcacttgagcccaggagtttgagaccagcatgggccacatagcaagaccttgtctaaaaaaaatggttaagatagtaaattttgttatgtgtattttaccacaatacaaaataataaattgtaaagaaaaaaaaagtttttctagtctgaatcaacacagttggcattgctcatgctagaaaacctgcgcctcccagagaaaaatgtctggcttatgaggggtaggaaggggggaacagaagggatactaacagggactgggcagagaagaacaagaactaggaagcactaaagaaggaattgaggccgagtaccaagggatagtgacaggtacgggggcacccacgaacaacgttcaaacatattttcatccagtaacctgtatttacatgcaaayatattggtttatgcaaaacagcggaggcctcgggggagggttttttagtctcaagcttgtgcagtcattgaaaaagagacgcaaagctgtctctggggtactccacgtccgccttgcccctgggagctgggccggttccaggaggacgaagactgaattagctcggcttgcagagaaaggcgagcagcgcccctacacgsagagtagcggkgcgcctacaaagtcgcgcatgcccactccggcctcccgctccactcctaaggcaggcggcgaggcttagtgcgcaagcgccattcgtcggcgccgactcctcccgctaaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggtgaccggcggggaggcggctgggacgaggggaggaaaggacgaggcaggggcggggccaacgagcgcgctagcagggggatctgckcatgcgcgcgccctctttccaggcagcacgtgagcgcggaccccctttttcccccagggagctactgatagcgacgcccgttgtattcagcgctctcccccggctgcaccttggaattgccgaagaagctttttttaaactccagatgggccgggtgcggcggttcacacctataatyccagcactctttgagaggccgaggcgggaggatcgcttgagcccaggatgacctcctgggcaacatagtgggactccgtctctacaaatcaaaaaacaaacaaaaacttcaaatgcagaatctctaggggtggggtcttgacctcagagttttaaaagctctccaggtgattcaaggtgcagagagagttgagacccacaccaccagtggcagctggtgacagcctcagctttttgcttccttgtcacggtagcattacctcattatttcgcagtgttgtgtattgactgagctaatccccagttaactctgcaggtccccgctaagcgtttgcgttcttcctgagcccctgtaagcctgtgcagcaggtttgggtcctcagctcacgcagctgtgtgtgagtagtaggcctatgttcttgctttcctccaggttggcgctgcagctctgggattcattcattcatatagctcgtatttattgagcacctaccatatgcctggaacggtgctagggaaacagcagtgttaaacaggtgaagtcctgcccgcatgaagttttacattgtagttcaggacacaataagcaggtaagtgtacgtaagacagataagtactgtgatcgatagaaaatagggtagcgtgataaaagggtaatgttattagtggggcctttctgaggagatgacacataggtgagacctaaggcaagaggatgagccagccatgtacacttggcgggaaggacattccagacactgcacatgtccasaggcaggaggcagattgacatgtttgaggacagaaagaaagccagaatggctgcagggtagtaagtaaggtggagtttgctaaggtgaaggtccggagccaggcacagtaggatattatctgttctgattagctttagacctcattataaggccagtgagaagtcactggggatgtttagtgaggggactgatgtgccctaatttactttttaaaagactattctggttgtatgtggtgagtgggctatagggggcaataacaaaaaaagaggctggagagaagccgattatggtactataagcgacagatggtggggggttggatgaggacggcagcacagaagatggaagtggttggattcaggttatgcgcaggttgagtcagcaggacttgctgatatatgggatgtgggataaaggaaaagagaggaaccaaagatagcacctagatattttttggcctgggcatctaggtctaagatggtgccatttactgaggtaggaataggtgaagtgtaggaagaatatctcgagttcggtgttaagcaggttaaacctgagatgccaagtacactgatttccaagtggcaatgtcaagtaggcagtgctatatttgagcctggggctcgggcaagagaccagaaatgaaatgagataatgagatgcatatacacacagtctgaagaaatgacttgtgaaacttggccaagacttgttacagaaggaacatgggttttttttttttcagcttagcccgaaacagagccaagccagcccacctaaaggagcaggagcacgcccagtggcatcattgtgactgtactgctgattggctggcagcctggggagtgtctggcccaggttatacgatacccagggccctcacatyattcatggtggtcttcactggcccaaagtgtaaagatctttaaggcaagaatcttatctagtcccaattctacaaacccgtgaactttctaaagctgtactccctgcatatttttagtatgagcttcctgaaaatagagatgatgccatttttatctttccctcyctcccctacsagtgtctagctagttcttggcccataaaaaaacactcagtaaatgtctgaatggataagtaaataattggttgtggctcatgagacaaagataatttgaatatagtttcagatgtagcagaactagatgaagagaagttgtgaagagtgagaaaggaatatttgtgtgtcctgagtggtgagaattgatttgagagcttaccatgtttgggaaattgcaggatctatggaggaaggccataacctggccttcaccactgaggagcttacagttgagcagtcagcggctccatccttggggaggtgagagagcgtaacattcacttgcttgattgttagtgtaagaggagccagcaaaggaggaaagagttttctctttcggagttgtcatcacctagggcaatcgtttctgatcagtcaaaggcccacacaggtttgagtcccagctgcagatgcaactcatggctgtgttagtgattctgtagcagctgatgaatgcattcctggtagagtgaaccagtgcacaatggcagcaggtgcattactcaggaccactgttgcggtacctcatcctaatgtcacctgagaatgcacctggccttagtaaatctttgtggtaatttttgaagggcgcaattccttgctggaattgaaaacactattgtgagtyactcctactgacacccccagatcatttataaagaccttgagaaagcaagatgattctggtaggctcttcattaaactggcagcaggaggtggggcttagatccagttgactgactagtatggagctcctccttggttaagccggttgccagaagacagaactggaggggaaagtagctctgctcatgccgtctttccatttccgtagaggagagaggcagtcagtcctcctctcagcctcttggcttccttcgtcctaatgatcaccctgaaaggtgcacagtgcacctttgccggcgtgatctcatttaatccttagtacagctgagtggtagccattactgttcccattttacagatgaggaaacatcagaaaaacaagacaacgcactgggggttcygtagccataagagacaagccaagtgagaaacagacccagcccctctggccctagtgtgcatcgtctcctgggtgcctggcctttcctcagctgctgttccaagttattgttagaacaacctcttattccatgaacgtcaaaccacttccttcccctggttgcccgttcaaacctttttgggccatagatagtttgggcagcaaatggaactccctgtgtttacccacctattctttgccccagccactaccagtccagatgggaagaaagatggtcctgggtgggacaccaggcggagaaaagckgggttaactaaagggcaaatcaataattcatacacaaaaccagagtacaaaaaccactgcctccatttattccacctcaaattgccctctggggagtcttgtggtccaccctaaacccaccaagtggggaggtggtggtgggagcgggaacacatgtaactcctcttacaccccatatcctattgtgtagttttaaaaagtcagtgtttatgggctttgccaattttgaatacagtttgtctaagaacacgtgtttcctacagcgctgagagcttaataaaagaattgcaacgtgggggaaggtggcacaacaaatgtaattgttgacctaacaacagagaaaggagcagatctttctaatgagttcattaggtgcttcctaaaagatcccggactgcacaccagcacccacttatgtagcacaaggtgcaactccgaggggcgtcctagaagagctgctgctcttcgcccaccagggagttctaactgtattgtatgcaagtttaagtataataatattggcccagtttgaaagaagttaaactttttcttgggtttctaataaggtaaatggtatttccaccttctcagaggagaattcaaaggtttttttgattctgttttctcagtcatccatttgaggcctggtccttggcattcctcagtgtggcagggagctagctcccaagccacctggcatatgctggccacggtgaagccatctcaacgttgctcacccccacttgtgggccccctgaagttatgcttttgaagagtgtcctaagaacagattatcctatttttaattatgtattgagcccatcgaaaacctggagttgtaaggagaatcatctctaagagggaatacaaacatctccatctttttttctctcccaattctgaatggcgccagtgtgagctagggtagtattcacaccaaggggtggcgtttatctctgcatatgtaaagctgcagtgctccacctgaagggataaattcttggccacttctggtgggtcactactttattcaaagatgtttggggtctgcccattgcctcctgggcaggtggcaggcaactttgtgagacctgcagtgcctctgatccttggtcccagcctgtgtttccaaccttgcctcgcaccaccctaacatgagccccaggctcagcaagggtgtcttctcatggtctcccaaactggccatggtacaagcaattctgatcctttgagacttaagtgcgctgtggatcactgcacccctacaaccgcaaaaaacccaaacacagagtttgtcaagaatttggtggcttcccaggctcttggagccctccctgggttccccttaaaagccctgtctgcctaaaacactcttgtcctgtgcctcttcatgcctcatcctcccagtcatttctggtccctgtgtcactcatgcccaggttggcactcctcactctctgcactgtcgctgcagtgaaactcagccctttcctgccacacctccccatcagcacagccaggtgcccaactcccacctcgggtctcgtgcagcggcccgtgctccgcagatctggctctcacttacacattgccccgggcagggttggtttctaattcatgtgtatcttgtctctgtagtgtgcctgccagcttctccacagctggcctgggtcgtcgtctttgtggcccctcaccgtcccctagtggagcactctttctatagtaggtgctcaagaaatacattttcaactcaattgaagggaataggctcccataacagaatgaactcatttcagaagttcattaccaagtcttgaaaacctttttttatagatcctcctggaccgaatccagctctaccttaattagcaaagcaatttgcaacaccctttcccaaaagtgcttatgcgtccctttgtgtgactagaataggggccgctgtaccaattgctgtcaccacccaaaattcaatttgcaaaatcgaaatcagtgcctgcagcactgatgtagatttgtatgyataaaagtttaatatggtaaagagaaatttactgacgactgaacaggggaaatgcaaaaggagcaaaaatagagctataaaggacactcgtcagatgaacatctattttattcacatttggggagcagtgctgaatttttcataatgtccccactgctgccttttcaaacccagcactgctattagtcctaaaacgtctgtgatctcattaggtgtgaatgcaaaatcaggtaatttaaagcatgtattaagaatatttctaaaaatgcaccgtccatttcatcagaaaaactgcatttcagagctcaggaatgttagtgctggagtctgtgaataaagtgtaagctataggaacgtggtgaggcttctggaattcgacagatgtctccactgacatccttttaagtagtaagcatgacttttttaattgctgagcttgagttatctgtggctaggaacccagcattgaccaaggcttcatcactcctcaagcagtaagaacttggctagaaatgggcatgtctcaaactcctgtcacctccactgagctgcttttacagcctcagttagacaccttctgacctcagacgggaaactggatggcaagtctgttttaggactcaggtgtttggttttctttctcaggttacagctgagtccaggaattctgggaactctctaggagactgtctctttcacacaggaagtttcagaagtgagagtggtcgggtgcggtggctcaagcctgtaatcccagcactttgggaggccgaggtgggcggatcacaaggtcaggagattgagaccatcctggctaacacggtgaaaccccatctctactaaaaatacaaaaaattagccaggcgtggtagcgggcgcctatagttccagctacttgggaggctgaggcaggagaatggcatgaacccgggaggcggagcttgcagtgagccaagattgtgccagtgcactccagcctgggcgacagagtgagactccatctaaaaaaaaaaaaaaaaagaagtgagagtacctgagggtcactttgctttttgcacttagactttgtacattttgctcttayaggagcagcactctgcaagggtgacccgccccccatgcccctcctgtctgtcctgctgctcatcagggatgggactacgtggcaaggaaggacagcaccttataccacacctgcttgagggtgtgatacaaggttgctgagcagcctactggtgacttctcactgctagagaagttggagcaggaagggaacttgagttgaaaggtatttgagggtggggatctggtcagaatgcaggtttatcaggaagcagtgttaggagcccaggagagaggcagaggctatgggaggaaggcagatcagcttgtggactcctttcctaagagcttggttgggaaggtggtggggatggtggcaggacgggaaggtccagataagcggccatcaggtgaagaccaggtacagcaaacagctgctctctcggcagaccatggagagctcagtgactgctgagagccaccagggtcagtcaggagtgaagcctcagcagtttttcatccttcctcacttccgtttccagcgccaccctcggcagtgcacaccagccatgctgatccactggtaacatgctgacccattccctgggcacgggctccacctggtcctgtgcctggagcaccccactcccttgccggtacatgcgcccatcctcagccactcattgtccagcacttcctgcctggccccgtaggcccatagcaccttgtacatgccccttcattccactcccaccagggtggttctgaactgttctgtcctttcccctcttattttatgagacaggggcctgtgtttactacaactctttactactaataactgtgagaaaaactaatcgctcacatttatcggcgttccaggcccggaattcagagcagcccaagcgtcamctcatttatcctcacaccaccggggacgtaggggctattattatattttcttttaaaagaaaggttaagttggccagtatgctttaaaaatgttcagtgcatgaaagacaaaggccgaggaacggtcccggattaaaggagactaaaagatacatgactgttaaatgcagcaggacatcctgtttttccatagattattattgagacaattgacagaattggaatatggactgtgcattagataatagtgttgtatcggtgttaagtggcctgaatttgatcattgaactgtggttatataagagaatgttcttgttcttaggaaatgcacactgaaatattatggggtgaaggggcattatgctcctactttcaagtggatcagaagaaggatatgtatgtacagatacagagaaagataaactgtggcaacttttttttttttaagtgtatttcatggggaagagtgagtggtttgcctgacatcacatagctgataagggatggtgccaggagtcaacccaggcagtttgactcccctgctccctacagccttggagatactcattcacccaagcgtcccctgctcatagatgggccaatcatgctatagggtctcgatgaatgtctgttaaatttataagtgagcgcactttgggaggccgaggtgggcaaatcacaaggtcaggagttcgagaccagcctggccaacatggtgaaagcctgtctctgctaaaaatacacaaaattagctgggcgtagtggtgggtacctgtaatcccagctacttgggaggctgaagcaggagaatcacttgaacccaggaggggagtttgcagtgagccgagatcacgccattgcactccagcgttagctcttggctgtgcgtgccctgctgaagaaatgttccagatgtgttcgcccagatgtgtgcagaattccattctaatgggactttccctggacaagctgaccagcagcagggagaccacagcctcatattttccattcattctgtccactcagataatgactttattattcagcaaacgctggccacctcctcaggccataatccttcctcttctgatgtatctgggtgtacattctcatgatgagtagcctgaacgcaggaatgggtcaggtagaactaaatgatggattgtcttttttgtttgctgtaaagtagggacctcatttgacatgcacagagaggcagcagtggagctgcctattaaaccactttactactgatttatttatgctctgccttctccaaggaaggatttaagttaggaaaaaatccatcatttgaattctgggggaaaaaatataaaagagaaagttttgttctggggagcttttcaaaattcttggcagaaaaatataaagaactatacataaataataggaaggacagagtaaagggaaagttagaagaggtgcaagagaaaagaccacacctcctctgtatgctgcctgtctccctgagaaggtccagcaggggcactgctgtctctggcaccagagaattgacttacatcaccctttctatggcaaggcctcagtgttctgggccatctcctttctagcaggacctaactgtggtcctggcttggttctcctcagtttacacattttatcttaaatgttgccttcttcatgtttctttccttcttgtagagtttcagcagctccccacttatcatagattgagaactcagatgattttttttttttttgcctttgctaaaagaatctgttggtctgaggccgggcatggtggctcatgcctgtaaccccaacactctgggaggctgaggcaggyggatcgcttgaggtcaggagttcgaaaccagcctggccagcatggtgaaaccctgtctctactaaaaaatacaaaaattagctgggtgtggtggcacatgcctttaatcccagttactcaggaggctgaggctggagaattgcttgaacccaggaggcggaggttgcagtgagccaagattgcgccactgcactccagcctgggcaatagagtgagagactgtctcaaaaaaaacaaaagaatctactggtctggcctgaagcatcccacaggattcctgcctcctcttccttgctgacggcatctcctcccccaggaaggcctgcccttctcccttctgcttgctgaccttctgcttgctgaccttctgctgtgcttccttcagaacctagcattgtctcacttccatcatgcactgaccacttgagcatgcggggactcccccactgagtccctgtagcccactctgcccagcaccccctttgttaggcacgcctttccaaccttacatttctattgtggcatctcccactgcagctggtgtcgtggctcacaagtcacagatgctcaacaaatgcttgtttgctgattaattgatctgatttttctgtaggttggggagttgatgaggcagagctatgcctccaaaaagtagtttctaatagcagagctgtagtccaggtttgcttcccgcagagtggagaagccagtgctagctgcaggcctgcttcatgtgaacgctttattaagtatggtctttcctcaaggtacagacactgtgggaggcaggactcctttgctcacctcctttgggattctttgcttttcaggttgcagagcctgaggcctgtgatcagatgtacgagagcttagcgcgactccattcaaactactacaaacacaaggtgagtgggccacagtcttttatatacccagctttctgacgggacaactaataagaatgagtgaaaatctgattaggtaatgttttgtaaagacttggctttgctgcgttcaaatgaaaccagtaatttcaaccaagccaacagaggtgcctggtagaggcttttaggccacctaaataaaagctatttaaaattgtgaatatagggaagaaacaaaaccaattatgaatagaagccatgtatttgatatgccagtgtgtgctcctgggaatgtctgacagccattggatttatacctattttcccatccactctgacggaactgacacctccccacattctggtgataaagatgggatgattgggaaagtgccctccttttacggagctgggcccaacatgattactgtcaaattccatttagagtggtttttcccatacttgaaaaatatgctcattaactccacaaacatttgtggccatatgcctatgtggaaaattgatkttttctaaatcctccctgctaacatgtgatccatgagcagcagcatgggcatcacctgggaactggttagaaatgcagaatcaggggccccacccatacctgcgttttccagggaggactcacgggtacattatagttggagctgcctcctggagactgtactggttcttgcgaggccaagtcttgacctcgaggtggcgctgctcttctccttgctaggcctcctggcctctggttgcccagggccyaggtgaaatgcagttagagagcagggcttgtgtgctgatctctcccctcccttcacttcctttctgccccggtgaccagtaccctcgccccagagacaccagcttcagtggcctgtcgttggaagagtacaagctgatcctgtccacaggtaatgaaagcacagctgccttttctcattggtttgcaaatgattctgagtttgagtggccaaggggaattgtctaagaagacagttttgcttgatggaaagtcttgtagaacagcccagaggaaattctgaagctacagggcgcatgcattttgaccatatactgtggagaaggtcaaaggygttatttaaaaaagaaaatctatctttagggcttttaaattcaaggctgggcatcagggaacagaggaatacatatttgccaaatggaagtagttgaaatcaggatggaaggaaaataattttatttttatggtcttaagagggctttataaacaatgaaggttttaattaaaacaaaaagccattcaataaacgtgtttggggatatccgcctaagagttatgtgacccaggggacgtggtctgtgggttagatatgagtttaactaggtatgttttagagtcattgatagactctgattatcaagaaaggaaacatcctgccaagcccgtcctttccttacttccctatctccattgtccctaaggaggggggccggagagccagggatgaagtaggcaggtactggaaaattactatttttgttgccaagtatattatatacaaaaataggttaaccttttctgggagggcatggccctgacacatttccttctggtattctagaaatgtgtctttcctcttcttctggcagccttcagcaacttaagttttgaggatttgggcttctagaaaactctcttctgagattaaaacctggtggtgtcacctgctattacatgtcaactctaaccctatttttattccagtactctctgggaaactgtggtgaagatattttggccaggcagaatcactttattggcaattttttttaatgtgtaaatttactcctatatccctgggtccgtgtaattagcagcattgatgcacattattgtgagggccctggacagtttgagcaaagtttgaacttgaagtgagggcggaagtaagttccagaggccctgcctctgccctctgttttgttcacctcagggcagcctctgcaagtggaaaacaggcagcaacgaaggctgsgagatagtcccgccattggtccgcgctgcagcttgttctggcagcgagtttagttcaggaaatttgctgagaatttgttttcacagcaagcctcatatttttgttgcaaattgtgtggcgtaagcttaccaaatgtttcctctgacaggacaagaaaagacctgcagcaccttgtagtgagaggctttgagggcctggcaagtctgaaatgtgctgtgttctgggttatgtgtgtgtccaccctgggattggggtcatggaaagcgcctaagggaggcctcagtgtccacctggacactggaaacatggacttctggaaaagctccagagcaggggcttttttctgttaccttttttggtcagaaaagatactctttttttctccagtagttttgttaacgtgaaaatttaggctggtaaagcaaaacaatattataagaatatctaaaatttaacatgcacgtaaaattagatttcatggaacattagccctagagactttagacaaatggttccgtactggggggatggttttgccccccaggggacatgtggcaatgtctggagacatttttagttgtcacaactggtggtgcgggcagcggtgctactggcattagtgggtagaggccaggatgctttgaaacagccttcagtgatgcacaggccagcccacgacgaaaaattatctggcccaaagtgttggtagtgccaaggccaagaaaccctgctttggttcctgggtgtagggacgtgtatgttcttaaacaagagcccctcccgcctgcattgtggtggatgatggctgccttttcattgagtgcgggctgtgtgccaagcgagttacctccatgcttttctttaatccttacaacttttgaggtacgtgtggttttttttttcttactttttcacctctccccaagttgtctgcagatgtgtgtttttatcttcattttacagatgaggaacccgaagcgtagagggttaagtaatttgcttgaggggacccagagtgggagatgatgggctcggattcaggcccaaggccatccccctcccagtgcctgctcaactccacagcatgtgctgagtccacacaccaggattcaaatccctgctccacttcccagctgtgcaacctgagcaagttacttcactgcctcctgcctcagtttccacacctgaaaactggggacaggaagggctgtgtggagcaggccaaattttgcgatgaagcatctgggtctgtgggttgcacagcggacagcgcagggccatttctttgccctcatacggagcagggcaacgagcagcacatcccgctttgatgccgagggtgaggagagggcaggagaccactgacagcgtgctgggcacagagtctggcacacagtgctcagtccccgcaagcggtcacttctgttacctgtttgatctgctcttcaggagctgggtctccacctttttcaggaacacactgtgtgaaaagcaagccatgcttgtgtcgggaaagcccagtgggtccaatctatgtcatcaagttttagacttcagtccctctctctttttgtcttccccttttgcagacaccttggaagagcttaaggaaatagataaaggcatrtggaagaaactgcaggagaagtttgcccccargggtcctgaggaggatcataaggcctgagctcaggccttacctygtgcacatacctaggtgtggagtcttgtacattgccatcgtcaataaaactgccccagtttccccttgaccttacggtttgggaatctcctctagytttcccagaaaggaagcccttgctgctctaaagaaagtttcagcctgagaagggatggtgattgagctatctgctgtgactgctgctcagggtagggaaatctcctggggagaggaaatgcaggtttccctctgggcctgatgagggtaatggggcctcggcacaaggtgcttcctgcattgccacgggagcccccgcccctctggcacgggtctggtgtctcctggcaagatactcaggctcccttttgttgtaggagctcctgggaggaagccaaaaatagcagtaaatactgaawagggcatcctgttgcaaasagaaagcagtagggaggtgtgaggccgagagaggcaaaaagcctgcttggccctcatccccactgactcagagaaggatggaccttaggcctctatccctgaccttgcaaaaacccacattgcccagttggcttaagggacagggaagctatagacaggccttggccaagcggggcctcagctgcagttggcttcagcactgtgggcaggttctgtaggtggccacaagtcagaggccctgctggctgaggacacacacagggtcacctcrttattccatggaaccttggctcttactgatattgagcatccttctctctggaaccgtgagggacagggctgggcccacagcggccctggtgggtacaaagtggaagtgggttcttaacctcgtctgtgtctagactcctcaggatgttctgaaatgcataaaataaaatcgacaggactgccgtagaaaccagttatgccgaaatgcagttctgggtaggcaaatctcaggggaggacccttgagacaggatgtcactcagcgtatctcctgagagcctgagaggccaggccagcagggaggggctcttgttcctgtcttctgccagtgtgtcctgttaatccccacagcccccgggggagtgcaggaaacacatccctttttaacggactagatttctattaatttatttaaggcaattaacatattagttctcaggccaaaggatttgtaaaacattacaccaaaaggagaaaaacaagcggtcatgaaacagccacgcaagcgcagctcagcccttgttgcctgggcgtacaactcttccccaggaagcctgggaagaggcaggtcctgggagcaagatcgtccatcatggagtcaccaggccacctggagccatgccgggggtggcatggacacgacagtgaggtctgcactggctacagcagatctgaggcacggagggagctgcacagccatgggcagggctgagcacagcacccttgaaataagttaaataacaaagccctaaaatcactagtaacagcataactgccacctcccccagaggccggcagccgccaaaatgtagtgcttggagttaaaggggtgaccccactcttaactacccacaaggaggactacaaagagttgtcagttattgctttaaggaacaaaggtctctaggtaggatttatcttctgctaaggcattaaggtaaactgagtcccagtgaactttcaagtctttttaagggctctaagcaggactgtcagctctgaggctccccctccatgctcttcaaagcctgggtgggtgtcagggtgtctggcagagtgggagtggaggctggccagctggctgggccacccaacccgagggagggggcagtgttcttcccagtcgcagtctccagtgatgagcatcccctgttggggccttcggtggctctcctcagcggctaatgcagttctggacatccacaaagcctaggcgttgcctgcgtttccgctgctccgtcatctagggttaagcagatgccaacaggcctggtcaggccgcctggcaccttccctccatgggtgctgtggaagagcttggcacccgtcttcccctgtgggcccagctgctattcggcactggcggcgggccagggcccctcggggtgctttaaggatgtcgatgtcagcaccaaacccttgttctcaattagcgtgtcacaaaccctggatttgatgcagctgggaaaccagcccactaacagaggctgcctcatcttcatgcaggcactgccagatgcagaagaggatgtctaggcaagagggccttaaactcccccatctccagtgatggggatcccctcaaaggacctacctggcagctgtcagaggaaggggatgagagacagagggccccaccaccctgtactaaagtttccacttggccttgtctttagtggcccaaggcaggggttgtcaaccccagtctgacttgccatgcaggggagagtgggtttggcacctgccttctcatccaggcccagggccagaggccagtggggaagagggtgggtcaggaaggatgaaggcaggcagggactgcccagggatagaacccagggtgggcctgggatcaggcggggtgcacacctgctccttgagctcgttgagctgggcagtgaggtgggacaccagcttcatggtggagttgagcttgtcctggagaatccgaatctcattctgctccccctcgccctcattgctgacaagggacatggcccgcatccgggggaaccagtccaggttcttgttctgaaaaacatcaccagtgggttaagcaggcgtgggcccggcctagaaaggcctcatttagaaaaacagtaatgtggggggaggcttctgccacacccttaacaaaactactcgtcagggatgtgtcatgggaaaatctgaattgacctggtcctccccggggccagagtgagctggcagtcaaccctcttgtcaaccctctgccaccgagacaggctgacttccgttaggcagcgtcggcagctgagtttgagtcctttgctggtatcagcaccatctgtttactctcataacaccccctgagaggtggaggaaggcctctgcacccagacagaccctggatctccttccttccttcctcccgcccgcctgcctgacaagcacgccccacgccccgggaagacgcgagtcagacagatggcaaattgagggatcaggaggctccgctgaggagagctggcatctgacacgtgtctgggaggcaaagccacgtttcccaggacagaggagtcggggggggagggggcaccaagcaattctcagcttccttgtagtaagctgtgaattctcagaccaacagataaacctgtacacaaagatcagtttgaaatacagactaaacgataaataattccttctttatgattcattgccttcactccattattacagaaattggacagatgacatttgatttctgtaagtgatttttaaagtttttccaggctccccttcagcccaggatcatctaattcagactttttaggaagcagcctgccttcccaccgagctagaaaacactccctgagagcggcccacagatcactggccacgggcagggtctccccaactccacccctcctcagcatcactgcacgacaggcccagggataccacacgtgttcttcggggcgcatgggtttgctgtgggatttttcctgacacccagaagtgtgaggaggcccctctgcagcagcggcttccgtgcagcccagagctgcttccagctgctgctcctcgccctgctgacctttcaacaagtgtctgcagctgtccgagcccctctgcctggcctcctagggccaacagtcagatagggccactcctctccagggcccagggtactcagaagctaaaaccatgaggcctctggtgcacagtgatgactctagaatggctggtttgggcccacaggcctggcacagcccctgctcacaccttgatcatctgggccacgtagctctcagggcccgtgtagtcggtcttgttcttcacgcggaccagcacaatgaagtacaagtagttccacatgttgtgctccagcttgatgtgttcctcaaatgacactgtcttgttatcaaacttgtccctctccagacctgagggtgcagagggcgggaatgaaaccatcagccttcaagagccactgcagggtcacctgctggaggggacccagcttccgggggttggaggcatttgttctcgggatgagcgcttccaacagctcgctctgggctatttgggtcacttctatttaaagcagcagccacttagtggagatcctgccctgccgcagctgcagccctcccgcagcagcaaccgaggactccaggagtaaacgcgagaatttctcgaactcaggggaagcccgaatggctgaatgagcgaggtcctacaggccatacaggtgacacctgcctgagcccgaggtggctggtgaggggactagcacttcatttcaggggtaggaaaagcactggactgagaccagaagctccagacactgactgggctcatgtcctcacctagaaaccccaagggtttacagggatgggcctgtcccactcctttctgactccaagttcaggcagggtcatgttctccccagttctgggatgagcaaatgcatcaagtcatcagctccgggccagggttccccagggcaggaagggccaaaccgctactgccactggcatcagatgacgttccagccccgctgcggcctccacagagcaggaagcagccctcaccacagatgaagcatgtcgtcttaagaatctcctccttcttctgcttctcactacgcaggtcagcgaaggtgtcgatgattaccccaaagatgaggttcagcacaatgatgatgacgatgaagaagaacaggaggtcatagaccactcgggctgggaagagagactcctgcaggggatgaggcagggaggctgggcccggtggtccccacattcactggggcaagataggactcaggttggggccagggctgtgatattggggacccagcccctagcagaaggaaatgagggcctctggcctgggggccatcagatggcagagtggacccaacctggctccacagagcaagaattgcaagcagaagccctgagtttgggttaggaaagcgtggactcaggacacgccggggtggaggcctgcagaaggagtctggcggggaggtagggctacgagtctcggtgtgtctctgcccctaacattgatgagggaaagaggcagctctgaacacctctgcccaccctcaggacgcctggcctcacacattccagaaaccctctgtctggccagggaggcggcctctcactcccaagcaacaggggaaggcctgacattcgggaatgtggctgcccaagccaaatcatgaggcctcctgataaagctgactcagctccgccctctgcccacctgctgtgggctaggaaagccagtggtcaccatccctagccctggggcaaagtttggttgccaaagtctttccttatggaatgggagggtgagggggcagctaagcagtaatatcatggaattggccaggtgtggaaagcagggaaaagtggatacaagttcgggggagggggttcaaccctgaatatctgacgcgaggccaaggacaggactctccacagttgctgatctggacagtggcttgggccccacaggtttgggagtgggcaggagtgctcacatctttggagggcttgcggagaatgtcgcccacgccaccaccgttgcgtagcccatggttcatgacagtgacgatgcacatcaacagagtgtcacaggcccgctctgtgctgtccagctccctgtcctctgcaagcggagagtgtgctgaggcccgggctgcctgctcctcctaccccacacagactcctgcacacacaccaccctcaccttccaggacctcaggcaccgagagccctgagacacagtccatcttgtccccactgcaggtgtccacaaatgcagcagctccatgtggcatccccagggggctggctggaggggatatggatgagatcatcaggaggtccagtgcctggccttatcccctggctctgtccccagtgtcacatcctccaggaaaccttccctggtcctggatcgccagccctccactgtccagccacagtgaagggtcatcacgcttctgcccccgactgggttgcacactaagggcagggaggggtctctgtacccctaggcctggcacacgggcagtttctgcaaatactgggtttaacatgaatgacagttcaagggactccagccctcaagcaaggggttccttaggggccagagacccaaggctctcccacccactcagtgtgttccagaaaagagcgaggcagactggtgttagctagacgtccccagaagccaagaggagaagcagacgggagcctggtgaggtaagcgctgcaggtcctggtcctgacgccagacatttgtgagacccaacctcattccccacaacctgcccaggagaggaagcctccaagacctgtggagtggttgttgggcagccggtcgacctcgagaatgaagtcatccttgaggaagaggaagccgacgatggagaagaggtagaccaggatgagggccagcagggctgtcagcaggatggagcggccattgcgggtcacactcttgatgacgttgaacagcgtctcctcgcggtagatgaggtcaaagagctgcaggatggggttgagatagggatggcaccttgaggggct

SEQ ID NO: 18006 - DNA, 22463 bp, Homo sapiens
tattgtgcagttagatagtaagtgctataatccaggaatatacagtgttgtgtgaataatgtggaatcagtttatctccagagcagaaaaaggtgaaggccgaagaaggcattcagagtgatactggagctgtgtagcaggggctactactgttccctcaaatcctttcttctcttcttcctgagtaatagagtcctttttcagctaggcatacagccatccaaaataaaaactatatttcccagcctccttttcagctaagtgtagccatgtgactaagttgtggccaatgggatgtcagtacaagtggtaatggcaatatctgggatgtgtctttaaaaggaaggaacatgtccttctccttttcctccttcctgttccctgggaggtgaacttggtagctggaggtgaagcagctggaacttggatatgagcgtcttgttgatgataatagtgcaacaagataaaagcagcccgagctggcctacatttacatgagaaggaaataagactccattttgtttaagctattctcttgcatatatatatacacatatatatcagctaagtgtagccatgtgactaacttgtggccaatgggatgtcagtatgagtggtaagagcagtatcttgtatatatatatgtgtatatatacacacacacatatatatacatatatgtatgcaagaatataaaatatacatgtgtgtgtgtatatatatacacacatatatatgtcccttgcagccaagtctaattctaactaatacaaactaactctaaaaaatgaatatatattcaccaggggataggctatttcaagcagagggaagcctgtataaaggctcagggaatgctgtggttttatgtggcagcagatgagactggaaatgagtcaggatgagccacagtggaggatgaattaaatgggcaggagtgtggtagaaagacctgttggaggctatgaatgcaatcaaggtgacagacaactggtgcaatgatggtagtggaaatggaggagaggggattgattcaagatgcatttaggaccaagaatcgggagcttgtgaacgtgtgtatgagtactgtagacggagtgggtgtgtcatcagagaagatctgagcatttgggcttgctctcctcagaggccctgcgagtggagttcagcttttcctcatggggcaaatcttactttcgctccagttcctggggctcagagtccctggcccagatgcctcttgccatctcatcttcaccctgcctggcttcccttgcttgttccaggattgtttcataaagagggatgtggttggtctttaaccctatgaatgctggctgaggatgcctgcggaacctgtagtgaagctttcaggggctgctcgggttctggctggtaggtgaacactgtccatcttgccggctgggacacagtgactctgggtagttgtgtaagagaggggcccttggcagacaaacaggttcttctctgttggtgggccagccagcaggtcagtgggaaggttaaaggtcatggggtttgggagaaactgggtgaggagttcagccccatcccccgtaaagctcctgggaagcacttctctactggggcagcccctgataccagggcactcattaaccctctgggtgccagggaaagggcaggaggtgagtgctgggaggcagctgaggtcaacttcttttgaacttccacgtggtatttactcagagcaattggtgccagaggctcagggccctggagtataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcagataatggcaagcatggctgccgtgctcacctgggctctggctcttctttcaggtgggtctccgaccctgacttcaacgtgggggtgtgggtggaggctggccagagggccctgtccaccctgggggaggagagcccaggccctgattacctagtccctctccacagcgttttcggccacccaggcacggaaaggcttctgggactacttcagccagaccagcggggacaaaggcagggtggagcagatccatcagcagaagatggctcgcgagcccgcgtgagtgcccaggggaaggggtgtaggcgaagggaggagacagctgggccatgccatgatgacctgcctctgctgcctcaacctctgtggccgctgctgggacagaggaaaggagcggtgctagctctgtctgcagatcccggccatcctgggctctttagcgccctctgcctgcagcccccgccttgacaactccgtagctgttgcccccttgctcactgaggcgcgggacctgggatcaatcgggaggacgcccgctgcagtccccagaatcaaaggatgatgtggcgcatctatgtttctttggagagtgttgtaggtctggatttgtatgggcaatgtgtttgtgcttcgtgcgtgagttgttactggccagggctaggacaagagccctcgaccctggggccaacgccctgcgtccttggttcccccagaggatcagtgcgcgatgacttggggacaaaggagatgatgggggctagcagtctgacggcctggatatctgtccccttctccaggaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcatatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaagtttgcctggcgtgactctcatttggaccatgtctgaaagcagtggcctcaccactatccccaaagcacacccatcacccactccattcccttgctgctctttctcatccacccactcccagtccaggtctgtcaaagggggtctggctgggctctgcttcagggatcctggctagacaacggctgtctgtcacacctggcaggagggcctgggttacgggcccttcctctgcacctgcactgttcactagcctgctcccccacaggacactgtgcatggaatgcaggctgtgtctggaagagctgtggccctggtggacctaagattcctgaggtgggctgcctcctttgttcctgctgttctagagtttgaatggcctctttttatgccggactctcttctggggactcccctcactcaggggcaccaatgctccctatagatcccctgggaactgaaactggggtgtggtggaggacgtggaaagggtaaacacagctccttgtctttggacttccctgtccggccccctttcctcccagctcagcctactgtccccgggttctcagcacctgcctgctccccaaccccatagcacagaccccacacatatgtaggctcatcatgcctgcaggctggtcttccctgacaccgtggattttgacaatgttggcaacagaactgggttgtggacccagcacctggagagaggaagtgctagaaaggtagaaataataaaaggtgtttttgttgttgttaggaaactggaaaagcataggtcaagggctatgatggggatgaggaggtaggagtgaaaatgagggctgtgtacttgaggctgggattggggaaggtagtgatgaggacagaatagggagtgggaagaacagaaagggacagagggattcagggattgtgagagaggggaagaggctgagccacccggaggggcgacctagcacgcaagcagtatgtggcccaacactggaaccaagcagcccggctccgggcgcaccttctcagggattcctcagggacaagtccagccccttgtcgtcaaggctcttgtagaccgacgtagggaccaatagaaccccgtgcggtggagctattgtgaaggagcaaaaaagtgccctggttctaagaggacgtcttaggggaagtgacggctgagttgaggtggatccggctggcgatgtaaggttcgagccatataaacccgggaaccgggagcccttgacgacattgttccccgagtgcccggagtctgcggctttttttggggtggtggcagctggcggaagtgacgggagaggggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgtgaggcgggggcgcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggmggtcggatcttaaataaatccccctatgtctcctagccttagtttcttttgtaaaatggtactggtgttgtcatcagctcaagtgagatamgatttgtgaaaatgctttgtaaatgttgtctgagggtatgaaatgagcagtagttgttatgaatagtattctcaccatttggacagcctggctcacaccacctgtactattcgaaaggagcagtctggaccctgtggagtggcgagagggagagacagctgggctgcggtctgatggaaggggacggtctggttattacttgaggagaagctgttctgcagtctctttgtactgaacgtattcytttcttcccaggacatgaacagagaagtggtgaagactgactctgctgccacaaggattcctgagctagattttgaaattcctgcctttagccagaaaggaggtaagtttaagatcagartatttgggctgttcgcatgtagctagaatcttaccctctttcttgcaaaaccccctggtgccaggtctagtggtttgtgtatgggttctaccatgtaatcattgtratcttcattagttaatcatgagtggaaagcttaggtaaaacagctcgagatggtagaaagtaatggtaataccatagtgtgtttattgtagaattttagcatcaytattatcagacatgaatggaaccttgcacctggccttctcattttayagatgaggaaattaagacccagagagttcaagtgaattgcccagggtcatacagggacttgatagcagagctgaggctaagtcacacttgtcttttgttcttgttcacaagctctgaccactgttgaaggattgatcacccgtgctatctctggcctggagcaggaccagcctgcacgaagggtaagctggggttttctgattgtagcagctcaaggaataattgcttatatagagtgtcccatgtgtctgaagagtctctgactaagtgttggaaacttgctgggtaagcatatggtggtgctggagctgctagaatgttgcatatgttataattattgtcttttccacttccctccctcagtatatattcaggcctcatcagacaatataacattacctctgaagagcctttcctaatccccttgggttatctgtgtttcctgagtattccactgcatcttatatttattatgacagaagtaatatattatagctgcatctttagttatttgtctccttaattggttggggagtcccatgagaggactgatatatatactattatatctctaacgtggcatgagtgcctgggctaaatggttgaatgagtgagaaaaatgaggctcacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtctttagcctgaacatcccatctgggagggctcaccctttgtcctcatgttgtgttccaggtgctccagttcagcacaaactgcccagaatgcaatgyccccgctcagaccaacatgaagctagtacgtatcttttgccaagcagttgggttgctcttcatctgactcaggcatgaagattataatcaggctgggagcatccctttcaaggaaaacacatgctttatacccagtgataaggaagatattatctttgattagactgtgtaccttgggttttgtgttcaaagagaaaattaggccatggtcactaggctgtgtgtgtgtgacctgagccatgccttcaaatgtgtgaacagggattgccatgggttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatgaggtgggtgggcgccattatttgggaagaagactagcttaagggtaacccccttttaactatcattcttcctaagtacttcagtactcgggggcagggggtgtagagtagcttgggtctttttcttaggtctagtgcagggtgatgagcccttgaaggaatgggaattagcctagagaagaaaagttagagattctataacttgtttaagacatattaaaggttgatgatatggaagagagaagtcttttgacccactcctcagaggtgtggaagttcagggaggcagactttgacttcacaatgaagaactcaatagagctgtctgaaaatagaatgagctgccttagagaattataaattcccttcccctgagtgtatctgagtataagctaattaaattctttaaccagaatattataaaggagacccacacattggatgcagtggatgaaaggactgcaataaatgcttaaaagtctctttcaaccccaaaagtcttttttttttttttttttaaggkaaattcagagtttattggcaatttgggataagttttggcacgttaccagggttgggcactgttcctggccagctcttggtgtttttggtttgggcgactgctgtttagaaggctmtttctttggtagctattaatgrccctaactgattggatgtccaagcctacactccaggtctcctgggtaccaagtgaggctcaggtcttctctctgttgctcctgactgttatcgatgcaggtgaaatctggaggagcagtagaacccttgggcaccaggatcaccctccacatcacagatgcctcagatatgaccagagacctcctcaaggtaacagtctgcttgggaaagtcactgttgtcctcataagttagataaactgtctctatctaggggaagttgtcttttagaaataaygttcagggacatgaggtatctcctacttccctggctttgaggacccctgagcagagggagttaatctaagattggaattgcaggtttagaaggtgaccctgttagctctttctgatgacctggtagctttttggcctccagtgtctatctgggtcctcttctctgtctgtcccctagtgacaggatacctgacagctcgaagctatgactgagtttccctttattaagttggatctattcccgtggttcagatggacaggagtgagtctcaagctttaacaagggagtcagagaaaactgagacagctgcccttgtccgcagtctatcactgctggtattaattgggcaggaggcctctggttggctttctttgcttctgacttaaagcttaaactracctctcatttcacagtctgagacttgcagtgtggaaatcccagagctagaatttgaactgggaatggcagtcctcgggggcaagttcaccacactggaagggctgctgaaagacatccgggaactggtgagtcacttgagtagtgtgtaaaccacctttgagcaatttggctgtgtgaagagggactggaagacttcagacatcctaattttcggtgctggtaactgtgggtttctttgccttaaagctggtttaagagacttaaatattactttggatggtgaagacaagtttatgggaaatgttgaatggaaattccaggcctaactttgggactttatagttattttgtggtcttggacaagtcatttattttactgtaaagttaggggatgagggtccttctagcacctaaaacttcccaacataaaaaacatacatgtatgggttgacttagcccaaatrtttatctccttgatgaattatttcacttgattctctgttgggcattttgtatttgtaaattgtactttttctttgcatttcttctccaaattagtatcagagatcatattctaagaacatgtttcgattttgttttacattgccagttttgttatcttggcacattatcccatagactcctaggagtgactgccttggtcagaaaggtggtgtgggctaaatggaaaccaagtttccctgacagggcacccactgtcaccccctgcctagtttatggtcaggcctaacaaatataaagccagtattcacatagtttggattatcatttattgcaggtgaccaaaaatcctttcacactgggcgacagttccaatcctggacagacggagagactacaggagttwagccagaagatggaccaggtaagaggtcactggccagtcagtacttagaatcctggggctccagtgaacaggaggctgcatgctcatgtcttgccactttttgaacatctaaccatcatgttggggattcttcttctggttttcttttcttttttttttttttggagacagagtctcgttctgttgcccaggctggagtgcagtggcgtgatctcggctcactgcaacctctgcctcccgggttcatgcgattctgctgcctcagcctcccgagtagctgggattacaggcgcacaccaccacgcctggctaattttttgtatttttagtagagacagggtttcactatgttggccagactggtctcgaactcctgacctcgtgatctgcctgcctgggcctcccaaagtgctgggattacaggcgtgagccaccgcacctggccctcttctggttttctatattccatgtcttctttcttgtttttctcccttattttgttagagcatcttctccagtagcttcctgggaaaaagtgcatgggaaataaaatttctgggaccttccacatctgaacatgtctttattctrttatcacactagagtgattattggctgggaatacgattctaggatagaaataattttttatcagaatttcgaagactgcactatggtcttccagtttggtaaagacattgtactatagtcttccactttggctattgagaagtctgaagccatttgattcctggtcttttatatgtgacctagtcttgtgatctcttcgtttcctttgatgtgaaatttcagggtgtgccttggtgtgggtcagttttcatccactgggctaagcacttggtagatgtattttttcagtctggaaaactcatgtggttcagttctaggaagctttcatgaattattctattgaagattatcttttttctgattttttttttctgttctttctgaaaactcctgggttttagatattagacttacttgtctggtcttctataatttactctttttttggtcctatttttggtttcttggtttttttgttcttctttgggagattccctcaactttattttccaacccttcaattgaggttttcatttccactaaaacttttattttccaaggagctttttaaaaaatagcatcctgtcttaaggatgtagtattttttcttcttgaggattattattttttaaattttttcagcatgcagtttatatagcacttattgatactgatgttggatcttttttgacattttattctccttgcatcctttttttccccatttgatttcccatctttcagtgttaagggctttgctcagatgtctgataatcattgattgtcttcttacaagtagcgggctaaagacctgagtagggggtgagccttgttgacmtggggcttattacaggggaatttaacttagctgttttgctgaggtggcctccaatgccagaattgttaggtctttcctcttgggctagtcagacaaagaggctatgcctgccagacaagaaccaacccaatttatattacagaatcctccaaagttttaagaattggtgaaattaggtagctctgaaagtagaggggaaaggatctaaaataaggactgttagaaaagccaacatcagcaagctgtggaccagggggtgctggcccagttgaaggtagagggaaaggactcaagaacaaggaggttaaatgactgtggctgctccatttcctggcctgagggtaaagacttggctggcagtgttctgagagctgtgggaagggggctggggtgtgtatgtattctgtttcccataagcttacattcatttaacctacttgttcttgattcctttccctctaccttcaactgggccagcaccccctagtccacagcttgctgatgttggcttttctaacagtccttattttagaacctttcccctctactttcagagctacctaatttcaccaattcttaaaacttttggggattctgtaatataaattgggttggttcttgtctggcaggcatagcctctttttttaaaaatttttctttactttcatttatttcatttctttttttatttatatatatatttattatacttaagttctagggtacatgtgcacaacgtgcaggtttgttacatatgtatacatgtgccatgttggtgtgctgtacccattaactagtcatttacattaggtatatctcctaatgctatccctcccccctcccccgacatagcctctttttaccaggggttatgtaaaatttacttgctgtgttctctctctcctttagatcatcgaaggtaacatgaaggcccactttattatggatgatccagcaggaaacagttacttgcaggtatagtagaccttccctgatgtttcatagagatacattttctgatcttccttgaatatgtatcatttccctagaaactgaaagacttgattctaaatggactgctttttaccaaggaggcagaagttagaagatacataagggagaaaagaggggggtgtgggaggggattttttttttaagtgtatgtaaagaaggaaaaaaaaaggatactctgaggccccttttttttctgtagtcaagctcttgtcccagttctggagttttcattttgcaaatctgattatggattgaggagaaatggtaccttgtccggaggccaagataggaaactgataggctttaagttgactgaggagagagtctggtgattgatgtacctttaccatttattggatacttaccatgggtcaggcaaaactcttctaagttctttccaagattaagaccatttgtcatacttttcataagaaggtgcagatataacaaaataggtggattgttccctgattctggggctggggtcttctacccctggcccatgtgggctctgttgctacccactagttcagtctagccatgggaaattggaggccaataaaaagaaaaaaacccaaaactcattctgttcttgggaaggtgggaattggaagctgcctgcagagagggggagtggcacagcggcactgattgtctctccttgaccttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtytgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccytatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatsaggaaaacagtacatcrgatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaagagatttcctggcagagggaactgcaaatgctagagctgtgaggttagagccagtgggggtacctgatcagttagccctactctcagttagaaatgttgaaacacattcatccagagagaaaggaggctctctgcagttcttctgaaagttaaggaccagtgaacactctgctgcttgggccctggacttcccagccagtgttctttgcactgtagtctcctgcctctcataaacaaaaggtgactcctgtggtgcagactgcagggtatttgttcaataaagaccagttcattgattaagatgttatcacaaaccttattgctttgtgttgcaaactttttttttttttttttggtagagacagagtctcgcgctgttgcccaggctggagtgcagtggtgtgatcttggcttattgcaacctttgcctcccgggtttaagcaattctgcctcagcctcccgagtagcggggactacaggcgcacgccgccacacccagctaatttcttttgtattttagtagagacggggtttcaccgtgttgcccaggctggtctcgaactcctgagctcaggcaatccgccagccttggcctcccaaagtgctaggattacaggcgtgagctaccgcgtccggctgtgttgcaaacttaactctgaagaatgagttagagatgatttagcaatcagacatctactctcgttgctctgttaaactactctcaaaggtcacaagtgattttccacttggaaagtgttatctatttctgtcacatttgatagtggaccatctcttcttaacccttcttttggctctcgagatactgtacccttggttttcccttcactttgaatatttcttatttggacactttgcctcctcccctcttactaaatttgtttctgagagttctgctttcagacatctctccatatcagattctttggcatcttactatcatgtgggactaacttccatacctgtatctctaatttctgtaagtgagggcgagagtaaggtgtttggagactcaggttagcaaatgactcattcaaactataaagcttcagtactttgggcaaacttctcacaggcaactattctaccctaagagattatctctagatatgtttccagctgacttgggaatctaagtttaccagacaaccctctgatctatcatttggtctcttaagtagacttccccatagtgtaggtgtgctctgttaagataaactgcagtatcaggttcattttccattgtgaaggaaaaaaaatggcactctggcttattactgaatctcttgtgagtttggttggtgtgaggcaatctcccagaatccacccagttcctaggaaatgatgacctgagtttctgaacttgaagactgaggaccaggtgccagactgggataacccagctaaggtacttcctgccctttgatgacaaggcattcttcagtttcatacccttctcttgaattatctttcagctcctttctcatttcataaagtgtgtcaggatgggagcttacatatagttaactgagtcttgctccacagcacccagcatatgacacatggttaataaaatctgttaaaatcctccatcatagattaaaccctattaggacactagggataacatctataggtaaaaagatagggaaagggtctcgctttaaggccagggtaggtgagtcaaagtgccaggaacatgtggattcagtttcacagccatgagtaacatttaagtggaaaaggtttgtgattgtgttaaaaaaggaaagtggttcatgcatgagggcacgcctcctactttcatgggtcaagtatgtgaaatgcagccatgttcggtcattagacgtgtggacgaacatacaggtaggtactgaatgtacatctgtgtcatgatgagtggaggaggggaggtgagtgttgggagcaagtatgaagggcagttgacttggccaactgaaaactttaatgatggcaacactttcattctaacatcagtatatttccttctttgtacacctgtggtatgtgcctgatgcacactgcagaaaatggtgtctctgcttacatttagggcagtggtggctaagactacttggctttattcctattaaaaaatgttttttacacacttctttttaaggcaaatggcagtgtttccaactgtggagagaaaaagctgcttattttgtgcgttcacctcagtttagtattggcacttccaatgcttgttttcctagtctgtaaaatggggataattaggataaacaaaattatccccattttacaggtgacaaaacagcctcagagaggttacttccagaaggaagcagagcttttttttttttttttttttttttttttttttgagacggagtctcactctgttgcccagactggagtgcagtggcgtgatcttggctcaccacaacctctgcctcccaggttcaagcgattctcttgcctcagccttctgagtagctgggactacaggtgcacgccaccatgcctggctaattttttttttttttttttttttggagacagtcttgctctgtcacccaggatggagtgcagtggtgcgatcttggctcactgcagccttgcctcctgggttcaagcaattctcctgcctcagcctcctgagtagctgggattacagacgcccaccactgcacccagctaatttttgtatttttagtagagatggggtttcaccatgttggtcaggctggtctcaaacccctgacctcgtgatccacctgccttggcctcccaaagtgcagggattacaggcgtgagccaccgtgcctggccagaagtagagcttctaagaggcaggtgtcaaacccatgccagtcagactctgaaacctgaggtctgaatattttaagctcagctccacaattactgtatttgttctattagatacaactgcagagagaggccaaagctcagagcaggccattggcacggcatctgatcctgcttaactgccctgcagcacagggtggagacacttgggccttgtcaggctaagggactggggtaggatgggtagcagtggaattgaagacaaagaaaacaaatgggcagaagatgggtgggtggaagttcagagggctatcctggcagtgttcactggagcagaagtgtgaggctttctgaatgcctgctgacaccagggtggggcagggctgtgtagtgtgagatgcaccaaattggacgagaagccaaggcaggcttgtgtatggggtaccctggggccctccgcctagtgaagccctatcttctcagcccagcgtcctcgtctcacaagccctcagagccccagcctgctttcctttctgggcctgtgctgcaaccccctcaacatggcccactgggtaaaaattcatgcttcaagactgatccccaagcctgttttgtattatataagtaaagaattttttaaacacttatccccagataatgtgtatttatttataaagtatagccctgtctgcttgactaatatattaaaaaagtgacctttttgactcttggtccaagaaactattgtttgcacttttgtgtagttgtgtatagcatcctgcaaattctgtcagaagtctgtgatttcagtaacactaaaacttctctctcaaatggtacaagttttcagttttaagacaagttctgggaatctaatgtacaacatgttgactatagctaataattctgtattgtttacttgaagtttgctaagacaaatttgcttaagtgcccccccaccgaactactacataaattagtgaaggatgttttacttaatttgattttggtaatcattacacaatgtataattatatccagtcatcacattgtacaccttgaatatatataattttttgtcaaataataaagctgggaagaaaacgataaaactgacaatctaacatatatgatgaggtaaaaagatctggtatttcaagaaatttggatgacctcttgcaccccacttcgctagcctctactccctagagtcatgttctgactatgtgaagttgagcaacttccttaatcttgccacgcttcagttcttatctgtaaaatatgataatgaaacgatttgagaattgtgagggttaaatgagataattcaggtaaagctctaaaccccctgcaaagaataaagtcttttctttccccccaaaacttgagtgttagaattcattctctctggtttctctcttttactatgctaaaaaatgatccaggtccgtccttctcattggcaagattgttttacagtttccttcaagagataactgggggctacttgtaatagaacactagaagagttacacaggtcttagaaactacgtttttcatagtaattatgttggtttgcacttcctggcttcctttcttggacggtaggtacctggaagcctagtggagcagattccccccacttaaagatacttataaaaataacgaacatagttccgatgaccatgtgcccaacaccgctctgcgcacttcacacagtaatatcatctcagcctgtgaccgttccgagttaggtgccgggattctccctgttttgtgataacttgcccgaggtcgtacagctagccagctatggaaccagtattcaaactcggctacgctgcagcccgtggccctccactttcttgctcgtgctctggagtttaggcggccgatgggggcggggtcctttgggtcaggttgtggcctcatagaacagcgcttgctgcggttggatggatgggtgggtgggtgggtgagtgaatgaagagaagaaacctggtggcgtcgtcccagggctgtggagcgccccgaaggtgcgcacgtccctggctagcctgcgagcgcgtcccggtggccgcacctgccagccgcgcgattcttagcactctccgccacttccggccgtggccccgccctgtcgggtggctggcgtccgttacgcgttgaggcattttgtccccagcgccgacccgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaaggggtgagttggtaccggccggggcggggcctgcgacgtctagccaccccttcccaactccgccctcggccgcccggcagttccttccctcttggcgggtctctcggcttctccgccgacccctgctcatgctcagggccccactcacatcgcttgaggccccccgccttgcctctgccgccccgcttacatctcgagcctctgagcagtagcgtcagtgcgttaaagccggggtgtaactttgattactcttttcccgccttggtagacttccgtcctctcccatagagaatgaatattgtgcctcgagaataatggagcggattcaaagcctctgtgcttggatctttagggcccggtacctgcctgtggggattcccagatcccaaggacttggttctgaatcagagacctttgatcacctcctgttactcttagtaatagtcctaacgtgagaagctaacatttatatagttatacttttcttgccaggcaccattataagaaatttaaacatatataagtttatttaagcctcaccacactaccatgaagtgggtattattttcatatgggacaactttgtggcccagtgtagtgggccctaccaaatcgttttccacccagaaccacagaatgtgacatttagaaatagggtctttggagatgtaatcagttaagatgaggtcatacttgattaaggtgggtgccaaatccaagatgactgtttgccttttaaaaagagggaagtatggatacagacacagcaacaaaggaaaaacgaccatgtctagatgaaggctgagattggattggatttatgttgccaaaagccaaggtatgcttggggctaccagaagctgggagaggcaaggaaagattctctgctagagactttccagggaggatggccttgcagacacctggatttcagattgctagcttccagaactgcgagagagtttctgttgttttatgccacgcaatttgtggtactttgttacagtaaccctaaggcactgagatacccagtgaagtcacattgttctaaagaactagtccaagttcttttctggtttggtgcttgccttattattgtcttcgtctttctg

SEQ ID NO: 18007 - DNA, 14611 bp, Homo sapiens
gtttccttccctttttccccttgtctccctccactggatccttccagaggatgctgcatcccactggcgccagtgctaaacactgctgatgttggcaaagcagtatttttcccagtgaccttggttttattatttttaattccctaggtccatgtcaatgttgtaatacagtcaattttacagtccacagaaatgatagcgctgccttgagaggcatatggcaaaggggtcacagtgcagagccccagctctatggcagagagcctcacccacctccctgcctccacatcctcaccatggaaataggagcactgttggtacctacctcgtgagggcggttctggaattactcaaacacatcatctaagatgctttgtacagggcctggcacattgtaagcacttgtcagttcctgttgcacagcatcctccaggccctgtttgcagagttaattgcttctggtactttttttttccttttttttttttttttttggcagggggggtaggggggttgggacaagagtcgtgctcttttgcccaggctgcagtgtagtgacgtgatctcagctcactgcaacctctgcctcccgggttcaagcgattctcccacctcagcctcccgagtagctgggattacaggttcgcaccaccatgcctggctaattttttgtattttcagtatagatggggttttgccatgttggccaggctggtctcaaactcctggcctcaagtgatcctcccacctcggcctcccaaagtgctgggattacaggcgtgagccactgtgcccgaccgctttctggtacatttcttaatgtcctgtgaaacttcacctggaatgggatttgctgggaattcattttgtagacaagggaaggatgcagtcttgtcagatatggtgacttaaggatcatcttaaaggatttaggtttcctaatatcgccaacagccacatgggtttaaatcctcaatactggtaggggctgggcatggtagctcacacctgtaatcccaccacactcagctgagttttgaagttctgttttttgtagagatggggtctcactgtcttgtccaggctgctgaggcaggaggatcacttgagcccaggagttcaagactaacctggacaagacagaccccatctctacaaaaaacaaaaccccaaaactcagctgagtgtgtggtgcacgcttgtagtcctagctccttgggagtctgatgtgagaggtttgcttgagcctaggagttcgaggccgcagtgagctatgactgagccaccgcattccagcctgagcaacagagcaagaccctgtgtcaaaataaaaaagacctatagaagcattagtgcttggggtaactattagcatgtgctggcagagaaggtctagtgcctttaccttggtgctaagagtccctccagattagtggctttcccgtgccctttctcttctctgggctgctaatgccttccttccccttattagtaatattactgataaacaaattgtacattctctgatctcacttcagaggctgtttctgtgcactgaagatgtacacacagtcttaattcaaaagagatagcatttatgtgctgccacattaaacagattgcaacagtattactattgagtttgtgttggctctgtgcaaccctcatggtgcccaggaacagatgaaaccaccagagacttggagcctcaggttcattcaatggtgtcccagggaacggggttggagggcttattcccagaaggcctctgaaatgtaagagctattaacaaggagttataagtcatttttggtagctataggcccaggcaatgggtagagatcaagatgggataaatggtaagatcagtagagtattgctcagataaatatgtaagctattttactggcacactgtatctagtgatattaacatgataagctataggtaggataatttctcatcagattgcagaaatacatttatagcctatttcctgttatataatgaaaagctactaatggggtagtagacaatgatatgggtaatagcttaaacagccttcgttgtcacttacctgaattcaggaatgacaggtttctttcatgcatgaggtactggatacattaaacacacacacacacacacacacacacacacacatatggcattgagttctagtcatatcctaaagaaaaactatggtgcgctatgttatttatagtactatactctgtgtgagtgactctgtgtgtatgtgtgttggtggaggtcagggatgacttgtttgtaatataccttaaggaagtctgtccgaatttgcccttcaaatactaaataaattcatctctcacctcaaactgcctttcagttcccttttactaattttgtttaaaagaaaggcaagtgaaggccaggcatgggggctcacacctgtaatcctagcactgtaggaggtcaaggcaggaggatcacttgagctcaggagttcaagaccagcctgggcaacatagggagacgccatctctacaaaaaaaaaaaaaagaagaagaacctgggcatgtggtcgcatacctgtggtcccagctgcatgggaggctgaggtgggaggattgcttgagccagggattgtaccactgcactccagcctgagcaagaccctgtctcaaataaaaataaaaataagacagctattttaccctgtcttcacctaaataagctcatcttattttttgcctgaaactcttgcaaactcccaggtctgctagttttgagaaaccttggatctcaataaggaatagttctcaattgcttataagcataatggatttcttttggcttaaagttcaaaactggcaacaagcagcgctagcaacccatagagagatacgcagaccatttcgatagacgtgtttgctgagtgaacaaggctgactgaatttttttttttttttgaggcagggtctcactttgttgcccaggctggcgtgcagtggtgcagtagtggctcacagcagccttgaccttctgggcccaagtgatcctcccttctcagcctcctgagctcctgagtaactgggaccatacgtgcaccaccatgcccagctaattttttagatttttttgtctccctatgttgcccaggctggtctcaaactcttggactcaagccatcctcctgccttggcctcccaaagtgctgggattacaggtgtgagctactgcgcccatccctgaattcttaattacaactaaactagatgcttatggattttcctgttttacaactcttgcctcttttatctgtaattttaagatcttgacagcttatatttggctttgcttttgtgtctcaagagttctttccttgataagcctctgtggaaactacagaatcttacaaatataaaacatttccggaaaaaatacaaaaatggacacctgacatttacactccctaaggtcgtgatcctgttgaagaaaggagatgaacgcggctgcttttcagtagttcttcacttcaccttaccaggttcttcatctggatgctatgctatgggggccagaggaggaggctgggattgtgatggatcctactagattttacagctggagctcccaggaatgccctcatagggaatgtcctgaagggaatcatgggtaacttgtaagctacctcaacttatttttggaactatgtaaggtataagatggatggagctgggttcctgtgcctttctcaccttgtccgcatagagatgcagctgctcctgcaggccaaagttctgcaccaatcacctccacctgcttcccactgggagacaaaggtttgaaagcctgtttggcgatgaaccacgatgatctgacactcaagccactcctgagaaagtcgggtttctttctgtttccatttatatatgtaattttcgcttcaaacaaacatgacctcgctattctatgcacagttttgaatcctgcttttaaaatgcgatgtctgccttgtctttaaatattctgagggggaggagaggagatgtgtaatgcgactgtctataatttgaaaccggacctcactatttagcgtctcagaaaacgcggggttcattgccctggtcccccccgccttcccccgccccccgaaccttccggctggctctcttgcggtccccgcctcggcgctgatgtggtctggcagtggagattggcgcccgggcggagcacgatgggcttccccgcggcaggcaggcaggctgctgctgcaggtgggtcccggcgcccgcgccgccccgcgcctcccgcggtcgccccgcccctgcccgcccgctccgctccgctcgcattggcgctgcctgctgtctgtccccgcgcggtggggagggggcgcacccggcggcgggctctgcagagggcgccttgctccgggtgcgaccgcggctccctggaggcctgggcggcgggccccgcgagcgcgccgccacctcgggagcagtgttggccaaggaccccgacgccctacgtaagtaaaggcagggcggggagcctgcgggggaggagggtcgggggcaatgtccggtccgcggaccgcggagtgggcaagaggtgcccactggatacggggtatccgagccctctgaggtgctgggagtaagaacgcgggaggtcgcttgtccgctggaatccgcggccagggcgaccctcatcaggtctgcccacctatccccttcgcgttacagcttgtcttagaagcatgggttgccggtggcttttttccttctttatccctctttgagaaatgtgattttgggtttctggccattacattataattctgcagacagcctgaagctgggttatctgttccacgcccccggcattttcctttttgagtactttatcctgcgctctgtctcctgccataaggggcgtcaagccagaattcgagattccttcctccaggaggaagcttcgtggtccgtatctggtgctgggaaagatgcattgctttcctcgggtactggctgctcaagggaaaaaggaaagggggtgttttctgtgacatgagacttgcaattccatcaggaaatgagcacagggactttaagatttcctgaggcgataaagctacccttgctggttaagagcgaatcatttgcagtctgacattctgcaaagttttattgtctacagactgcattattttccctcgttagttaagtttctgtttgggtattcgttttatttctagtatgtgagatacattcaagtgagcttctcaaacgattgtctttgcgcaatccaggttagtttccaatgacagactcctaaacatctcatttcaatatttctattatgtggtaatacagcctctgcttaacaaaaatgctcaggtgctgaaaactcacaagaggtgagaagatttaaacagttatcagcttaggttctagtgctcactgaaacattgtgaggagaaacactgtcaaatgttcatattttagttccgtcattgttctagaatgactttatctttctgttagaggcacacagtatgaaacacccaacctaagataatatttacttagatcataaactgattttcagggttccagttccttctacagttcataaaattatgggttacccaaatgaaacttcagtgaaggatttacataaaaacaatataaagaatgagtccctttgcttattttagggcatccacccactaaaattcataggatctttgttggataatcacctcccatttccattctttggtgccatcataccattctaaggattaaattttcaatacacctttatattatctaagtttgccaattgcatagtttgccaacttatttttggcttttaaattagttcctgaaccaaaaaaataaaatataaagaatttcaaaagcttggttttcaaatgacaagaactcagtctactcgtggttcaattatgagttgataagtgccttatggttaaatgaccattaatcaattttttaatttttttactaatgaaacactgcagattagtatccccaaacaattcattttctgacgaaactcttaaagcccagtttcagaacataagctttaagcaacaagcaatcttgtgttaatctgagctctgttacagctctgccgtaatctcagccaaattgcttcatctgtacgtggtgataccaccatctttgtaatattgtggtgaggattagagatgtatgtaaaagtgcatgcactgcctaatacccaagaattgctcaataaatgtcagctattactactcttactgacttccaactatgtgcagattatggtggaaacatgtgatacagcagatacagtacttaaatgaaaatgtcaaaattgtacaactaatttaagagtgggaaatgacagtaatgctaaattttcctaagaatatgtatgaaaaatagcacttccttgatggaacatacatttttagaacagaaaccttatgttataatggtaaaactagagagtcaaagtctctagttctaactctggctatgaccttatctagttgcatggcttttgacaagacaactgctcccctctggagttcagttttgtcatctggctggatttgagtaatctcaaataatctctaaagtcctttgcagctttaaaattatctattgagtgtgataaagattacatcagcttgcttttcatcctgcacttcatttttggttcttgttgtttgcttaacttgcactttagagtcataagcaattcacacagacaacacaactaaagaactgataatatcagacttgcagggtaatccaaaatgaagtttcaacaaggaggataaaacaaaatagaatcacactgaactctttaatagggccaaagtaaaccccaatgtttattctccagtcatttcattaagttattatatggaaaatatgcctggtagaatcttatacattcactgaaatagtctccacagaaaataataggctcatagtgaaataaaataccactttcttttctctcatcaggttgatctttaaataaagcaaaaatttatccaaagaagggctttcatcaagaaattaaagagagaaattacaagccatagagaaactgggcatttctatactagagaaaccacctaaaacaactgtatggagtaagatgaaaggtatgaatatgcctggaagaaattktacctagtgtgacatttttgctcatctttttgtcacaaaaggctgctaaggaagagagaatacagttttctagagaataagagtgcagtgtaaaaatggaaaccacaatttcagaaattcatgtagaaaacaaggatgagaagagatcagcagaaggtagtcctggggctgaaaggcagaaggaaaaggcatccatgctttgcttcaagagaagaaagaaagcagccaaagcactgaagcccaaagctggctctgaagctgctgatgtggcaaggaagtgtccacaagaagcaggagcttctgatcagccagagcccacacggggggcctgggcctcactcaaacgtcttgtmacacgcaggaaaaggtcagagtcttcaaagcagcaaaagcyattggagggtgaaatgcaacctgcaataaatgctgaggatgctgatctttctaagaaaaaggcaaaatctagacttaagattccctgcataaaattcccaagagggccaaaaaggagtaatcattccaaaattatagaagactcagactgcagcatcaaagtccaggaagaagctgaaattttggatatacaaacacagaccccattgaatgatcaggcaacaaaggctaagtcaacccaggatctaagtgaaggcatctcacrgaaagatggtgatgaggtctgtgaatcaaatgtgagcaatagcayaacttytggagagaaagtgatttcagtagaacttggattagataatgggcattctsctattcaaacgggaactctaatccttgaagaaattgaaacgatcaaggaaaaacaagatgttcaaccccagcaagcaagcccacttgaaacttcagaaacagaccatcagcagccagtactttctgatgttcctcctttacctgcaattccagatcaacaaattgtggaagaagccagtaacagtaccctagaaagtgcaccaaatggaaaagactatgaaagtacagagattgtagctgaagaaactaagccaaaagatactgaattgagccaaraatcagattttaaagaaaatgggatcactgaagagaaatccaaatcagaagaaagcaaaagaatggagccaattgctattattattacagacactgaaatcagtgaatttgatgttacaaaatctaaaaatgtccctaagcaattcttaatttcagctgaaaatgagcaagtaggggtttttgctaatgataatggttttgaggatagaacttcagaacaatatgaaacactcttaattgaaacagcctcttctctagtcaagaatgctattcagttgtcaatagaacagctggttaatgaaatggcctctgatgataataaaataaacaatcttctacagtgacttactctccagagtcacggcagaaaaaacaagcttaatgaagaattcttttatacatttgtggcatttcttactcagtaacaaatgagagatttatcatctctagaacttaaaaggtacaattccagcgcagaagtgctaaagattaagtcaagtttataaaactctaccactgaaatgcagtcacttctggattggaggaagtcagcacagattgcagtgtaaaatgacataacatacagggagttgctaaaatggcatatggagattggagtgctttgggggaggaaggtgtatttattgagcacttatggtatgccataagctttttaatgacctctgatataacaaagtctggtttccttttgataattcagctctgtgtataggctaacatcacattaagtttttaaaaacttattttttacagtgcacatatatgtttaaaatggtgaataaggtgagctacttttgtgaatgtgatttgtaattgttacattcctaagcagcaggcttaactcaaaaaatacattgcattttcccaatttcagcagatagtgtgcagaatatgcatattgatattaaacgtgagtggtttcctagtcttaagtctcttataagcgctatttggccaggggcagtggctcacgcctataatcccagcactttgggaggccaaggcgggtggatcagctaaggtcaggagttcgagaccagcctggccaatgtggtgaaaccccatctctactgaaaatacaaaaattagctgggcgtggtggtgcacgcctgtaatcccagctacttgggaggctgaggcaggagaattgcttgaacccgagaggtggaggttgcagggagccaagattgcaccactgcactccagtctgggcaacagagcgagactccttctcaaaaaaaaaaaaaaaaaaaaagagaaccattcacaaatccttcaatcaggcaaattgttactaagtgcaaaagtgtagaaacagggagagtgggtttttcccccgcttttctttctgcctcaacagatctgtatatatccatttctgcatggatttatctgtgaaaagttaaaaaatgaaacagcaaaaacaaaacaaggggaatattattcttcatccaggagaagggaaaattcccaagtaaattatcacagataatataggattcatcttgcagaattacttctttaagagccatattcatcaacttctctccaaagaggggagagtagattcaaagccagcctggtagtaatggtcctggaaaatcctaataatctagtgcaaatatttattctcggccaaaaatgagccatgaatgtgggtgaatagaaaagtgaaaagttattgctaaagcacattataatttaaatgtcagtattccttcatgtctgtgtgttgagaccagtaaaaagcattttacatgaatattgaaagttaactttttcatcactattttcttttcttttttttttttttttgagatggagtctcactctgtcgcccaggctggagtgcagtggcgcgatcttggctcactgcaagctccacctcctgggttcacaccattcttctgcctcagcctcccaagtagctgggactacaggcgcccactacaacgctcggctaattttttgtatttttagtagagatggggtttcaccgtgttagccaggatggtcttgatctcctgacctcatgatcctcccgcctcggcctcctaaagtgctgggattacaggcatgagccaccgcacccggccttcatcactattttcaatccagatatactttacaaaaatgagaagggcttatttgcatttttatttacatattgaaagggaagcatctgatctcatcaatgattgccatattttttgaaaaagtaatcctatttcaatctttccttgtgtgaaatggccataataccagagtgcacttccctacctcacaggttaggattcaaagtgtgtattcccccattgtgtaaattgagtgattgtgttactacttgaaacagatgaagtaataaagatgaagtatgagatgtaaggtatttgttcaagagctccacttggaggaaataatgcacattagatgattttaaatgatctgggtgaattcttgcattgtgtatggattgcatatagaaagtatttgctactttgtcctacagaatcatcttcatttctttctgtaaatacatattgagacctctaacaaaagaaactaatctgacttggaaattgaaccaaatcatggatattattagcaagattctttgctgaagtgcaaaaatatttcccccagattttcctaccttcatgcttataatccggggaggagggtggaaatcctgagcaagatgaaaagtgtcattcaaaacacatgacccaagaagtcaatttcttttaattgtacaacttttaaacattaaaaacaaaaaagacgagtcatcttctctgaaaacactctttaactcactatatgtggtgctaatggacttggacagctaccagctatcatatttaaaagtgaaccattttaaaaacctgactaaggttggtgcattttacagtgtattgaagaatcctgccctcatttactgcaaggatgcctccaagccaatacacttgcattgtaaatgtttagtaatctcatgaacaagcaaaaagtatagtacttagcagttattggaaatattttgggggatttttaaaaaaacagataaatggtaaatatgtgcaatgaattttttggttaagaaagtaaaattttatctaatactaggtttttacttttttcactgtggtttgatatatatttttggttagaatgtactgattgtttttatgataagatgtatattttacttgcattcattcttaagaggtttctgtttttctattgagaatatctgttgaattaagtaggatttcagttagaaaaaggaattccgaaattaactggtctcaatctgattatatgtgctacatggccaaatcctattacagtgaattctaaggtgattcaaattgttttattgttatagaaatatgcagaaatcagatggcttcagagtcataaaatatttttcttgtaatagtatttaagcaatttgaccttatatgcaaacgttaagtgaatataaataagttctgtttcaattcatgtccatttaacaacattaaaataattattaggaacaccacatgaattttctttacatttgctgtggtataaattctgcttttaatgaatgtttatttatttattagccaaaattcagtttctctttgaacccagaattttgcaaagctgggggttggggagggggattattagctacttgttaactttttcagcatattatcattcctcttttaagactcaagtattattcactttgcttcttacaacccagagaatgtgaaaattctcctctattttatgtagcactattcacttaacattttttcaaagcactttataggatataaaaatagtacccggtaacatttaagtaaaggtagcagaaaacaaaagaactttcaaacagaaattatgttccctgccacctcctccacctcaaagaataataagcatgtggcataaatggagttgttcagaaaagctgtctgcataattttccttcaaggtaatgtatttgacagcatgaagtttgtgatgatcttacttggtctactactcagcggagtcttagaatctcttttatttacttctgagagattgttatttcaccagtatatgtgaacaggcttgctaaaggcattaaagatatggatcatggaggcaccaaatttggcttctgtatgcaatccagcattaacttcatccatacatttctaacttcatccataaatttctaacttcaagttaccttattttttatagttaagaatgtttttcgaggtttacaacagaatttaaaaaataattgttaggctttagaatcccactgtttgaaaagatccttttaatgtcaactttattgaaatatgtagtctactttctaatttcatctgataatatagcaggatttgatttttctgcctgccatttgtgcatttaaaaaaaaatcctcatttaagatttagagttctttaggttcaaattcctatgatgttttattgggtaacatgaactctcttatacataattcaaaatttcaatccatggtatattttatggtacattttgaaaagaaaatttgtaatgctccttagttacaaaaattagaaggaagctacataaaattcaggtgtcctaattaaattcaatttgattcaacacacgtattaggcataactcatacctaacactatttgataagggagacaggctccctgccatccaagaactcaacctagggagcagtgacaacagaaaccgggttgggttaaggcaaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactcatgtttattcagatcttttaaaagaactgtgggcaaactatgttcatttcctataactgtaaagatcacattgatggaactactgagttcgcactaccaaaagttctactctgctaattgggaattggacagagattttacaacaacactcctaaaacagtccttcagcaagacaaatataaacacctacaatgctgaactaattcagccaaaagggcagttctgaatttgatgacatttgtgaatttgacaaaagcacactgttttcatctcttgatatactcattattttctgcattaacctatgaattgttcatctttatgatttttcaaaagactaatcaatgtgaaaatgctagaattattcagacggtacatactaaaggtgggtgtttaaaaagttctgtgtttactaagacactgatttcattttggtaatgttaacactctatcttttcgtaaccacagcccgatgataacaatcaggctctaggaaggactgtactttccaaatcttggaaccaatttaaaacttgataataccttaaaagtcctaaaacgaatctggcttcaaagcaaaatgtcttcttaatgtacaaacactgtaatagggtagctaatatttcacattttgcaggatttttaaaagttttatggccgggcgcggtggctcacacctgtaatcccagcacgttgggaggccgaggcgggcggatcacaaggtcaggagatggaaaccatcctggctaacatggtgaaaccccgtctctactaaaaatacaaaaaattagccaggcgtggtggcgggtgcctgtagtcccagctactggggaggctgaggcaggagaatggcgtgaacccgggaggcagagcttgcagtgagccgacatcatgccattgcactccagcctgggcgacaaagcgagactctgtctcaaaaaaaagttttattaaatctcttcttggtttaaaaaaaaaaaaaaagatacactacacttcacaaaagttgtcctcacaggcaattctgctaatccctttttagacctacctttaatgctgacgtctggagtccccaacccttttgtgaatacctacttttctttctttcttccttcctgaaagcttaagcttactgggggttaagttcccgagcttaggaaagagagtatgcgtgtctgtgcactacacattcacagaaaatcctct

SEQ ID NO: 18008 - DNA, 40987 bp, Homo sapiens
  misc_feature (1)...(40987): n = A,T,C or G, or insertion/deletion polymorphism (see Tables 1-2)
cactgcaagctccgcctcccgggttcgcgccattctcctgcctcagcctcccgagtagctgggactacaggcgcccaccaccacacccagctaatttttttgtatttttagtcgagacggggtttcactgtgttagccaggatggtctcgatttcctgacctcatgatccacccgcctcggcctcccaaagtgctgtgattacaggcgtgagccaccgcgcccagcccagattctttttttaaaaagcttcccaggtgattctaacgtgactgctcagttaagaaccactgcctcagaagaacacgggaccaaggaaacccaagaaattatttcacactctacaattacattgatatttaagagacaataaaaactttctttactttctagattgtataactctggattagttcaaactaagtaagatagaacaactttatactagtctctataaataaacaattccgtaagagtgttcaaagtatggaaattatgttgactacattaaatgaacaaatataaacaactgtaattctaattgtaaccttaaaatattggccagattaagaaacaaaagtgctccatggccaggcatggtggctcgctcccagcactttgggaggccgaggcaggtggattacctgaggtcgggagttcgagaccagcctgaccaacatgaagaaaccccgtctctactaaaaatacaaaattagccaggtgtggtggcacatacctataatcccggctactcgggaggctgaggcgggagaatcgcttgaacccaggaggcagaggttgtggtgagctgagattgtgtcattgcactccagtctgggcaacaagagtgaaactccatctcaaaaaaaaaaagaaaaagaaaaaaaagaatcaaaagtgctcctaaactggcaggatgggcatgggtgggggggtggaggaacacactattttcagacttcttttcaaatagtatttaggaaaaagaaatatttactctcttactccattacacctagattggatttcataacacctaaaaatgatacagaaattctaaatctgaaaatactgtttgaggtaaaatctgctgtaattccagacatctgcttattaagatctactgagaatgttagcaaagagggtatggagggggtagatgaaacaggaagagtagttatgctctagaaacctttaatggaactgggaaacgttagtttggggcctcctgcctgttggcagacatagccaacctccaagcacctctaattcccatctaaccaacattacattgtaggatgcctgataaagccaagcacacaagaatactaacaacagtaagcacaaattgttaatagacctttaaaaaaaatcagaacccggagaaagaaaggaaaagattcctctcagtccattaaagacaaaccaaatttctaaaagaaaaaataaggtactcaaaggacaggagaaagatggaaaattataatgctagtacagacctagaatacagtacaggcaagagtaactaaaacttctggatacaagtaaaccaatacttctttcgcaatggaagtatactcccatgaacacactactcaagtgggctaataaaaacctttgcttaaagtgcttggagatttcagaaaaaataaaacatccatgcatgactgatttgtaaccagagaagaaatgaattagaaaaatataaaaaataactgaacactctaagcactttttctcccaataaagcaaaaaaaaaaaaaaaaaaaaaaagagagagagagagagaaagaaaattcctgctagcaaagggaaagcagaacggtaaataaatgcctataatcccagcactttaggaggccgaggagggtggatcacctgaggtcagagttcaagaccagcctggccaatatggtgaaaccgtctctactaaaaatacaaaaattagttgggcgtggtggcagacgtctgtaatcccagctacttgggaggctgaggcagaagaattgccaataagggggaaaaactcaaatgtccatggatagtcaaatggataaagaaaacatggaccaggcacagtggctcacacctataatcccagcactttgggaggccaaggtgggcggatcacttgaggtcaggagttcaagacccgcctggccaacatggcgaaaccctgtctctactaaaaatacaaaaattagccaggtgtggtggcaggcgcctgtaatcccagctactcgggaggctgaagccagagaatcgcttgaatgcaggaggcggaggctgcagtgagctgaaattacaccactgcactccagcctgggtgacagaggtagactctgtctcaaaaaacaaacaaacaaaaaaaaccccagaagtataaaaaaatttaatcaataatcctgaaactgatgtttgttacaaacactttcttcttcctcctctatccctaagcaggttcaagtagcaatatctttcctttttagggagaatactattctggttattttcaaaacctattattataataaatactatatgcgaggccttgtgctaagtgctctatatacactatctcttaaaatcgtcactgtgatgactaatgtattattttcatttccattttacaaatgaggaaaaatcctaagcttaggacacacaatcagcaaatggtataaagtggagataaaaagccaggtctgtctccatagcctgtgctaataaactggagcaatattttcttagctttctcttcttaaaagactgaagttcacatgctatttggaataaatacacagaaaaggggcacaggaagtggtgcagaaagaagcactttataacttatcaagataagagcacctgcactgcttttttaaaacaaggaaaaaccctgcaataatataaaacccccaactcttttctggccctgttattgctaaaatggacaagttggtcaggcaccacctacggaccatagcaaataaatcactttggttcagtggtggggaggacattatgcaacacttcccagcacagccctggccaggatattttacggccaaggcacctcctccccagctagacagcctggctccttcacattcccctcaggagatagggtggaagctcacagctccactttgtaaggcatagagggcagctgaaagtcctgcttggcctctctgggcaaccacaggcgccaataaatcagccacaggcgattctctcattcccttcccggctgaaacaggagcaagatataatgcaaaacagcactgattggacttgagagataagcgatctaggcttaaattctactgcgaatgactgtattaccacagcccaggtaatgagcctgtttcctcaggcttgtaacatgaagacagtaccatctcctttttggtaaagacacaaagttcatctacgaaagcagctagtatgatacttggcccactgcaagtactcagtaaacagcggccaacttgagcagaatccatctctactacatgcaaataagacattcaaggtaggactggacaaaaaaggtgttagcaggttacgtgggttcctttctgttttcttcctgaccacaccttgatatttcactgactgccagctctcagaattaatctgttccatgtcatatcccatcagtgttctgttccctattaaggagttgatgtccgataacggattcacgatttacccttaactaaaatatatccagattgttaaagaagactttgatgccttaacataaggaagcaaccaatgctgcaaataatagagaacagcaatgaaattttcaggggtggctggggggtgtaggcttttagttccaaaaatacaccataggcggcctacctcacctagaaataccatcaaacccacacagtggccatgcctgacttctccataacctgaatcaagccaagtatatataatgacctccgccggatacattctctacaggtgagtggggtaaactggcactgcggtcctggcatggtggagagtgcaatcaccaaggtgtctggagccttggagtcttagctatcaagaggtgtagctagctccagctacatcacgctcttcaggcctggtgtcttctctgtaaaacgagagggatgaaacagattttctataaggcacctctcggctctaaaatttaagattccaaagtgtactttacatacatgacagaatcttgtgagaggatcaacagctctgccaggacttgagtctcaagagaaagaatgccaaatttaatcccttggggtgatgcgggcgctaactgttgaaacatgctaggtgccgtcaggttccaggtactacgttgtgctatgcgctgcctccgcaactggtaacaactgattactccaaatactgagtgccagagaagacggtgataagatgggtcaagcttcaaaaagaaaaaccggatatgcttagaacaagataaacataatttgaagatagaaaagggggggatgtcttcttgccctagaaacgaggtaatcacaagctgggagtggaaacagtagccgcagcgtcctcccagcatctggaaagtcgcccgctcgtaagaggggtcggcgctacccgagggaggccgcaggcctactggggtttcctgctgggggtcgcacccggacccgcggccgggacggctctgcaccttcgcggcaccccgtgtgccaccctgaatcaggccccggcagccgctcctacgagcagcaaagggtggttctgggtattgtcggcccagcgctcactcgcggatgtattttcctcctgtgccctgcctgacatctcaatcggaccaaaaacacccctctccccagctacttgcatctgtcccgcgactggtgcagctgcaggccgccgccctgggtggctcgcggcaggagggactgagcccggggcagcccacaggggcaggaccgcgtcgcttacccagatgccgccgcggcggcaggccgactcctccgtgcaggaggggcgggctcccaagccgcgcactgcaagcagtggcgccggctcacgcacccctcggccgcctctcgcgcggcttcccgcgccggcagcccgcgatggccccacgtgaccgcgtgtctggtagcaggggaaagaggggcgccagggccggggtgtgcgtgcgtgcgtgcgtgcgtacgtgcgcgccctcccgcccgcccgcctcagtggccgggcgggggtcggcccgcgctctgagtgccgccgccacagttcgcagttgtgactctgtaggcggaagcatagggacaagcctgagcgtcacaggctccccacaaacaaccgcgtgacccggggactttccccagggtgtgcaaaagcacaggcaccccctcagttctggggtgaaggtgggggtggggaaggatgcgcccgcgtgttcgctggggaagggatgagggcgcggggccagggaggccgagccgcgggagcctgggtggagaggcggactgggcgaggtggggcatggcgggggaagtgactcagggccagaggcagcaggcccacggaaggtggggtcgggggggcgcggggactgggcgaccctgaaccgacggggcagggcgaggttgccggagcactcgaggcggaccgcgagtgacggcccagctgctgggcccaacgggcaggggtctgacatctggacggagtgggaaagcagcctcgcatcctgccctggggagtcgggaggagcccagttccatccagctgtgcaaacaggaggaggaggaggtcccaagcctacccttgagaggggcaagaggggtggtcaagccgccgccgccgcgacggcccccgcggtgcgggttgcgccagcctcctcggagctcgacgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtaagtatttgccagttgtggggctatttgcgcaactttggcccaggccggagggcgacgggccgcgggcctggcggastgcggggccggaggggcgccgatccgtgcggggagccggagcgcggcggacgcgctgcgaggacccggtgacgggcggctgccaggccgcctgcttgttgccggcgcgtcaggtcccgggcgtgcggcctccctgagtcggaggcgaagcccctacggagactagttcccaaattagttaccttcttttctttctttctctgcctttatttttttcgaggggggaggggaggtgtagacgggaggcgggagaacccggttgattgacgtgcctagagcccgcttctctcaacttacagctgcggctcggcggcgggtgggaggggaagtgtcccggagcccgaggctgcagacttgggcgcgctccgagggaggaggcgtaagatccgtgcaaattcttgttacgctgtttcccaccccctctcgccggcacacacgctttttgttcagtaaaaagtggaaggtctgagtttgggaattttaagtggaaaagatctgtttcttgggaagggagtgctttcgcttgcagcggtgggcgcttactagaagttcggtaaatgtgttggatgcagatcgggagtcgttactactaaagtatgtaggcagggtctgagctcagccaccccacccagtctccctttctacctaagcaacgcgtgtacatgatctgaagggttgacatgacattttctaaattgggcgaatcaggaagaggttgatgaaaatccttgacgttttctggggataggacatttgtgtgtgataacgttcttaagtcgaatttcagtgtggcagtgcacgcagattcttcattggtgttagtgtatttccatacggtatgtatcagtacaagaaatagtgttccctttgacactcgaacccaaggagtggtccgaggctttttgaggcaacgtaggatcaatgtctctgaagcagatttggtgaaggatgcaggtctcataatttacagagcaatcacagccttctttgaaacggagaaattagattctatgaaattttgtcagtgcagatagatatgatgtggagaaacggggaaaattgagtacaaaaagatgaggcttgaatgatggctggccaacatttgctcagaacctcaaaactttgcttttgaatcacttgctggatatctaataaagtctcaataataactggatgactttgggagctagaaagggggttcctcctcttaaagaaacaggaaactgggccgggcgcagtggctcacgcctgtaatcccaacactttgggaggcygaggcgggtggatcacccgaggtcaggagttcgagaccagcctggccaacatggcgaaaccccatctctactaaaagtacaaaaattagcctggcgtggtggcgggcgcctgtaatcccagctactcaggaggctgaggcaggagaatcgcttgaacctgggaggcggaggttgcagtgagccgaaatggcgccactgcactccagcctgggcaacaagagcgagactctgtctcaaaaaaacaaacaacaacaacaacaaaaacaggaaactgaagcatagtagaggtgaaatgcttttccaaaggttaataaacataacgtctacagtagagtcttcagttaacctcttacattcgttttatgagcaagcaggctttctccattaataccacattttcatggtattgaataactcaggttgaacagtctttcctgaagcctttctattcttcccactcctaatacgatggcctacttttttggggtttttgtggggaagggactggtgtatcattgtcagagaaaagagaaaccatatttaaccagggccttagcagggcatgagcacagtcacagccacttgctcttgaccttgtgctttgatttcagtttaacacttctaaatttttgtactgcttcctcattctcctcttttgccaggctctggggaagatatagttcatcgacctttttaagagtatctcgttttctttgtagcatcatttccctttctaatgtgcaggagaaaagaagtacctgctttcagacttgccctctagccaggaaaagcactaagcctttggtgcaaaggagaggaaactatttggtatagaaatacagaaaaatttccatagatttttgttaataagctgcaatctgttgtcttcccaaaaaaaatgaggtatatttgagaaacatcttcttgagaggtcactttggtctctatagaatgttttctcctgacattttcttctgtgctagtatctcatgctaaaatggtgaaattattttttctcatattcttatgtgaaccaaattaagggttactcgtgtctattttttctcaaaatggaaatgttttttattataaaatccatgctctttgaaaaattcagcctgtattgaagtacataaaatacaaaaatgaaagtcattttgactcccactccccagagataatcaccntgtacagttaattccttgtttaaaacgagagaaggcaacatttgatcacagctgtgtgtgcctcactctgcctggggatggcctrtggtgattcatggactcatgttctctgttcacattactcaggttggtaagaattgccaggtagaggaaaggggagtgttttgcattgggctgatttaaaattatttgattaactgggctgctattttaggtttgtccttattaaatacttactgtatcatggtgggctatttttcatactttgttcatgttaatgttgttgcccagcctctgatggattgatttacagcagccaaacacatgaaaacaaaagcaaaccctcacctttatagagagtttcataatttataattaggaaggagtgggtatacttgccatgaagaccactgccaatatatccctgtgctgatatgggatggggttcctcttgatcagcaccaaagattgcatgctgaacatatggaaaggaaattggacgaaagaagggtcaatgaccgctgttttcagatgtggcatggaagagactgatactggggaggaagcggcagggtctcactccttagccatgtgtatttaagaagaatgaactgtgaagaagttgatgatgatctaaaaacagagccccaaaatagtacatagaaagttaattacaacattggttatttgagagtgttggggacgtgggtggtttttatactactctgtctttgaatttaaaatagttttcaaaataaaatttgaagattaaagaattaaccagattttcttttgtctatatgagatgcatgcagtcgtttttagagatgagttccatccccactttgaatctgaagtattagaagaggcatgctctggtggacagtggggagttagcagatggaaggggatttagggaagggactggacattcttcctgcaagatggagcagtaagagaatgatgagagcttttagattcatgaaaaaggtgactctaggaggcttagaatgttccaaaggggcacttcagctaatagtcatattcagaagagtgttgtctggtttacacaaactgaaacttagggctttgaatcaagagtctcagcttctacttacaagataagcagttttggggaagtcagccactgaacctgtttcttcatttgcaaaatgaggataataaaaatacctatctcagggtggttgtgagatcagttgtataatgtatgggaaaatgctttaaattttaattttaattttaatttccaaccactatataaaagttgccatgattgaaataaacaaaaaattgataagcaaaataaaacttacctgtttaaacatttattcattcaaaaactcatcaagtatcaactaaatgtcagacattcagtaatgactgagatactgccctgatgtcaaggagcttgcagtaaagcaggggagccaaataattgcaatatctgccttaagygtggtaacagagcatcacagttgggatgatgcattattggtaccatattgttgtatgtataggctgttttggcagcacagaagaggcatctgcctcaccctaagatcagaaaaaacttcccaaagaggccaggcacaatgtctctcacctgtaatcccagcaccttgggaggcctaggcagrcggattgtttgatctcaggagtttgagaccagcctggccaacatggcgaaaccctgtctctacaaacaatacaaaagttagctgggcgtggtgccgcatgcctgtagtcccagctattcgagagactgaggtgggaggaacgcttgagcctggaagggcggaggttgcagtgagccgaaattgccccattgcactccagcctggatgacagagccagaccctgtctcaaaaaaaagaaaagaaaaaagaagtcccaaasagagtgagctagacattgaaaaggttctaagcaaaggaacagcatgtgtgaaatggcaaggcttttggtgtgttaggttatttgggatcgggggaatcttaaagcttaaaaatggagttaagtttcttagaatgaacatgcattttatgattttttaaaattggtttcattttgttgaatttcaattatatgattgtgatgttttcaggattttggtttgaattaaacaaaactggagccacaaaattggaaacaatacaattttttttaaaatgtgtaggatctggccgggtgtgtggtggctcacgcttgtaatcccagcactttgggaggccaaggcaggcggatcacgaggtcaggagattgagaccatcctggctaacatggtgaaaccccgtctctactaaaaatacaaaaaaaaaaaattggccgggcgtggtggtgggcgcctgtagtcccagctactctggaggctgaggcaggagaatggcgtgaacctgggaggcggagcttgcagtgagccgagattgtgccactgcactccagcctgggtgacagagcgagactccgtctcaattaaaaaaaaaaaaaaaagtgtaggatctgctcaaagaaggaaactgggtaatccctcccatcatcatagagctgtctcaccagttattcattcagtaacacttactgaatacttaatattccagagaaatgaaaaagccaaagtcctcgccttaaagttgctcacaatctcatgggggagaccaacacataattataaccaattcttatttagcacttactccatgagagatatacttaacaataattcttcagaggtagaaaggattaccatcccttcttagagaattgaagcacaaattgactaagcaaccttctcaaggtcacacacttaataagtggcagagccagaatttraacccaggcagtctggttagtttgtgctttaacacctactttatgtagctgttctgattattaaaatacagtgtaaaaagtgcaaaataaagaggtaatacacaatgagatcaaaacctaaaatagtgggagaggaaggtgttacagaggctttctgcaggaggtgataaactgatttttaaatgatatctgggaggttcagacccaaagaaccaatcggcatgagtaaaactgcaggggaagtaagaaatttatgaagtatactggatgtgtgtggaggagggtgaaggtggtgatgagcagttttatgttgcttgaacatgaagtttgaagcaggcagtaactaaacatgtaagactagatgggtgggcatggagggctttgtatgcctcaataatgattttatactttagtctgaagatatgtgaggggaaccatggtagaatagtgtgatatgatttttcttcttcatgaatcatcttcaaaacagcattgctctgggaagaaaaagattacctgagagtgaaggatttgagagactggttgagcctattttaataactcaggagtgataacagaggccttgcaagagcaggaaaggtagggatggagtagatgggcagatttgagaaatatttaatgggaaaattggcaacacttaatggttgattatgagggagaagttmtaggtagctcccaagtagtctaggtgattggtacatagtggtggcagctgagacaaaatacagggaggggcatttttaagtgggttccagacaaaatctgagtccacagaattagtactttgaaatagaagtcctacaaaacgaaccctaagaatatgaatgccatgtgcaataagggatttcctggtgaagcgtttttagctgagaaaagcctactgtttacacagtgccctctggtggtcagaagatgctgtgctgtctcgttaggatgaatggattaaaatgtacttttcctcctctgcttctggagagggagagaggaatattccagaagccactgtgttccttctgctttctgtgtgggtaagttcatttcttagaatataatgcaactgaactacaggaacatctcacttatttgtaagttatttggttggcaacctcagctatccagtgccttggcctgatgcaaaagaggaaggaaatatgatcgcctgtcagcaaaattcaggaattaaaactttacatcttatgagcatttccctagatcttcagaagatgttgtgctccctctttaggatgaatggatatgtagattcaattttcaatgagtttttgtctaatttcacagccaagaagagattgaaatggtgggccacaggagatcagcacacctttcagaagtgacagttgttggcttgcaagtaaagagacagaaaaatactaactagccaacaaagcccaatctccaaaagcataacagtctgaggccattttgtgtaggtgcaaacccttgcaaatttgaacaactactatgtttcagcaaaacataattgtttcagaggagaaaacagccagccgggtgatgctatatgtgtaggctgcagttagagtagtatgaagagccctagaccaggattgaggagaccaaggtcttatcctgacagccactaaaactaaatgtgactttgaacataccacttaacctcttagggcctcagtttgctttttgatctataaagcagtgggttgaacttgatcatttcataaaattctataaactgtaattatgacattaattttttttaaattgtactgtgcttggattgaaaaggcaaaggaacatttgtcatctctaatttatttaagagtcctctgagaagtatgattatcccaattttatagatgagaaaattgggcttaaagaagttcccgcatagctaaactagtggtagagtttgtattcaaacaaacagtatatgctctctggcttcttttttaattccttcacttgacaagcacatattaagtgtcaactatgtgggaagagtgtgctaggcacaaggaaaacaaaggccattaagccttgtccctgtctttgaggcttcagtacagtaggcattgctgtatcacactgctccttggatctcttgtcagtgctaatgatacaagtaatactactgcactgttaggcttaatatatagctccattatgtctttagggtgtgggtataaaactaagccaccatttatattattgtttctatgggaatatgtgtttcaagttccaaataaattaaaaataaagttttaggatataacccagttataattgcagaacttcctgtactaagtactgaatttggagtctaatgcacagccaccagtgcagatagtgcataaaattttctaaacttgatcgtgtttgtcacttaagtgcgttgaaataaaacctcttatctttgggagcctctacaactggttattcctggaagtttcaagragaaacctagagaatgtaatagagattggaccctataccctgcaagatggtattctaggaaagaattttgccaatgtgacattatttttatagatggcagaatctttaaggtcatgatcttgggcttagagtcatattgcctgtgttctaatcccatgaagtcctctctttgtgatattacaaaggttatataacactgtatgcctctgttatttaatcttgaaaatgagtcttatagcagcatctactttgtagggtttgttacgaggattaaatgctaaaatgatacttatatatgcatacatacacataaaatgatacctatatatggatacatacacagatatgcacacatacacacatacatgtatatacatacatgtatatatgcaatatatgtgtgcatatctcacacatatatattgcatatatccatatatatccatatgtgtatatgtgtaatgtatctgtgagagatatatatacatctccctatacatctgcctggaatagagcctggcatayagtgagacataacaaatgttagctattcatattattattgtattacagttgtcatttactctactttgataaccttcatctaccagtccagtaaagcaaatctaccttctgtcctgttacatttccagccaagctgctgtgtaccctcctcaattatttacatacacatctatataaatactcgaaatgcctcacccttgctttctgtttatcctactcattcatcaaggctttactcaaatcctacatccttcctaaagcctactattttggtataattaacgcttttcttctaaactcttgctgaactttattcaatatagtttatttttatttttatttttatgtttgagatggagtcttgctctgttgcccaggctggagtgcagtggctcaatctcagttcactgcaacctctgcctccaggttcaagcgattctcctgcctcagccccccaagtagctgggaytacaggcatccactatcatgcccggctgatttttgtatttttgtagagacagagtttcaccatgttggtcaggctggtcttgaactcctgacctcaggtgatccacccacctcagcctcccaaagtgctgggattacaggtatgagccaccgcaccggcctcaatatagtttattaaactcctcaaattgtttcttggtttcaaatttaatccctcatatacagttatctctattgtacaccatccttctccaccctccatttcaatgctctatccagtgttaggaacattatgagtattcaatagattctgatattctgatgttaaaatgtaagaatcctttcattacattttagacttttaaaatactctgtaatcctcaaatccatatgcatacatacattcaacctataagacatagaaataggtaaaaggaaacatatatacataaatcttccttgagatccagaggtaattgtaagtcagagattggggtgctgaattgggactgtgatgctaggctctctagactttcactgaggctaagcgaatcatcttcaaatgcctcattggtgctgcaagtctgtgacacaatttagagggtgattatttgcctcacagaaacactttaaaattcctttaagttacttctttattcattggatatgcttatttatagacccttaaattatcatttaccaaggctggagcaagagaaacttccagcaaaactgttatttccaatttgagagatctagcaatggaggaaaaatatttctgaaatcttactatgtcagtgagaaatttactgaaatagcttacacagtataacttagggaacacatctattgaataagactagattgacatgtatggataaagccacattacagataaagaattcagattggggtaatcacttgctcaatagcatccaaccaacaaaccctgtattaaggactcatgccctgtccttgtttagtgttctttccggaagaccatactgtatagtaccaaggaagtgccatatatagaggttattactatctgggtggtcaggagtccttagtcctagtatgtgcttcagcacagttaactataccctgatacattaaaaaccatgtatctttgccttctatggaataagaatgttagactagattagatctctctaagctctaaaaatgtatgattaaattacttaatatgcttaatgtgcttggtgactgtttttaaacttgagatgagccgttaaactttttcagactaaaattttaaaaatccagtataaaactttttggatcacctaactccttaattcttgctagagttctgcacagtgggtatccttctagccttagtgtaactcttggcattatatagcttgttttccttatccaaatgacattaagtcctttgagtcacattggaggttctgctctcagacctgagcccttgacttctagttgtgctaaacttgtcctaccagtgatgcagctagtagtacaaacaaaagcaatcacagatttcagtcgtaaaaacaagaacagctgaaatacaagctgtccatttacttaaaaccttttataggctttactagaacataaagttcattaactttttttggcagcattaataaagaggtcaaaaaaatgaaaaaagagcaaactcctcttggaatttgagtgaaattataatttaatgaaagtgaatgcctcataattttttttttttttttttgagatggagtcttgctctgtcgcccaggctggagtgcagtggcacagtcttggctcactgtaagctccgcctcccgrgttcccgccattctcccgcctcagcctcccaagtagctgggaatacaggtgcctgccaccacgcccggctaattttttgtatttttagtagagacagggtttcactgtgttagccaggatggctcgatttcctgaccttgtgatccacccgcctccgcctcccaaagtgctgggattacaggcgtgagccacggtgcccggcctcaaaaatttttaatgaaaaaattatcttcaagagataagctaaaagtctcacaggaatttagatcyctcctcccctgccgcatactcctctacctgtttttggtgtagtaatccttcttaaagcttttctgggctaggcacagtggtttatacctgtaatctcagcactttgggaggctgaggtgggaggattgcttgagcccaggaattcgagaccagcctgggcaacatagcaagacctcatcactacaaaaaatatacaaaaattagccagtcatggtggcgtatgcctgtagtgctagctattcagaaggtgtgaggtggaaggattgcttggagaatgagtacccatattaaagcaggaacagaatgctattgaggacattctgagctatgatggcaygccagcctgggtaacagagtaagaccctgtctcaaaaaaataataattaaaatttaagaaaaaagcttttctgaatgaggtgtaacaaggacagagtttctggtactaatgtgtcaatgattgctattataagttactgtgcctaaaatcagttttactcagaacttggacatttgcataataatgttacttaaactacaattctaggtcagcctaaaaactgttgtgttaggattaaaaattagacacagcatttgttcagcttccatttgttcagcttccagctctatagggggaatataggagtataaacatggatgcagtgggattcacactgtgatccgtctgactgagagcacttgttctttctactacagcatgatgccttcttctgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtagtcartaaatgtttgttgaatgaataaatgtgcattaaaatgctataagtgctcttatttaaatgtyttagtgttttatgttaataaaagaatatgtatttttactcagttgaattgtgactatagctatagatgtgcctatcatattgatcttctatgtagttgtattaattttggttgctgatgataaaactgctgctcatctagataagaaagggtctttggaacttctgtgctctttatatcattatttcaagcctggactatttaatacttgaaagtttttatagattaactactggctttctaatggactgttatttggaaggaaattttaaggttatcaactcaaacttacctgatgcttaaataagcatcaccaccattacaacatccactattactttcattattacatgccaagcacgatgcattttacacattgcctctgtgaatcctcatatatgatactgtatttgaggtattatccctaccttttcagttcaggaaacttagggtcaatgaggataagcaagttcccaaaagtggcaaagctagataagaagccaggtctgtctgatcctaggcccatgctcttttcacttattatactgtcctcaatagcattctgttcctgctttaatatgggtactcattctccaaacaagtttgtttcattcttgaattactcttattaatagaaagtttggttttttagaaataatacctatccctctgcctcttactctatagtttattatttattaaatgtctctctgaatcctagaaaaatgactatagacatagaaatttcatcctacttaaaacgggcttgggtcaacatttttgtgtatttttttcatcttttttccccccaccttttgaataaggttgtggcgtggatttgttttatataattctaacataattatgtatcctgtgtttrtttatttggctctccatcttgaacatttttcccacttctgtagttgccatttagaaatatatatatatatatatatatatatwtttttttttttttttttttgagacagtcttgctctgtcagccaggctggagtacagtggcatgatctcgactcactgcaacctccctcagccaggctggagtacagtggcatgatctcggctcactgcaacctccctctcccaggcgcaagcaattctcttgcctcagcctcccgagtagctgggtttacaggcatgtgccaccacgcccggctaatttttatatattttttagtagagatggggtttcaccatgttggccaggctgatcttgaactcctgacctcaggtaatccgcccaccttggcctcccaaagtgctgggattacaggcatgagccactgcgcctggcccagaaatacaatttttaattcactgccacatgacagtgaattctggggcgtagatttaccttaagactcctttttttactaggcattcaaatgagaagtaactcattaatgactatctttgtgcatacattgctttttgtatttagatacatactgaacatgattcctcacagctttttacagatacctgagttacagaggtttgaaatattgtacttacttgaaacttgatctggcttccagaaaaggtgcagtggttgcaattttaagaaggcagcaggtttcatcataagccatcttcatttcaccagtcctgtatctctggctatggaactttatgtcttagaggtggcaggatgggcatataggtagtaaaaggggcgtatgacccatatgtgatcgctgaggaatggataaaaagcaaatagaagtaygtaaacgtagatacccttaattactactacagagcttgaagagtgaacattttatttctctaaacagcttgttacatgttctttttaagttcagtcaaattgcataggaacttatttttaagtagaagatagattctgaagctttatgtatacggattaaaaattgaggctaaaatttgatcttattttaactttataatatgataggatttctagtgcttttaatacttcctctcctttcttccttatccaaagtcagctccctacactaaaaatacttaaatgcccactaatattgtctaatgttaaatgaagaaaactagttgcagagaggtatatatatatatatatatatatatatatatagtatgataccatttaggttaaaaaacacaacaaaagcaaaactatgtgcctggcatctcataggtactcaatatgctaactatgtacatgtgcatctcaacaaatctgaaggtatataatccagagtgtttggaggggttacctctgaaaagaggtgtgtgatctgaggtgtgtttttattctatatgcctctatgtttgaattttttgctacttttttttttttttttgagatggagtctcgttcttgtcacccaggctggagtgtagtggcacaatctctgctccctgcaacctccgccttctgggttcaagcgattctcccgcctcagcctcccgagtagctgggattacaggcgcccgctatcacgactggctaactttttttatttttagtagagacaggttttcaccgtgttggccaggctggtctcgaactcctgacctcagcctcacccttccaaagtgctgggattacaggcatgagccaccgcgctcagccttacttttttcttttaacaattaaaaaaaaaaaaaaatagaagaggccaggtgcagtggctcacacccacaatcccagcactttggaagcccgaggcaggaggatcgcttgaactcaggagttcaagaccagcctggacaacatagcaagaccttgtctttactaaaatattaaaaaaaaaaaaacaaaaaaaaactgaatgtggtggcatgtgcctacagtcccagctactctggatgctgtggcgggaggattgcttgagcatgggagattgaggctgcagttagctatgatcatgccactgcactccagcctaggtaacagagcgagaccctgcctcaaaaaaaaaaaaaggaagaaaactttacactctaaggataaataaaataccttctcaaataaacccactgcttctttataccctgaaatgcatgttgagcaacatgagacacattctaactctatagaattattgcttctttgataattcaagaaaagacaaaggcactgatcaaacttgtttggtgccatttctatataatctaataaggttgttgttgttgttgttgttgttgttgttttgaaayggagtctcgctctgtcgcccaggctggagtgcagtggtgcgatctcggctcactgcaagctccgcctcccaggttcatgccagtctcccgcctcagcctcctgagtagctgggaatacaggcgcccaccaccacgcctggctaattttttttgtatttttagtagagacaaggtttcactgtgttagccaggatggtttcgatctcctgacctcgtgatccgcccgcctcggcctcccaaagtgctgggattacaggtgtgagccaccacacccagccctaataaggttttttwaaatttttatttttgggatagagtctcactctgtcacacaagctagagtacagtggcgtgatcatggctcaccacaacctcaaaatcctgggctcaagccatcctcctgcatcagtctcccgagtagttgggactgcaggtgcatcatcatgcctggctaatgtttttttgttttgttttgttttgtttttaaggcgagatcttgctatgttgcccaggcttaatagggtttttaaaatagattattttaacaacacatggccaatcttgtatcatctattgctccccacacccaccccatttatttttaagcatatctcagatgtatcatttcatctgtaaatactaaagtatatatatccaaaagataaggattctttttaacacaatcaaaatacctttctcacacttaaaaaatgagcaatagctccttagtattaatcatttaataagtttttcatactttacaatctaattgttaactttcagtttaagttgctgttttatttactttcattactcatatccttcaagagttgttttctttttttttttttcttttgagacagagtcttgctctgtcatccagactggagtgcagtggcgtgacrcaactcactacagcctctacctgtcgggctcaagtgatccacccactttagcctcccaagtaactgggactacaggtgatgccaccacacctggttaattttttaaacttttttgtagagaagaggtctcacactattgcccaggctggtctcaaactcccgagctcaagcaatcctcctgcctcggtctcccaaagtgttaggattacaggcgtgagccactgcactcggcctccttcaagtatttttaaattaatgtctttttttctgttcaaatttagtgtacatgttccccccaagagttgtaatgaaactaaaactgtcttttgcttttgatgcctttgttcaatatgaaaagcctgaataaatggctggatgtcttcatcttcaaatttaaaaaatgattcaagtatatattattgagttttattagaatggaaagctcttaatttcttgattgtaatagcagtcatgcaagtcacaaatcatgataaaagttaattttgtcaagtgcttttctatatcttgtttgactttaatatttttgttttacataggtctctaattaacagaagatggcaaagcccagccacagcagctatgtccttcagcagctaaacaaccaaagagartggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccrctatttgatgtatgtaaaaaaagttccgtgtccaaattatctactccaaaagaacgtgtgtcaagacgctttgggcggagttttacctgtgatagctgtggatttggctttagctgtgaaaaattattagatgagcaygtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttyttagctatgattaaaatttttaaatgtagactacaagyggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactatcccgtttgcttttagtgagttaactactctttattcccccttattaatgaaattcatattcttaaattgacaagcttattaggcaagttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaaattccagtggctttacctcacttgaaaaattagtggggataagccattttgttttgtgatattaaatttaactatgatagttaattaaaaagacatatcttgtattcattaaaaatattttaatttaaaatattctgatttctaaagtgtgttagcttatcaattatttttgtttataaatagactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctgaacactaatagcattgctctttttgttcacatcatatttaaaatatgcaaatcatattttgtatacaatttacataaaagaacaagttgccaaaagaactgagagacatactggtgagtacagatttagttgaaagcattagagcaccatgtgagctcagatttgtggggatatgttgaagtgttaagtaaggataggaacagcacaggaaccaagtgcagaattcaaataacgggaagtaggcaggggacgggtagaatacacacaaaaattaaaaatttaacagcaaaagcaggaaaagtgattcatcttacccttacttagatacaatagtttatcaagtaattaaatttgaaatccaacttaaaatgaaatgtggtatgtatattactgataggaaccagataaaagttctctaacccagagaccatcagagagtggtataaagagatcagataaaccaagtttccaaactacagtatatagtatcataatggacataatttatttgagatcacttttttcgtgactcatcaaaatttttcttgcagtggctttccccattgttaaagaatagggctttttctaaatactaccactttttgaagaaacgattatctattccattaggaagggggcttaatttagtcttttgatatgtactaacagctaacaattagcaagcaaatatataaactttactctctaattttacatgactgagatgtttatagttttagaaagccatacctcaacttattttttattttatttatttatttttcttttttgagacggagtcttactcttgcccaggctggagtgcagtggtacaatcttggctcactgcaacctccacctcccagaatcaagcagttgtctgcctcagcctcctcagtagctgggattacaggcgcatgccaccacgcccggctaatttttgtatttttagtggagacagggtttcaccgtcttggccaggctggtgttgaactcctgacctcgtgatccaccggcttcagcctcccaaagtgctgggattacaggcatgagccaccgtgcccggccacctcaatttttttttctgagtttcatgttacacagaacatacctttttgttttggagctagctacagggaagcacaggcttctctagagtggaatgtacaattcttatcaaggcaaaaagttaaagactacttgctttttaaaattagggagaatgaaaaatatccagcacttttccccagcccagttccctaatatctccttcctctcctggggcagagctgcagagctgtcattccttgctgttgcttcttgccctccctgggtgtgaaggtaatgaaacaagtgtgttgaagctgccagatcttctgcctttgtaacttaggtgttcaggttccaaatctaaaaatgaaaggagaatctacacagatatatagtggaatcaaattctctttctgtctcatgaacaccatgagactcttttgctttggcccttttattctacacagcaagaaaacccagaggaatggttagcaagcttgccatcaactatagtacaatacaacttgcatgttctacgattccttagtaaacaggactaagaatctcagaaattaatagagcacaaccaaggcagcagtagattaggactcagaaatgcgtcttcatctcccccatgtttttaaggtaaaaatattcagaggccaggtgtggtggtttgcatctgtagttccggctactcgggaggctgaggcaagaggattgcttgagtccaggagttccagaccagcctgggcaacataacaagaccctatctctaaaaaaaaaatttgtttaattagcagggcatggtggcatgcagctgtagtccccagctactcaggaggctgaggtgggaggatcaatagagcctaggagttcaagggagcagtgagctatgatcatgccattacactccagcctgggtgacagagtgagactccatctctgaaaaaaattagaaatgacgcacatgggttaaatggtatatggcaaactaacagtttgagtatggacaaaaattcaattagaagaaaggatcccagaggggctaataattwaaaaaaaaaaaaagtttgctagagcagtcaggacactaattaaaaggaaaagtagaggctgggcaccagcaccttgggaggccaaggtgggtggatcacctgaggtcaagagttcgagaccagcctggccaacatggcaaaaccccacctctactaaaaatacaaaagttaggccaggcgcagtggctcaagcctgtaatcccagcactttgggaggctgaggtgggtggattgcgaggtcaggagttcaagaccagcctggccaacatggtgaaaccccatctctactaaaaatacaaaaaaattagccaggcatgttggcacaagcctgtaatcccagctacttaggaggctgaggcaggagaattgcttgaacccaggagatggaggttgcagtgagccaagatcacaccactgcgctccagcctgagtgacagagcgagactccatctcaaaaaaaaaaaattagccaggcgtggtggcgcgcacctgtaatcccagctacttgggaggccaaggcaggagaatctcttgaacttggaaggtggaggttgcagtgaactgagatcatgccacagcactccagcctgggcaacagagcaagactccatctcaaaaaaagataataatacacacgaaaaatcatgttttactgtagctgaaaaatatatgaacaggatataaaaattgaataaaaaacatttgaaaattataggtgagatgagtagggattaaaaataatatgactataattatagaatgcctatggaacaattttatgaacatgccaaggatatgcctaaataattgagatttttgtaagtaatgatgagagaggaaaaagtaattgagatattatcttttatattctaaaaaaaagtaggaagagaagctggtggtggttgacaactttttccctggttaaacaatactcatttctctaagtcagtagttaaggaactttgtatttaataaatttctggaaaatcttccccaaaaccagtttagccattgtaatatttaaattaaacataaaacttgtgtcgttgttaacaaaaagccaaatcactaccaaaagaaaaaaatctgagtgtatgtgcacacatggttaagaataaagaaatctggtatacctaattttaactgggtttttatcatgaattaaaagttaaaacatttttcttttcttttttttttttttttttttgccattcatctattttgatcagttagttcctcaactttccttactactcccatctcctttgtaacatatacttctcagtaataaatggccagtgctctccagacatcctagcatcaacaacttctgggattgcagggtaccaaaaagctctgggggaacatacccttgtagaatccctcccacatccttgataacctgaggtgcagtaaactggggatgataggatgaatgccaggaaactaaaacaagtagggttatatttggtgttaagaacttgaaattgcatcccatatttggaaacccatgatccatccatcctagggctctcacttaataaccccagcatccatttatttagcactctctatactctgcaaagtgctctacatacataattttaattaatccccacagccttatgaggtaagtatcatactaattttccagatgggggactgaggttcagagagattatttttcctaaatcacacagaaactatgtatcttagaactggagtttgaacctaggtttctgacttctacattcctgtactccacctatcaagaagtacaaagaagggccttttcagcctagaaacacatgtgataaarctcctatgagattgtgctccttgttcatctgtcatctgctgtgctggtaaggtggctagtaatagtgggtacccaattaacatgctgaataatgtgaaaacgtgagtggaaaacaaaactttatttaaatggttgattcagaatgatgttttagaaataaatattaaatgctgttatgttttgattttccttcatttaaacttaaaacagttagtggtactgtcagcctttttgaggggcccatagtaggtgggctcaattaaaaattaatttgaattcaacttccacatttctatgtctgtgaccttttcttcctttatttcccctattcctgtcctttatgttttaatctctcccgccaatctccatttccttttattggttataagactgttgagttgaaggactcaaatcatttgaaaataaatattcccaagaaaaagcaggataacagaataaccagtttcctctttttgccttaacagattatgtggataagaaattcatcatcttagccaggcacagtagctcatacccataatcccagcactttgagagactgagttgggaggattgcttgagcccaggagtttgagactagccctggcaacacagcgaaaccccatctctacaaaaatttaaaaattagccgggcatggtggtgcatgcctgtagtcccagttacttgggaggctgtggtcagagaattgcttgagcctgagaggtcaaggctgcagtgagccgtggttgtgtcactgcactccagcctgggcaacagagcgagaccctgtckcaaaaaataaaaacaaataaattcatcatatctttgactaataaacagaagaacccccttccccagttaccataggtgattgatttgattaagatttatagagcaatctaagtttgcctaaaaacaaatgttggttagtctagccacttataattcaatttcccaaaatacctatggatttttagggtaaacttatagagacagttttactcataaaacaaatgaaagataatttcaggaaatgacacatagctgcataaccaccctaacctagcagcaaactttaaaaaaggttatttaatggtttaagtgaaacaatctccctcaatctaatattattttaactttatgcgtctattaccttatttctatactactatgttaaacctactactttaatgatctggctaccgtctgccaaatgtcacttttcaagtgagaacagaagaatgagatwgtgaagattcygtggacaatgtctatataatcatttaagtgttaaatataaactaaatgacaatagcagcttgtaaattaatgctaattctggctgggagcagtggctcaggtggctcatgcctgtaatcccagcactttgagaggccgaggcaggtgaatcagctgaggtcaggagttcgagaccagcctggctaacatgatgaaacctctctactaaaaatacaaaaaattagccgggagtggtggcacatgcctgtagtctcagctactctggaggctgaggcgggagaaccgcttgaacctgggagatggaggttgcactgagctgatatcgtgccactgtactccagcctgggagacagactccgtctcaaaaaaaaaaaaaattaatgttaattttgaacaaacttaatatcacttacatttatatgcacacaattggttgaatttagcattaagaagtttaaatcttacttaagttgttctcttattcaggagaaccaaatcactgaagtcaattagtagtgtcaaaattgctcattctttccatcaaaatctaccacagatcactaagggacagaaagccattataatttctcattatccatctcaattgctgaccaaaaaagatagtatgaagattacaattaaatacttggctctgaactgaacatatcaatgtactaatcattattgtattaagtgaaaacacaggaatgtctagggccaagggatgaccaaaatttaaaagattatttcatatcagagtcagggatattaataattttatgtgagaaaatttgcagtttgttttctcctatttgaggaaggaacagttaattatacagcttaaaaagcccctacttacttaaaaagttaacatgtttttattctccttaaactaactgctcatatcaaacacaatcaggagagctcatttttagatgatagaaacattaattctaagcatccagattatgaaccatcttttttttcaaatgcttatgtttaaaaaattttaaaaaaattaaggatcttattatgagggaaaagcactgttgccaaaaatataattttactcagaatcactagggcagattaggaggcttataagcctaggaatttgcaggaaaacccctcctcttcttttgtgcgtgtatgtgtgtgtgygtgtatgcttcattttcatttgcagagtggctgaagacagtaaaaagaatatgaactttaaaaaaattgttagatttatgtttcaatcagagatttgtcattaacaagttaaagtacattgtaaaatcattttatttgaaggaaaacacttcttaactgcttccttcctccctactttcctctatttgtctgacccctatctttttttatgttatatatttatatgtcctgctgatagattaataagaacatcttatatttgaatggtacgagttacattcgggaaataattaaatttaaattctaggggctatgcttgtgtttctattctctrttctgttaacagtgtgttggcctagtgccaaagccaagaaattctgatctaagaattatgttgtatcttgtagagcagtcaacttgtaatattatttttcttgagttttgtctttttctgtgtggcagtggtgaaatagggccttctaaacctgtggagaagtgagagatctgaatttggagaggacatggggaagaatcaatcttcaacagataatctttaagtacagacccaggaatatcagatctgaagtggcaccatcttttctgtcttcctgacaaacttccatcaacccaaaaagttccagttgcaaagatccaagaaaactcagtaaagatcactttggaatcactttgttgtaacaaaattgattcatggtgactctaatatttgtgtaaatctgctgaagaaaagtaactagaaaattcatacaacatcagtggttacagctatactaaaataaaactttatatgctaattatcttcaagggtctttctaaaataaaaggggttgttaggctactgcaaatataaagagacataatcacaaatctatttatatagatataaataattctaaacttaaaatcactagaattatagcttaaatattatgaaatgtacttagtcaacttaaaaacttacaccaaaaatctgtagtttagagtgtaagaagtaatgggtacagagaaaaaaaatttaagaccaatattttaacaggataatttggttattactcactatagtaaaacacttgcccttcttccttttccactgtatatgccagtcacaatcttgatcatttatatgaatgaaactcccttttaaacctgttaacttgaaggagaacagaaatggtattacttcaatagtggtagatttccacaaatcagacacattattttcttctgaacttggcaatataacctaataaggcagaataagtttctgttaaaatacttattctcaatatttatgtataaaccatgcttctcagctttcaaatttcaagataaaatttaagtattcagtaaaatgatggttaacatgttttaaaaaatctttaatggagaagttaaatatttggtgagattttagtctggctataaatgctttgtttgatatatatatgtgcacatatatatattacttaaccatatgaattttatttccttattctgaatatacttgtagttttacttctttctgtttatgtacccaattccttatgattattttgtttcttctgcaatatcaagatgttatttattttgagaaatgcttatttttatgactatttattccaatgttttaacaagaagcacagagatttatagtattcttaatagtatgtgcagaagttacatcatttaaaaaacccttgctgtaaagtaggataacttgaatattcattctaataattagactaagtgaaaatctgagaaagagttaattgcaatgtgatagtgggtagaaaggagagaaaaacccactgaagggttcaaatacatgtgaattctactgctttaagagaaataaaacaaataagcctagggaaatattagagtctaaaaaaccctagagttamtctcttttgggaacataaggaggtatacagaactgcagacctctaaacataagtaggaaaaagaaaaataaaagaatattaccaataattaaaggtgccagatcaaaatagtaataaatcaacaaataatttttgattgactggtggaattagatttactaaataaaaatggcttaaattttgactgtactaactataaatgtaatgaattataataattataaatggtataaatgcattctacaatgtgattattttctgtattttagtatatagtataaaatggaattattgggttaaagtacttttattacatttcttaatccattgtttttacctaataaaatttcctcctctatattccaaagttaaattgtctgtatattacttttatttatactgtattttttccaatctggccatttaaaaaaattattagtttgaaaattattaactccttccatcctctaataccacaataataaagtatctgatatagctaattatgatgttctcaggtagcttaagatgtgcacaaagagaattagctaaaattcttattgccagatcctgatttctttcaatatagaagaatgatctgttactcagcctggaaagtagtgccaagattatagctcactgtaacctcagacttctgggctcaagggatcctcccaccttagccaccctagtagctaggactatagattcccaccacgatgcctgctaatttttaaaattttttgtagagatggggtctccctgtgttgcccaggttagtcttgaactcctgggctcgagtgatcctcctgcctttgtctcccaagtgctgggattacaggtatgagccactgcatctggcctggatttccttcttaatacacaaagaaataattatttataaatatccattgataaagtgtttagctctttcagaggcttaattcatttttcaagtaaacacaatttactgtcagagaaataactactttgccagtataattcatttttttttcagtttaagaattaaataagtattaacaataattgcatattgaatctgattctccaagtataggacagcctcacttcttccagattatttcaatctattccacaagggtctataaggttagcactaaaagttgaagtaggtataatttgtctgctgttgtcatagattaacttctcttttggaaaaagccttccaggttcaggtctcttacccttccataccaggcatggaaatgtcttaccccagcctactgtgtatctacagcttaagtgtaacttcaagactgaattttttaagactcaaagaaacaaatggcaagttttttcctgtagtgataggtgaagaaatattttaggacacagcactttgtaagaattataaaatggcagtatttatagagatcttaaagataatcattagttgaatttcagtttgctcaagggccctcaaattagaggctgttattccatcttttcttcaggccaacattatctccttaagataatctacaacccttgtgaaggttgttcctgggtagagactgagaggattttaggaaaattcacgagttggggtttttttccctagtaattctgcaaaaatgtattattgctcagtctccttagggcaggtctaacacccaggcacatagttttaggccgtatcttattcacctttgtatctctagtacaaatattttcagatatgaatttgtttcaacttttggtctctgcagtgtcatttagtacagaaatataagaggtaggcagtgtatcttcctactataaagaaaaaaactaaattttttttttgttaaataatgtgtctcaggtcacttttaataaatactaagctagtgatttactactgctttccaggcactcttctgggtgctaggaattaattacagaggatttgacatatgttaaagctcttgttttttccaccatttaatctgtggagccttagtctttggattttaaaaatactttgaaacaccctagtatttataatctgccaaagagagagttcacttgttgaaaatcagcaataatttctatgtaagactaatagactttgtttcaactgttgatatggtttggctgtgtccccacccaaatctcaccttgaattgtagctcccataattcccatgtgttgtggtgaaagataattgaatcatgggggcggtttctcccatactattctcgtggtagtaagagctgatggttttataaggggaaaccccttttgcttggttctcattctctcttgcctgctgccatgtaactggtggtagtgagtaagatctgatttttttttcagcatccaaaatctttttattaagagggtaggatccaaggttagtttttgtagcctcggctggcctgtcggcctctgatgcactcgaacttccagcccttggagcagacatagggtttggtgtggctgtgcggggttcccgggccttgctgaaatgctggtacacctttcggcccttgcaaatactggagagcaggacagtaccgcagccctcgggggagtccaccccttttgcttggttctcattctctcttgcctgccgccatgtgcctttcgccttctgccgtgattgtgaggcctccccagccatatggaagtgtgagtccactaaacctttttttcccttatagattacccagtctcgggtgtctttatcagcggcgtgaaaatggactaatgtagctgttaatagtcaagttctcaaaatcaattgtaaaagcacagtaaggaaacttagaaaaattactgataattctaccttctagataaccaattttgatgcattttaaatctatattagattatcctacatataagaagatacaagtttcatatattttattcacttaattataccaagaacatttttccgtgtcattaaaaatcttgtaaaccatttttacggctgcgtaagaattcatcatatgcatgtactataatttaggtaatctcttatttttggatatttaaaccatttcctttctattatcattaacataaataatactacctgcattttctattatttccttagaataaatcccacaatgagtaatgctaaataaaaggcatgatcatatttaatgtaaagaaaaaatattggccaggtgtggtggctcactactgtaatcccagcactttgggaggctgagactggtggagagcttgagctaaggagttcgagaccagactgaccaacatggcaaaactccatctctacaaaaatacaaaaattagccgggcttggtggtgcatgcctgtagtcctaactactccggaggctgaagtgggaggatcgcttgtgcaagctgtgagcctgccactgcattccagcctgggtgacacagcaagtccctgtctcttaaaacaaacaaacaaatttttaaaaacccaaaatacaaatacagtgtcttttttgggaaaagcttaggatgcctcttaaactatggaacatacaaaacacaagttagggcagaaaaaaatatacatggctaatgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgattctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctaagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcaggcctgtaatcccagcacgttgggaggccaagatgggcagacaatttgaagtcaggggttcgagaacagcctggcaaacatggtgaaaccctgtctctaccaaaaatataaaaattagatggacgtgctggtgcacataagtaacccagctatctggaaggctgaggcacgacaatctcttggaccaaggaggcagaggttgcagtgagccactgcactccagcctggcgacagaacaagactctgtctcaaaaaaaaccaaacaaataccccccacccccaaactacacaaaagacaagaatttccaagaataaaatcaagagatctgtactcacaatttatgacagtttcaattagaaaagtctgggttttatccttgttttcctaatattttcttttctttttctttttttttttagacagagtcttgctctgtcgcccaggctggagtgcagtggcgtgatctcagctcactgcaacctctgcctcccggattcaagcaatcctctgcctcagcctcccaagtagctgggattacaggcgcccaccaccaggcccggctaatttttgtatttttagtagagacagggtttcaccatcttggccaggctggtcttgaacttctgacctcgtgatccacgcgcctcggcctcccaaagtgctgggattacaggcatgagccaccgcgtccagcctttctaatattttctttaaaacgtcccctttttcaaaattttttcaaattcatggaaaagaggataggaattatggttaaaattagtactaactgatgacattaaccgattaataaccaattatgttcttaaaaactggaaatgatatacaccactagataaaataatcttaaatgttcattgactttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacactaatcttctgtacagaaatcctagtccagcaaacattgctctcatcttcgcccatacacaatctatgtaaagaatggctttcctactctttgctggcgaacttcagctcccggattaggcatgccacctcttccaggtagctctcagcaacgcacttttccatcagcctgggtgtgcccctctgtgttcccatggcgctttgctttcagcgcttctcccaaattatgtttacctgtttattagactctccacctctgaagaccaggccatttcatttggctttttactgccacgtagtaggtacctgttcaagcttgatggaaggacttccccagcctccccacacatattatgtaaagtgatcgctgtctttgcttcctcctggagaccatttattttatttttttgagacggagtctcgttctgtcgcccaggctggagtgcagtgtcgcaatctcgactgactgcaacctctgcctctcgagtagctgggactacaggcgcgcgccaccacgcccggctaatttttgtatttttagtagagacggggtttcaccatgttggccaggctggcctcgaacttctgacagcaagtgatccacctaccgcggcctttcaaagtgctgaaactacaggcatgagcctccacacccgtccaggagcccatttatatgggagcctgcttctaaagattattacctggtgccagggtattttccagacctgtcctcacattcctgttaaacaggaggaagtgaatcgcgctccttttcatctaccttctcggagggtttatgcctccaatattaacctcagcacagccaaagaaaatcattccattccattgagcggagtcagaaacatgactaggtcacgatcacaaccccgtgtgtgccagggtgaccgagactgggtgactttatggtgtttcaacgtgtgggttttgactgattatattatgggttttccagtcaaaaactcaaagcagtggataaagcacttgcgacctaaaataagcaatggaatgaacaggaaggcgaaaccagagtttaaagcggcaggacaaacaggaaaaaggaagagtgaggcaggaagggtttaaatgcaggctcctcggaggacaagtcgccgccacacccctgtctgccgtcccgccagccgccctcacgcggcgcgggaaaacggtcggcctcgccctgggctcaggttctctccgcccgccaggcagtggggtttttttttg

SEQ ID NO: 18009 - DNA, 17138 bp, Homo sapiens
ccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacccctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgacgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctgcaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattctagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgcyaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggrgtgtccgcagcgcgcacgcgcaacgaaagtcaatggcggtctggagagactggcggaagctagctttgcaatayggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccgagatcgtgccattgcactccagcctgggcaacaagagtgaaactccgtctcaaaattaaaataagaaaaaaaaaatggtatgaagacttgtctttggagagagaagacatgtgaaatggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagrgtygagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaatggccacgattcagaatgagccagtcccgtgtgggggctgtagagaagcgtgatcagagcatagtgtccctggatggatgggctatggaggctttccctgcctctttctaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtsggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtktaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaagggagtggagatggggctggttcctgctgcagtgaggggaacagatgggacaataaagactggagactcagttgaataatacaaaactgtttaatactaccaaaaatataattgtatgttgygcggctctccctggctatcatgggaggactgcaggctgcctctgaactgtagtccaacaggagaaagggttgacagcctggggtaggggatgctgctggattaaaaaaggaggatgaggcccgtcccgtgaggtctgcgtccatgagggttagaggtgggttaggggcatgggggcaccagcaaggggagggttgtatggagtgggagagccagggggcaggtagtgggtataggtgggcagcagttccccctggagcctagggtcactctgagggagggagcacggtgagggggcttccagtttgcagtgggaagagctgcagagagaaacaagaggttagagggcacttccctgggttggaggtgagtctggccagttctgggcagacagggtagagcgtgccacccacccagccctggctacccagcccgctgggcgcagcaggcatggaagccgaccccgggatggagagcccgcggccctgttggggcacgctcgggagcgggcttgcgtgctgcacggctgttttcctcttggggagtcaggccaggaaagggcagaatgagctcggcctctccttgccctgggggctgggagaggaagctgggtcacacacaggccagaagcaggggggaaacggggcatctaactaggacacagtcgcatccaggggtcagtcacctgaccctacagggcccaccaccttcagactgagatggaaacgccctctgggagaaccctgatccgccccaccctacacaggccccggaggtactgggcctgcgcccgccacaccttggccgcgagtggcctctgcttgggtgggctcccgtcctccggcatccgcccccaccaaggctccagaagaggggcgcatgggcctccgtcttcggcccgcttcccaggcactcacccatagctgccaggcaggtaggctgtcgagtagctggggggtctgtacccaaagcctctgctcggttgggtggtcgcgtaccccggcccccagagcgggccgccgctggccaggttgcctcttccctgtccgcagcgggaaggtccggcgcccgagctcttggccttgcgccgaggccggtacttgtagtcggggtagtcgcgcaggtgtcgggcgcggagccgcttggcctcctccacgaagggccgcttctcgtcctcgtccagcagcttccactgcgcgcccaggcgcttggagatctcggagttgtgcatcttggggttctgctgcgccatctggcggcgctgagcggagctccacaccatgaacgcgttcatcggccgcttcaccttctccaggggcagcgtcccgggggccgcggggctcccagcgccctcccgctcctggggtcccgaagatgaggaggcagcagccgtggcagccggaggctccaggctccaggcctggtcctgtgaggagcctggtagcgccatgggttgggagaagccttaagagggcgtcctgaatgccctcccctcaacgtgaagcgtcgatcctgaaaatggaaaggtcttcccagtctggagtcgttgccgaggaacttgggtccttaaaaagtgtattttatccccaagcccagagcttaaaccggagcctttgcttccaacctgttcggcacactttggggagagtcgaatgcaaaatccgctgtctggtgccccggcactgaagaggtgttctgaggcctactgactgggggacccccggtccctctccccgacccgcagctgcgatcagaccgaccttccgtggagggggtaaaccataaacccctttgtggtctccggagttccgacagctgccaggcgcggataggccagacctctcccacctgggctcagcgtttgtggcaggcgggccagacctgggaacagcttttaaagactgactccgcccctgtccctcccataagactgcacctccttaagggcgccaacatcctcagcccgtaggtaaacccaggtgtcctgtttgtcccagcccccaacaccctcagggtgccacgccccccgccccccccacccaagacctgatgtcaggccttccagcccgttgctgattgcctcccctccctgaagcacaggcaatttaaagccaattctttccacaatgggatcaaacacagggggatgaagtgccctcagggcccgagttgtgctgagaggagcttgggagcatcccggaccaccaccccaacccctttcctggtgcctgttgctcctcaaatcccagaactgcccctggggcaagaaaggccgaggagggagaccatttttgtttcctgagtcattccagcaggtgcttgggccgtgattcaacccctttcccaagtgagaaaacttaagccctcccaactccagtccctaaacctatatttctccactgctattgaattatggcaagttttagcttcagtcgtccaagtcatgaggggggagccaggaaacccaggacaactccccaagttaagaggtctgtgatgcgcatgccggagaaaaagcctggagccagaacagaacaccaccaagaaggccggaccccgggctccagaggctgctgtgagggaaccctgctccccactctgcccaacggcccagcccaagccccaggcctcaggtaatcggattaagcagcctgccttggctctcagcttctacaggaacagctccagctctgagcagccctgcctagcctgtgctgtgactcagggtataggagtggcccaactccctctaccagcaaacttgggggaggggagaagcaacaaggcacaagcccccctcctctgaaccaggagggagaacctgggcctggggagtttaggaatgtcaggaattcccagaagtaagaccatctttgggacaagagacaatgaagagaagtcagatgtggaggaacagaaaacaagagccaggggccagggcaggtcagtcctagagaaacaaatggaccaaactggggacaaagaaggcacaggagccagacagccatttggatttttttattctctttttaaatactgtacagtgaaaaataaatacgccttctcatccaccagacaaggttggtcccctccccagggggaccttgtcaccccccttcatacacacccctggttctactccaaaaccttccccgtgcctcccacccacttatctcttactatccccgtcttccacagtgatgaggccccagaaatggggggtacaggatgggaggagggatagcaggggaggccccctgaacggtcaaatctgggtgggtcgaggagcaccccccaccaacaggtggagaatgggggtgttcagagagagattggggcattagaggataaaggcacatccagtctgatggggaaggagagaggctccccttaccctgggggtagggtggacaagagggagggggtatgaccctgttacacacccctccactagctcctggaggttggggggtacccaagctgctgtgccacccccctcccccctagataagagcagctccagcgcaggtcagttgggcctgtgagggccatggtgttgggcagcaagcgagatggagaagggaggggtgcaggttggaggttttatgaaaccccattcaccatactacccaactccaagggggcggagagctccccattctccgaggggcccttaggaagcttgctgacagagtcaccctgaggggaaagtgggaaagaaaacagaaaagcaagaagcggtgagtagaaattcaggtgggagacattccctaccatccaagccctcctggcatttggtgatccagaggttggttccctgatctcatgatccagtctctcttacttgggatccagaaaatgtgaaccacactttcttctctatcctattcaaagtttacactggtctaaactccatcagacacagctgcctctgcaattcagtaggagatttgtgaaattttttgtgccccctgccccagagtaacaacaaaaaagggatggggtaaagcacatcttgcctgcctaccttctgtcctgaaagagagtcttctgagggtttagtgcgttccaggggtggcctctggcggctctgagactctgctcgtgagatatagtcagccacagtcactggggaaggcaggagattaagactttcagatggaattctggtagccagcctaagacacccactgaacccgaacccctgattttcacaggggtgagcatcccattctctcagctctgaggaaggattctggtgtccagagttggctgacctggctggcggtctccactgatagagccatcagtccgattaccacggttacggcggcggcggctgcgattacgacgttgaggtcttgattcatcttctgtagggtaggaaaaaaccagagtcacacatccaacctcccaccctcgattcctacccatctctaactttccagaccccaggcacaccctcacccaggccattctctgtcatgttgggcccatctgattccaggcctccatccatgacggtcctgtcttcatcagtgcggcggcggcgggagcggcggcgcctggcacttgctggggggggttccccaggttctgaatcaaccgggggctctggttcagacgtgtccaataggctgtagggattactgtctggatccttcagcactggtcagaggaagaagaggaggagttggcagtcaggtgcccatcatctttccttttggcccatattcatgaacccagctgtctggtacctgagctaatagatgaagaattgtatctcgaagtgggccggggggcaggtgggggtcccctaccccggcccccagtcggccgcctccggctttcttcccctcgggttgggggatccctgtcgccaggcccagctcggttgggctcctctctcttctctgactcagtctctgaagctgtagacacatctgagctggggcctgaagaacacaatgggatttattcacggccattcatcccacctcaggatccatcacatcccccaaactggaagaattctccttctcactcacaagcctcccagccaatcaatcactttttcatcatctccattccagatttccccaaacttccatccagacctctgcctctacccacaagccctgccactccttgcctcctgttcccataactgtctcaccataggcaggaccgcctgtcctccggccacggccacggcccccatagctgcccccataggttcgagtcgcatggagggaggaggaggagctctcatcagtgctatatccagccttgtcgctgccaccgctgccccgcccactcccaggagggcgaaagcccagcccaatctgccgaagctgctcatcaatttgtagcctctccaagcgaagctgctctacctcctggttgggtaaaagatggaagaaggggaaggagaaataagatcagtgccttgcttcatgcttctgcaccctgactgtccctctatatctaacctctcaggaatgcagggagaaggaagacactggctaaacaaggaaaattctgggacccaaccctatagccccaaatttccacagatgttttctgttctacacggagagacaaacagagaaccaaaatccctgagctgacccccacagcagtcttagttcccttttcacacccagcatttttctctcccggcctgggtacctgcaggtaggagaggtgatactccagcaaagcctgggcattgctgatgttctctcgggtgccaacaaaaatgaagggaaccattccctagagaacagagagcagaaacgatggatcagaaaggaaaatgaaatggaaggattaacgccgcccagtctcctaggggagcctgcccagtgggatcattctgggctctaaatctactagtgttaaacaactttccgtactccaccctctcaaagaacaatcccagccctcagaggacaatcccatttacttctggaaaccaatctctatgcccacttgccccgtacccatacctcctccctggggttcttcttgtcattatcaccttccactcgaaccctcaccacaccagatttatccacaatctcctggatcactttcccgttctttccaatcactttgcctggaataggtaaatgaggaattcagccttttattttttttaaggaaataagaataaagctgatacaccgtcttccagcctcattttctttatatggattccatttacttcattctcctgcttctaggtttctgatgtgtttttacaggacaaaatgttacaatccctagaaatttattctttcatttttatcactccc

SEQ ID NO: 18010 - DNA, 13818 bp, Homo sapiens
gaggctgagatggaaggattgcttgagcccaagaagttgaggctgcagtgagctatgatggtgccactgcactccaacctggatgacagaacaagaaactgtctcaaaaaaaaaaaaataaaaaaaaaaaaaaggtcaggcacggtggctcaggcctgtaatcccagcactttgggaggccaaggtgggaggattacttgagcccaggcagtcaagaccagcctgggcaacacaaggagaccctgtctctaaaaaaaattttaaaaattagccaggtgtggtggcacatgcctgtagtcccagttactcaggaggctgacaagggaggatcgcttgagcctgggaggtcaaagctgcagtagccatgtttgtgccactgcactccagcctggataacagaacgagaccctgtctccctgtctcaaaatattaatgtgtgtgtgcgtgcgtgtgtgtgtgtgtgtgtgtgtgtgtgttttggtctccatcctggctcctggccagacctcctaaagcccttgtaatttcctaaatgataaagtgaagggagcttttgttattcataacaagctcttttcaaccacaactgagtttatgttagtaagttgacttttagaaagcccctaaggttggggtttgttgccaaggtaggcaactgtgtgattagagagttagaacttttagctccaaccctctgacctccaactaatggctattgaatcaagtatgcctgcataatgaagcctccataaaaaaaaacaaaaaagatgagggttggagagctgccaggttgatgaacacatggaggtgcagggaggtgcccagagaggacaagaaagctccaaatcccccttccccgatactttgtccggagcaactcttccatctgactgttcctaagttttatccttcataataaactagctaacataagtaaagtgtttacctgagttctgcgtgctattccagcgaattactgagccagaagagggagtcataaaaacagttaggaggcctggacttgtttgtgattggtatctggagtgggggcagccttgtagaactgagcccttcaacttggggattagataactggtaattatgggtagagtgtcagaactgaattaaactgcaggactcccagttaatatctaccaagaactgaagaattgattggtgtgggagaagtctccacatgattggtgtaagaagtggtgttcttggccaggcgcagtggctcacgcctgtaatcccagcactttgggaggccgaggcgggccgatcatgaggtcaggagattgagaccatcctggctaacatggtgaaaccctgtctctactaaaaatacaaaaaattagccaggcatggtggcgggtgcctgtagtcccagctactcgggaggctgaggcaggagaatcacttgaacctgggaggtggaggttgcagtgagcagagactgcaccactgcactccagcctggccaacagagcaagactccatctcaaaacaaaataaaacaaacaaacaaaaaaaactgagattctttgcaaagagcctggaataacttccttttagtcctggactataatgatgatgataaatatacctcgatgtaaccctgagatcccaagattcactagcccttgaataaaaaaaaggaaaaagaaaaaaacagtatattttttcgttttgcaaatcacagttcccttattaagatggaattgctgccaattacagagaagctatttgcctaagccaaaaatccatgaggttcacatggacttatagttacacaaattagaaacaaatgttatatttaaaaccatagagaaatgcccaggtgatgaaagctggggtgaaggagtctgcacattcatttcaaactgttaaaggatttgtgggccatgcaatggtcccttgcattagagaagtcaaagagctttgtgcaatcctctcctgtctgtgatctggaagacacgtgctcatcacagagctccagctgctccgagactttactcctttcttcagctgcacgcactgctctctcgcttttgttaggaattgactaattcctcctcttcctcttcctcctcctccttgccatctctaggcccagtcagcatctcttgttcatcctctgatcccatgtccagctatggttctggattcaacactagcagcaacagtggcgctgactccactttaggatcaataaatatttttctggctaggcgcagtggctcacatctataatctcagtactttgggaggccaaggtgggtggatcacaaggtcaagagatcgagaccatcttggccaacatggtgaaacctcgtctccactaaaattacaaaaattagttgaacatggtggtgcgcacctgtagtcccagctacttgggaggctgaggcaggagagtcgcttgaacccaggatgtggaggttgaagtgagccaagatcgcgccactgcactccagtctagcgacagatggagactctgtctcaaaaaaaaaaaaataagtatttttctttctagccgtatatccaccttacatggtccctcaactccccaagcccactctgcctgccccatctcctccttccacatcctctcctcaacctagcacttggttggcaatgccttcctcgatcctctgccaaagaccctctagccagtgcttaccctgtctgttctctctctttacccaaagaaatacataaagtttgaccagaatggaaacagagatatcagtgaaaaaaggtgatttggggaagtgtgcaggcctaggaagacagaggcttgttcctttgcttgcttaaaatctttgatcaaacggccaggcgtggtggctcacacctgtaatcccagcactttgggagggcgaggtgggcgaatcatgagatcaggagttcaagaccagcctggccaacatagtaaaaccccgtctcactaaaaatacaaaaaattagccagctgggcgtggtggcaggtgcctgtaatcccagctactctggaggctgaggcaggagaatcacttgaacccgggaggtggaggttgcagtgagtggagattgcaccactgcactctagcctgagtgacagagtgagactccatctcaaaaaaaagaaaagaaatctttgctcaaatatcactttttcagagaacgcttctctaaccactctatttattttattattttattgtattttttgagacagggtctcactctgttgcccagactggagtgtaatggcacggtcatggctcactgcagccttgatctcctgggctcaagcgatcctctcacttcagcctcccaagtggctaggaccacaggcgtaagccaccgtgtctggccagaccaccatatttaaaactggggacaagtcaggctcacacctgtaatcccagcactttgggaggccaaggtgggaggatcacaaggttaggagttcaagaccagcctggccaacttggtgaaaccccatctctactaaaaatacaaaaattagccgggtatagtggtgatcgcctgtaatcccagctattcgttaggctgaggcaggagaatcgcttgaacccgggaggcagaggttgcagtgagctgagattgtgccactgcactccagcctgggcaacagagcgagattctgtctcaacaaaaaaagctgggtgcagtggctcacgcctgtaatcctagcactttgggagtccgaggtgggtagatcacctaaggtcaggagttcaagaccagcctggtcaacatggtgaaaccccgcctctacaaaaatacaaaaattagctaggtatgatggcaggtggctgtaatcccagctactcggaaggctgaggcaggagaatcgcttgaacccaggaggcggaggttacagtgagctgagatcaagccattgcactctagcctgggcgacagagtgagactccgtttaaaaaaaaaacaaaaaacaaaaaacaaaaaactggggaccattggcaataatactcctatgtcccctcttccctactttgttttcctccataggcacctggcgccttttttttttttttttttttttttttgagacggagtctcactctgttgcccaggctggagtgcaatggcgcgatctcagctcactgcaacctctgcctcccgggtttaagcgattcgcctgcgtcagcctcctgagcagctgggattacaggcacgcaccaccaggccctgctaatttttgtatttttagtagagatggggtttcaccatgttggtcaggctggtctccaactcctgaccttgtgatccgcctgccccagcctcccaaagtgctgtgattacaggcgtgagccactgcgcctggccacctagcacctttaatatacttatttatttgtattgtctgccttccccaattagatcaaccatgaagacaagagttttcatttgttgggttctctgggcctagaggcatgtctggcatatagtaagcattcagtaaatatctgttgagtgaacgtatgaataaagaagtgagttcctcccagcaggcactgagaacattgggagtacagggttgcagctctctctgcagcaggagaatgtagctgcaataaagggaagtcaagaagccagagtccagccaggtgcagtggctcatgcctgtaatcccagcactttgggaggctgaggtgggtggatcacaaggtcaagagatagagaccatcctggccaacatggcgaaaccccatctgtactaaaaatacaaaaattagctgggcgtggtggtgggcgcctgtagtcccagctactcaggaggctgaggtaggagaattgcttgaacccaggaggcagtggttgcagtgagccgagattgcaccattgcactcccgcctgggcgacagagcaagactccgactcaaaaaaaaaaaaaaaagcagcagcagcagccagaggccactccagcatctcccctacctggcttgggtcagggagagggcagtgagaagtgaaaactcccagctacagaaaaggaaatatgttggggggaagggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgcgcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcrgcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtagaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttaagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttac

SEQ ID NO: 18011 - DNA, 17797 bp, Homo sapiens
agcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccatagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgatgtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttacagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaaaaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacgaacaaagggatcaataaaaagaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagtaaacgtgctactaagttgcacgacttgtcaagaaaagaggcgcttccgagtttgagaattgggagcaaatggagtccgagtggacagaaagacaagaccctgaccgtggggaatttaaaggccggccagcgtgcttccgaaggccgggggtggaggcattaccgcctctccgtgccctcttctcttaacctgccctgggccaagggcctcggccccgcgaaactgcgagtcctccagaaagacacatcgctgttggggtgtccaacctttctgggattcgtagtttatacccaggtcctggttatattttagttaagagttctaataagcagctgtttaatgagcacttgtgccagcccatatactacgggttttgtgtattattttaaaaagccttttaacgagcttttaacattttttaagtgagtacacttagacgaacataagtgtcagaattgacaaatccaggcctacaggactccagatcgagcacttgtactttactgccccaataaaaagctgttaacattttagcttatttttttgagagagggtctcgctttgtcgcccaggctggagtgcagtggcgcaatcacaactcactgtagcctctgcctcccgagcccaaccgatcttcccacctcagcctccctagtagggaccacagatgcacaccaccacacctggctaattttatttttatagagatggggtcttgctatgttgcccagcctggtcttgcagacttggcctcccaaagtgctgggattataggtgtgagctactgtgcctaaccacattttagctttttattacaaaaattttcggccgggcgcagtgactcacacttgggaggatgaggcgggtggatcacgaggtcaggagttcaagaccagcctggccaaaatggtgaaaccccatctctactaaaaatacaaaaattagcctggcgtggtggcgggcgcctgtaatcccagctacttgggaggctgaggcagagaattgctttgaacccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcggcaaattttttgtggcagtccatgggatataaatttatcaagctaggtgtggtggctcatgcctgtaatcccaacactttaggaggctaaggtgggccgactgcttgagctcaggagtttaataccagcctggggcaacatggtgaaactccgtgtctacaaaaaattagctaggcgtgatggcgtgcacctatacctcctactcgggaatcatctgagccggggaagtcaaagtcatgcctgggcgacagagtgagaccctgtcttaaaaataaataagtaaataaataatctatcgaggaagatccatctctcacagcattaactgctccagtcacttggtgctatccaaggacaacctatttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctataagattgatgatttgccaattttacagatgaaaaaacagacatagcagttaggggttggtggtgttttgtttgtttggagacagagtctctgtcgcccaagctggagtgcagtggcacaatcagggctcattgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattacaggcatgagctacctgccctgcctgtagttagggtttggacacattctgcctgacaccaacatctatcctctctaacagccagattacatagcctctttgtagtaataaatgttgagtgaatgtgtcagtgaacactgccagggtatacatatttttctaattgtaaactaaagagagcaatccaccgtgccccagcacctgcatcatacctgttctaaagcatttaccaagttgtattgcaatggtttgtctacacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgttgtgataatgaaagcaagaagaaaaatatcagtactgtggccatcaatgcagaggcatggcagaattggggggtggggtggttacccaggttgactggggaggggcaaagaggaaaagtcatttaatgactctttgtcatggatccaatccccagttggaaagaggaaggcagccaacacctctacccctaaatcttgctgttttgactgatgaagaggttgaacccatcctgtgctggaacccaccctcttttgctcccttcattgtctctccagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgtgagtggtaaggaggcagaagcatcactgggttcagtctctgcccaaagtgtgagaatccacccaccaagagctggcctcttagctggtatatctactatgcttggcccacggaattcagtggctgtattaattgccctctggagaaagatgtgcctaaccaatgcttggtagcttgaaacccaaggagagctgggcttcaataacaaatacaatggagtaaatagaagccgggacaggccagacgtggtggctcacgcctgtaatcccagcactttgggaggctgaggcggacagatcacgaggtcaggagatcgagaccatcctggctaacacagtgaaaccccgtctctactaaaaatataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgagtttggttctgcatctctgttctcatacttctcccacctgccttgacaggccgccctgacatgaagactgagctcttttccagctcatgcccaggtggaatcatgctgaatgagacaggccagggttaccagcgctttctcctctacagtgagtagggatacaaggcaggaagggttggagggaaacaagggagggcaggagaactmctcactctgggtcctatgacaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggkgttaaaatctcataaaacaggattaggactcacmaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaataactgacctgtaacttcatctaagtccccagatgggtacaatgggagctgagttgttggagggagaagctggagacttccagctccagctcccactcaagataataaagataatttttcaatcctcatctcattctggggtttgtctccagacgtcattcccactcctcccatttcaacattccccctggatcctctaccacctaaactcccagctggacggtgtcagtaagaacagagtggcagtaactctcactttgtagtggtatatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtctgtctatcctgccctggtctcctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacaccctaaatagttctgttctctcctgtgtatgaaggggggccctgcaccctcgtactcgggtttcttccccatccctgaggtccctatgcttacaatttgggtcatgcctcacacttttctcctaaagcccacactctcttcaccctttgcccccaccccacggtcacagcccctttcccgggtctcccctctgctcctcaccttccctctccaacccctcactctcccagtcagtggccgcctcatccccattgggctcccggaggctgacagccagcaccaaggcctgcaggagaccaaagaggcaggcgaagtgcaaagggtgggcagtaagtaggctcagaacagcatggagcccatgcagggcagccaggaaggacagtaggccatgtagccagaggcccagcggtccacgcaggcccagtgtgtccaaggctgcccgcagtggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccacttgagggaatccattcttttgctccctagctgctcaacttggggctcctccttgcttggttcggaagcagccctagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgcttcctcttcagttctggggtaaaggggggcatacccaaattcattcaccatccacacccccacaatctgagattccaagaatctcagatctgacaaggcctgggtcaccaccagagagtcctctctgcgtttccggatttccttcccagcaggcagcaccccaagtttcactcaccaaggccacaccccaaggtgtcccagaaactggggaggcagtgctccatccaataaagcgggcaggaaggtggccccaggtcctaggtgctcctggatcgtgtagtctttaactgctgccccaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggccgcggccttggggagccgccgggagccgcgaagcccggaagcagctgcaccaggactggaaggacccgcgggggcggtgccgcagctcatggggcggaccctgcgaatagaccgcccccgtataccccgcgctgtctgtgcgcgccggaccgccaaaccgagattagcaaggaccaggaccttaatataaacccagctccccattttcccgggtttctcatgcttccctaaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaaagaaaaaaattgataacatggcactttccctctccagctgtgaactctttgagggttgggaatgtctttacctgtattcttggcacatagtatatggacttatgtttgtgaaatcagtgaattggctgtagtcagggaactcctcctgggggaagtgagacttgcacgaagctgggcaattcttggtccaggggggttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgagcagatcccaggaaggggaagtcaaagggcccaggtcagaggcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgggtatcccaagctgggaaatgtgtcactcggggctggggtgctgatctgtagcctagtccttcctggtccctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagttctcgcagtactggagggagggagtaggagacctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcctcagcctcccaagtagccgggattacaggcacatgccaccatgtcccggcaaagcctgctttctacaaaaaatatgcttgagcccaggaagcggaggttgcagtgagctgaaatcacaccattgcacaccagcctgggcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacaattcttactacccccatttctaagatgagaaaactggaacatgtagacattaggttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctg

SEQ ID NO: 18012 - DNA, 14769 bp, Homo sapiens
cacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacctatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagttttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataatttttttaaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgmactttggagtgatcggcccccagagggaagaggtgagtgcctggccagccttcatccactctcccacccaaggggaaatggagacrcaagagagggagagagatgggatgggtgaaagatgtgcgctgatagggagggatggagagaaaaaaacrtggagaaagacggggatgcagaaagagatgtggcaagagatggggaagagagagagagaaagatggagagacaggatgtctggcacatggaaggtgctcactaagtgtgtatggagtgaatgaatgaatgaatgaaygaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacrgatgaatggagagagaaaaccagacacctcagggcyaagagcgcaggccagacaggcagccagctgttcctcctttaagggtgactccctcgatgttaaccattctccttctccccaacagttccycagggacctctctctaatcagccctctggcccaggcagtcagtaagtgtctccaaacctctttcctaattctgggtttgggtttgggggtagggttagtaccrgtatggaagcagtgggggaaatttaaagttttggtcttgggggaggatggatggaggtgaaagtaggggggtattttctaggaagttyaagggtctcagctttttcttttctctctcctcttcaggatcatcttctcgaaccccgagtgacaagcctgtagcccatgttgtargtaagagctctgaggatgtgtcttggaacttggagggctaggatttggggrttgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcmacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcgggtgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccgaactgccggacgtggtggcatgcacctgtaatcctaccactttgcaaggccaaggtgagaggatcgcttgaacccaggagttccagagcaacctgggcaacatagtgagatcctgtctctattttttaaaaaagaatgaaacataggaataagatgtgggtgaaggactcacatgccggcttggtcccactggtctttgtggtgaaggaggggagaggtgagaggtgggtaatccggaaagagaaaagcaccccctccctggatgaaggctcttctggagagagtcaaagacaaataagggtggggcgcagtggctcatgcctgttatcccaacactttgggaggctgaggtgggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaaacaaatatggagacggaaattgagcccccctagactgggagcccccactgagttcggaaattaggctttacctccagccctggggtgccaggcaggagaaaaccatgtggtaggctgagggggtagggtgacccattggggtgacctagatagggccttgggtcaccctctgcctcctccagcctgtggctgaaagtcagccatgaagtaatgggggacactgttactcatcccagaagcacccacacttactcacttttgggaagggggacctaaagtgtgaaaaaaaggtgaggattttccgtctcaccctaaatgggacaccctaagtggggcatcggtttttcctcctccccagaacttcctggtgttttcaggcaccacaggctccttcctgccatccccatctctctctaatattctccccttctttctccttcagcctcctcccttcagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaagcttcggagtttgagaagtcccccttcctcccaccctccaactgggctaatggtggggcctggccattcagaggcagggagggggtgggacaggcagaccatcatccctaggagcaaaggccatacactgtgttgtgatgaattgtttcaagcaaccagaagagtactgagaatatttaacccgcacccgtgcacccaccctgaattaagacgtgtgtcgcaactcagcatctttatcggcagcactgaagctttccattctttattttcatcaggttcaaaatcaatttccaaacagtctcctacatttttcccactgccatggggtcctgggcgtccgggcccccaatattcacgcactcgcaccacgcactcatattccctcaccccaccatcacggccccaaagaaggtcttccctctcgcgaagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccctgggggtccccgccgccagggggcgcccggccccggtagccgacgagacagtagaggtaatagaggccgtcctgcgggagcgccagcccctcggcgtccgagaactgcgtcccgctcgtcagaaacgcctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgctgtttctgggatgagtgcgagttgggggccgagggaacacggatgtggggtgcagaacgctgtagtggggacctccaggccggcttttgcttgcaccggagggaagaagaaactacactgcggggacgagcgtaagagtgggcacgagcgacaaaaggtcgtgaagcgggtgggaaaccgagcactggaatcatggagccgaaggactctgggcgagcagaactggaaccttcggattatttacactcttattcaggtcttggaggtccttacctatgaggtgggcagctgggagcccggggctgagatctgtttctggctcctcctctggcagcttctgaaaccctggaaggggcaaagagtccacgattgggggcagggcagccacccatgcaggctacccttgagagaacagggcgcagggatggggagcctggattcctagaggaagaggtatctggggacgcagcagggagctgggagcccctgagggtctgaagcggggaaggagagacagtctgctcttacccagtccttgctgggcctgtgccccggggtcggccgtctccgttacctggttgggtggggtcacagtgcccagagttcagattcagctcatgtcacccctacccctctgaaagtggacccaagctgcaggcctggggtttctcctaccagcaccatccccaacacacacctccttagaagggagaacaagcaaggcataggtacttgggcggagaaacagatgtacctcgggaagaggagaggagacacaaggggcttatgtcgggacacaagcacaacatcacaggaacatggaaagagagtcagcaaagagacaagacatccccaccagggacagccgagccagctgagccagagggggcaaaagaccacaggcacaaccagagggagccaagcatccgcaagatacaactctccaccagggcctgttgcagccactcaccagtcctccctgatcctggggcactaaggccagcacagccaggacagtgataggcaccgccagcaacaaggtcaccagagaagtggctcctgccacagctagcaggagggaacccctcccctggagcctcccacccctgccctccagccccagtgcccccattgagactgaaccagagccagagcagggggctttcatacctcagggacgggcccaccccctccctgtagacctgcacacctggctgggactttccgcacacccctgctcccctcacccagcttcctgtttacccagagctggggtggggcagctggatgcctgggttctctgaactggggaagaagttgaggttagggagacaggctctcagggtggaaccaaaggggtctttagacatcttctggctcagcagagagagaaactgaggcccagggagggaaggtagcttgcaggaagccagtcagcagagctgaaatgagaacacagatctccaggtttccaatgtggtttgcattcttctataccctcaaggtaggtgctggaggaagagctgatcccgtctctgaggtcaagggccggactaggacaaggactggaatcttgagggatggatgtctgggttccctgagaagaactgattcccatactgggctgacctcctcccgttcccttgctcatctccagccccctgtgctgagtgagaaagggagaggtaagccttagcctcaccactgactactgactcactaaggagggatggaaatggagctttacctcccttgctacaaaaagtaaagacagatggacgaggcatactcccaccctcagagagcttccaagtctacaatgagccctatccattagtaggtgcttactaaatgtttatacataaatgaataaaaggacaaataaatgcaggaataaccaaaacaaagcagcaaggaccacatgaatggtagatgtaggcagcatgagtggttaagagtcaagggagtagccggggtagtggcttacacctgtaatcccaacactttgggaggctgaggcaggtggatcacttgaggtcaggagttcgagaccagcctggccaacatggtgaaaccctgtctctactaaagatacaaaaagttagccgggcgtggtggcacgcgcctgtaattccagctacacaggaggctgaggcaggagaatcacttaaacctgggaggcagaggttgcagtgagccaagattgcaccattgcactccagcctgggcaacaggctgagactctctctctcaaaaaaaaaaaaaaaaaaaaaaaaagagtcaagggaagaaagaccaggtccaaggaagctggaagtggctccaatcatctccccttcttggtaacatctctatgtgtttccgtaatactaataataatatagctgacccacaaaatgcacttaacatgtttatgccactgatttacacactttaataatttttttttttgagacagggtctcgctatgtcacccagactggaatgcaatggcaggatcatggctcactgcagccttgacctcccaggatctatggattcacctacctcagcctcctgaatagctgggactataggcacatgccaccatgcccagctaatttttgcattttttgtagagatggatttttgccacattgcccaggctgggctcaaactcctggactcacgtgatctgcccgtgttggcctcctaaagtgctgggattacaagcatgagccatcatgcccagccaataattataatcctgacaaaaaccctaagaggaaactgaggtacagagaggttaagaaacttatggagctcacagagtcagtggcagaaccagaatttgaacccaggcatctggctccagagccttgataacaagacagtttaaaaactgaatactggggctgggcgcagtggctcttgcctataataccagcactttgggaggccaaggaaggtggatcatctgaggtaaggagctcgagagcagcctgatcaacatggtgaaaccccatctctactaaaaatataaaaattagcggggcgtggtggtaggcacctttaa

SEQ ID NO: 18013 - DNA, 40000 bp, Homo sapiens
tcaccccgtcggcttggtcttcccatcatgaggcccatttcacacacggggccaggtgagttgcccaaggtcctacagctgatgaggtggaggggccaggagtcagccggcctcagagctgtgctcttaaccctacctgggcaggccactgtggaaacgcattgaggccaacacttcctgcctgctgtgggctggccatacaacagcatgcccagccctcagcacagggggaaatgaggctcagggaggcagctctcctggcgtgtgcctgctctgccaaccagctgctcggtggcctggggcaagccgctaagcctcagtttcccgtctgcaacagaacagccacctccgcggcatcagaagctgctgcagagtccgaggcacggagtggtcttccagggcacggcactgtgccctgggcatcagtatctcctctgccttgcacgcctgcgtgttacacaggccaggcccgcctggggggtgacttggaacctcagcttccttctgacctgtaggcaggggcccccctcaagggaagcagctctggagaaaaagtacaacatccttccctgcattctcctgcgttcggcagggacagaaactgggcagctttctggagcgcggtttggcaacatgtgggcactgaaaacacagtgctccctccccagagccagggaccctcagtgtcagagaggagccctgcgagctccctccccagagccagggaccctcagggtcagagaggagccctgcgagctccctccccagagccagggaccctcagggtcagagaggagccctggcttccagcacaaaggcaggtgcactcagtggatcctgcagccctacagcaacggtgggaaccaggaaaacctggacgacagggcctcttgctccccccaccccatctgggaagtgtgtgggaagtttctacactgcgtcaccctctctactactgtttaccttccaaggttgagccatcctagtggctgctgtggccacacctgcagcccacacggccaaccctccacagcatctgtccagaggcccaggcagctcctgccaggaaccccgcagtggcgcctcctgtccctctccccaggttagaagcctctgctgtccaccctgcatcctccatgggaacaagggcctcgcgcggagccaggcctgggtttgaattctgactctcgagctgtgacgcctttctcacatatctgccaggatgcagagaggagcagaccacagagcccctgccctcgaggggcttagcttctaggatgggagaggcaccaaaatgcaccaacccataaaccagagtggggggctcaggggaagtcaagacagcagagggctgtgatgtgtggacagcgatgggggaaaggccagggtggcttcttgaaggaggggatgcctgcagagacctaatgatgaggcagagctggccacaggggagcagcatggcggcacaagggcggaggcaggcgccagtctgagtgtctgaagagtggatgagggcagccggcagcctctgtgcacaaccctctcgtggcacctccaccatgggggcggccgggtctgctgacccctggcttccactgcacacccaggtccaccctggtgccggcccatgccccacagcgcctcaatccctcgcatcctccccacctgggcctggcacctgccaatgcctctgcctggagcccttaacctggcgaggcccaaccccacatggaggccagcccctcacctcgctacgctgcccgatgccccactggatggcgttctgtcagggagatggctctgtctggactcccagctctctgccaggaccaggcctgtaggaggcactgggcacatggtgctgacggaacaaaggcccggtgggtggcacagaccccactgagaaggatgaggagctctggccagcggaggcagggggccccagaagggtctcggaggcctcccttgggaagggggcgagtggagacacagcaaggactgtcttggggctgtgcccagcaggctgtccctggcatcatcagtgcccccccgacccagctctcagaacctcgaaaacattccttagtwggaggctatggaagctttgaacccacacaccttctccaaacatgggcagtgatgcccctgcctcagacatctccccgcaaggttttgctaaaaatgtggatcccatgcagactgcaaaggcagatggggcccaggaatgtgcaagaacaggccccggggtcctgatccacagctgcattcaagaaccgctgcccagaccagggacacagaacacaagtgcctggggctgtggggcagctgggttccggccacactcacctcgagggctgcgtcatttctatcgggttctgatgccccacatcatcggggccagagcgctgccttggccaccaaggagctgccctactcagggacactcaaacacaagcgtgggtgagcaatgtttaggctggggaggaaggcggggctctcctgtttcctgacccttgcagacactgcatgtcggtatctactcatctttctgtacgtaaagggcctgggataacttacgaagcattttcaaagccacggaaggctgggcgcagtggctcacgcctgtaatcccagcactttggaaggctggggcgggcagatcatgaggtcaagagttcaggaccagcctagccaacatggcgaagccctatttctactaaaaatacaaaaattagccaggtgtggtggcgggagcctgtaatcccagttactcgggaggctgaggcaggagaatcgcttgaaaccagaaggtggaggttgtggtgagctgagatcatgccactgcactccagcctgggcgaaagagcaaaactctgtctcaaaaaaaaaagccatagaaaagatgctagtgttagcccatctcccagagaggaaatccgaggttcagagaggccccaagcgacttgccccatcgcagagcaagggactggtacagtggggcctgctgctggtagctgtgcctgcaaggactggctggggccccaggttcagctcaaaataaaaggaaggcacagcacgggccacacctcaagccccaagggggagtgagaacaccggctgaagttaaggtagaagcagccacgaagccccgccaggcaggagctgggttccagcagcttctctccctcctagggttgcgcctcgcccctgcacttgtctgagttaccaaacaggtttcaaaacttccaaggcgcagtttcctcatctgtaagttgggtcctacagaggctgacctcaaaagcttgctgtgaggcctagaggtgccactagaacagcgattcccaaccaggacaactgtgcccccaggggacactggaaaatgcctagggacggtcctagttgtcacaactgacaacyaggaatatgaggtgcgggtgggggtgctgctgacattaggggtcgaggccaggggtgctgaccgcttcctacaatgctcagggtgcccccacaacaaagaacgatgccgtcctaaaggtccgcagtgccaaggctgagacgcccgactgtggaccatcagaaaccacatggggaaggggaagggcaaagacaagggatcctcactgctgctctgaccacaggtgcccacgccgggcggccacaaagaaggcaggtgggagcaaagagagacagaggggctcatgcagccacgcacgcatgggcgaacccactgagtggtcaggtgagaaagaaaaatgcagccaaaccaccggccctgcactgtccaagggcggccccgccccggccgcaggcccaaggcttcactgcctggcaatggggagcgggtgcacgcaccaggcaggttcctcagcatccccactcacacgccatgctcagaaagctcaggtgccacagcctctgcacacaagggcacagcctggtagctgcacgccgccccacccaccaagtgtgtcccctgcacaggctcgcctgccagggcacgtgtctgcctggccctggtgggactctcctgcactctccacctcagtgaagagcccaccaggccacccaggcactgccctgcccactcacccccactgcagcctatgcccacaccatccaacagggagctccctgcttccatccctcaattctccgatcctccctctccttcatcaccgactctccaggcgggcgcagtggcgtggccctgccttggtggtggtggagacctgcctccatccctgaatccttcacccagcagcagttggagctgtcttaaaaacatcaagacccacgcctggaatcccagcacttagggaggccgaggcgggcggatcatgaggtcaggagattgagaccatcctggccaacacggtgaaaccccgtctctactaaaaatacaaaaatagctgggcgtggtggtgcgtgcctgtaatcccagctactcaggaggccgaggcaggagaatggcttgaacccgggaggcggaggctgcagtgagctgagatcaagatactgcactccagcctggagacagagcgagactccgtttcaaaaaacaaacaaacgaaaacatcaacaccccatcacctccagaagcagaaccctccagctgcctcccactgtacccagaagaaaacccaaactgctcccttgtggcttcctgcgttattaggcctcaacctacctcttctaactcatctccacttgcactgcgccctccctggccacactcccactgccctgggctccttctgttcccagattcgactccttcccaccacaggaccttcgcacctatgcacttgcttcttcccacagctcaaagctcacccctcaggggtccacccaggcggctctgtttccttatgatcggaagccccttcatcatctaccttgcacaatgtcttccccacaagagcagggtctcagctgctgcgtcccaagtgccccagcacagcaggtgcccagtgctgagcatctgaggcaggccccggctttgcaggtagctgggaggcaaaagagcccccccgtggaatggcctctgcttcccaggccaagagtccctgccccaagaaggcagagaaagcagttcagccttgagcagccagggctgggcaggctggagggacaggcaggcacggctccacccagcaagtcacagctagacaggcacagcccgccagcctctgctccccgaccaggtgcctggcggccccgggtgacctcatcactgcctctggggaaccacacgccccagggggctgctgtgaggatctattgcttctgtgcaccccagagacttcagcagcatcgacgcctccttgggcctgaggaatgctgggagggacagaggccctccctctcctaggactttcagccccaggtcagggggcagcagccaagaacccttggtgagcaaaacagaccagcggccaggcgcagtcaggtaggagcccaaaggtcgggggacccaatgctcatcagggctgctcctgtttggccagggcccaccggcctctttgggcacacggcacttgctccctcctctagaagccactttggaatcggccctctgtacggccgctgctggagtcccacgcgctccccagggttgcagagccacagcccagctgtaacctcaaaggagagggcaggagcctccttcccttccagtttccttccaagttccggcctcagaacaaccgggcgtctgtgcctcctcatcctctgcagaaaacttctatcctcccaccaagaccccagagaagggtcttgcaccaatcagaggcggatctgtttaccagagaattaatcccaccacgtgtgcaaagtccaggcagagccaaggaagaaaccacaggaatgggtgggacagaccccccacatgccacccaagccccactgcaacgctggacactgggcacaggcacctagctggggtccggggtgtctgcggaaggatgactcaggggttctctgcttccctctagtgccggagcctgggcaacaccaaacccccaaatcacggagccactgaaacgggccaccattagggctggaaaggccaggccatgccgggagggttgggcatgcaggaggagctggctctgccacagcccaggagaggacagggggaccccgagcctggtccagactggaaatctgaggtgcctgcctcccttcccgttcacacgtggcccaggcagcatttgcaccccaacacacccagggtcagcacacagtcaagagcaccccagctgactctgtccacagagactcaggggtccaagggcaggaagagccccaagcccggatcctggccatgcctgtccaagtcgcatggaccatcactcagcccctccggcctctgtttccccatctgtaaactaaggatgctgcagagtccaacagattgcccccaagacagagggcttgggcctccggcagagtctgagaaccccgtggtgggcgggagagagaagtacagatggtgctggggacacatgctgcccacactcaaagcagaactcgcagcgaaaagaactgaccacggcccaggaggactcattttctgaacataaagtcgcctctgaaaataaaaacgaaaaaggcaaatgagcccatttcactttccctgctctccaggggccttgccccacctcggcagagacggaccgcagctcttagggttctgactcccgcctggctgggtgtgggaaggtccccgaggcgcctggcaggcaggaagccaggccatggccctgcctcccgggaatccccagtgacttgtgagggggagggccgggaggtctagggacattcaagttctgtggggcagccagccacaggacacaggtcgaacgccctctctgtggggcaatgccaggcccggaacagcatctccacctgaaccggcccaaactccaactcctgaccttctccccaaaactgtactgcacagctgcctccaccccagtcagggccaagcccatctcccatttcaaaggcccaaagctccagaatcttcttggactcctctttctttcccaggttctttaaaatagacacccagaatctcactgtatctcaccagggccgctggtgcaggcagcaccctcgtctcatgcctggattactgggcatcctctaagggcctccaaccaccacaataccctcggcagtccaggctcaacccagcagccagaagcaaaaacactctgaaaacaaaaatgcagactgacccatccctcctccgctcggagcctgcgtggtccggtgtcacttggaggaatgtagcagtgcctccctgggtcatcaaagtcctctaggagctgaggctaccctgtcgggccctgagcctccccggctgctcccttcccctccccagctcctgtcgccttctgaggcatgctgacctcctttgtctctgtcctcctctcagcacctcgctgcagaaagcactgtgattaggagctgggaccgggtctcccctcacccccatggcaggcatccccagcctggcacaaagcaagcaaagatctgtcagacaagctgacccagtgtccagctccctactctatccaaatgagatcagcaggaaggtcctgatgcccgcaagcacactgcagagttatcagcctgtccaccctggacacaaggtgaaactgaggctaaacgaggaaagctcgagcttgggcctccactcagtctgtgatcaggcttctaccctgagacaaagctgtgccccttggcccaaggcttccagaagaggctccccaagcccagcagsgagccagggtgagaactcatgctcggagaagagcccccgccacccaaaggctgctttctgtttcagcagacaggacaaacaacaggtgcggcacgggcgcccgcccaggagggccacggtgcagcccacgcctggctccagatgagctgccaaacaggaagccttgtgggggggcaggggggcggcggggccaccacgagacaccctgagggtgaaaacgtgacgccacagtgttggggggagtcacttcctcccagcccccatgccgcctggctctgacctcagcttctgcccctgccctgcggtgctcaccctgtgcccgccacggcgacctgcagctggcctgtcaccctgggcctgggctgctcgctcttccccagaagccaacagggcccatttccgccatcctcagtggagccttccccagcacgcccgcacaygtgtgcgtgcgtacacacacacacacacacacacacacgccatcacctgcaaacagctcctctggctttgtttcactttgtattataaaataataaaagactcccaagaagttgcaaaaacagtacagagagatcctgtgtaccctacctcctccatcccccaagggcacatcagagtaactaaggacatgagcaaaaccaggacactaacccaggcacactgctatgacctggactgcaggccttcagcacgctgcatcatcttctacacacaccaacattcttacatgtcatgtgtagttacacacaaactgtgaagctttatcacacacacagacacatctccccaccactgtactcgagacgcggaactgttccrtccccacgcaggcactcattccgccagcttcctgtttaactgcacgcatcaccatgtgggcccacgagtgcacaaacagaatgtgagcacgagatcggggaccgtgtctttcttattcaaaggatccctggcaccaggtctggcatacagcaagcactcaataaacacctgatgaatgaatgatgctgggagtagctgtygacattctccccagcttgtgcatcccatgctctcaaggagayagacatcttcccatcactgcctccccagtacgtcctcttgctctggggacccaggtgctctgtccaggccccgtggtgtgcacacaccaaggccccgtgatggtaagggcagccatctactacccagtgggcaccagagaccttcacacaaaggacgtaggggtccctgaaactatacatgcagtggggcaggcacatgcctgggagagggtctcacggtcatcatcagtctcgaggccttgtgctctgaatcatccaagagctgccatctagccagagggaggcgttgagtccttgtgggagggacaagagtctcgcagcccacagctcaggccccaccatcctgggatgtgtgaactcagcaagtctctcagttgctctaagcctcggttttgcacaggtaatcaatcaacagaccctgaagcagggccggcaagagatgcgtcactgacaaaccgtgacttcccagggccaggccctccacacacagtcaagttggccctgtagggaaggcagtgtgaccgttctcactcacagatggggaggagcctgcagagacaggctgggcctggccttaagcccaggcagacccccagggctcttgctcctggatacagcctgtacctgacactccggagtccgaggagcctgtcttctcatctcagagcccctgtggtggccgtgtcctgtcacccagttgtggccagtgagacttaagtggaagcctgttgtggcctctgtgaaaacttccatttttctgctaaaaaagacagaggcagttcgtactggcccttattgtcctttctgccctgaacgtgggtgggatgtctggagccgtggcagtcatcttgtgaccatgaggcaaggtccaagagactcacagatactggtcctcatgccactaaatccaggggacatttggcaatgtctggagacatttttggtagtcatgacttgggcgaggcaatgctactggcttctaggggtggaggccagggatattccacccccttcaaacgttctataatgtacatatgaggcactctgtgaacgggagtcaaggccacagccaggcccccttaacaggcagggagacccgcacccagggaagcagctggcccttcaaaaataacccaaggagaggctctgggtgcagctagtcccaggacaaacctctgctcccggtgccctcagcccaagaatggacagacaccccttgactcagggcacccttccaggccagactaagctctgcctggacacagaccctctccagactgctgcacctcccctcccaccggcaggtgacagacacactcagctggcagacacccttggtgggccacggccaccggctcctgctgtgactaccacgtgcttgccactgccgaggaaggctcctccaaaccgcggacagtggccacatacagttaggtcagaaatgcacaggtgagttaggtctcacagagcttgttcaacttaaaaaaaggaaaagaggcaaggaaactccggcaaatagcataaagtgtaaagttctttggtaaatcattctaaactaacatttaagacccagccaggcgaagaagattccacagggtcttgcctaaaagcagagctgtgggatcttcagagttgtccagggcaaggtataaaaggtcggggtcagaaagtcgaggaagagttcagccaggcacggaaggggttaactggkggacaaccctcagctgcctgggctcctggctcccacctccctccatgccctcagccaacagcaagtcgctgccagcccaaggccgacaaaactggccgctgagtcaggcccggctgtgctcccggggcctgattgttcacaaagacaaaagggacgctgacggcccagctctccagctccggcccagctctccagctccgtcagcgggcgggggctgggggcagacagctgacccaggcagcctgccccgctgcctccctggagctgcacccgggagcctccccctacccacctcagtaaggcccaggcaggggcaggaggcrgcgcgattctcagaggcttgagttcagatctcccaggaagccaagagcggatggcccctctgacaccgtccctgtttgggtctccaccctttggcaaccaacaaatagagtctgcggcctcttcatcgtcacaagtattaaatggccagccagcagatttagttacaaaacaccgtcgcctgaagtcgggggcacacagtggcaaactctgtgaccgatcccaactgcttctggatgggtggtgttcacaggactccaggacagcaagggaaaggtcgggccagggcccttcccaccgtcccccaccaagaaagcatgcgttcaggcacccaccacctgtgttccaatctcctcctggacgtctattacctcacgcctccccaccctggccctgccacccgcccccaggcccagacaggtggttagcctttctctgcctcagtttccccatctataaagtaagaatggtttcagtcccatcctcagaggcctgctatgaggacaggagaggacttctgaggaggccagagcacccagcccacatgcctgcgcactgttttaagcagttaatgttcctgttttccggatgaggatgccactgccaagacagacccagctggtaaggggcaaagtcaggattcgaacccacctctgcaggccccagaggccaagcactgatgggtatggagtcccagaggtagctgtgtggatcagagcgagcccagacgcacgtgggaaggccttatcccactgtaagcagaaaagagctgcaggcactggaggcacacaccctcacctctgggcagctgctcccgcccagtccatgcccccaggcgcctgctgtgggcctggggaatggagccaaggttctggaaaacaaggaacaccctcttcatgtggcctgaaccccataggaagaatctcggtgaaggcatgaaggctacagtgtccccaaacaccctctaagacgactctagacatctacaaaacacattccaggacgagacggacagggccgcctgctcccaccaccctacacgctcccttcccaggaggacagaggcaccccggcaggaacctgagctgcccggccactcgcacaggctagaagggccccggccaccctccagcacccctcagccagcggctcctcccactgctacacttgcacacatccaccaatacacacggaagccagcagggagcccccgagtcaccccaagcgttcccaaaaagtgggcacagcaacttctgctggggcctctgacccattcacctgggagccaggctcagccgggttccacaggatccttgtccacactgccccagtcaggcaggttactcctcaagctgtgtctctctcaatggaatctacgtggtgtgcacacgcgtgagcacacacacgtgatcaactggcattagggatttggattcagaaagttcatgaagtgccaatgccctgaaaggggtggtggtctctgagctgccttcccctccaactccaaccccatcaatatgccacggcgctagggcagacagcttccatccatcatgggggtggggaggcaggccgcaaggcaggactctttgtatcccttaagtgtgtgtgtccctccccargcagctgccaggacttactagatgttttaaaaaagggcagggaggtgggaggcgttttaggatggagaagagtgggctgcgctgcttgtaaatgagtcagactagaagcccataggccaggccactcaggcaggtggcctccaccccaaacacatcgtatctacagcaacgttcacaaacatcagaccttggtagcaatgacctactgccaccacctgccccagcactagaacaggtgagaggagtgcctggggaagaactcagcctgccagtccctaagagtcatcagcaaacacttcaagagggcgttacctgcaccaggcccaccctaggccctccattcagagaactcagatgtgctgtgaccactcccattttacgggtgaggaaactgaggccacacacctagcgaagggagctggggtgtgtaccaaggcaggcaggctccaaggctcaccatcccctaggtggtatggcctctgccagggatggagaagtgcaatctgccttctcttcactcccttggcttaaacgcaatcaaatgtctgaaaactgtcatttccccagccttccagacccaggaagcccaaggccctctccacttcatctccacggactacccaccccaagccagccatgtccactcacccgtaagtccgctggatcaaggtggggtgcagctgctgcaccccaatggcaaagcctaaaacgagagaacaatcagggacttggccttgctgcacgagccacgtctcaagggctgcacacagggtggcagaatcccacaagccacacacctctagtcaaaagggatcatccgcttcctctcccctcccaggcctcccccttgtgaaccccaaggcacaccgctgaagtgtggcagtgagtgacgcaggtgtcagcagccactggtgtcggcactcctaacctccaggccccatggccacttcctccctcctgcgaggacagctggcaactggggtgcagtaccctccctgccccccgcccccttctttgggccacacgctgtgagaaggggtctagatcctcgagggggggatggctgccctgtgccggctctgcaggcacatgatagccgactgccactgctggggcgaggagggggggcctctttccacccgacagataccgacacccaatatagaaaccgagaagagccaggcaggaaaacacaagctctcacccgtctggaggctccgcggcttggcgcccagatatgccaggttcacgttggccttgcggccgtcgatgatggggttmgggtctttgcaagccctctcagctgccgcccggtcggscatggtcacctggtggagcagagacacatcaggggctgccgtggggggaaccaggggcgaaaggggcagacggctccgccctggcaccggatgctgccacccctctcttcccttcctctgagggtgcctgtgacccagggtccttgagccaaagctcctctgaaccctacctggggctctcccacaaagatgcctcctggattccagctcctcccgtcaaagttcaaggcctgggaaatgtggccttcaaggacaaaaataatcccctgcggggatagggcaaaaatgaaccccgaagggagcttggggggccgcctggacttgcccaccagtgagggccgagactttcctctgagaaggagtttgcgacgctatgcttggaaggtaagcaggaaagtgtcttcaagacgtttttacttaagctgatgtttatttggggcggctgagagggctgttaaaaatatgggggaggccgaagagctcctaacaccccggggtggagccattgctcctcaccccccgctgctccaggaaatcccgagtgccctctggctccaaaacctccccaccaacttaggagtcctaattgaacacagcggctcttccttttaaaccgggggtgggggtgggggtgggggtgggggtgggggccggggcctggggtggtgggggcgggaccggcaggagcgcgcccgggagaggcggcaggtgcgggcgccggctggaggcgcctggggcgggggcggcagcgggccgtctgggcgtgtgccccggagtggactcggcgcccgggccgcgataaggtgtgcggcggggtgcgggcccgggcgcgggggccacttacgaagccgtagccgcgggacttgcccgtctggcggtcggtgatgaccacggcctcctcgatgtcgccgaagccctcgaagtacttcctgagcgaggcgtcggtagtgtggtacggcaggccgcccacgaagatcttggtgaacgtggtgtccttctgcgagccgtgcatggcgccgggggcgccaggggccgcgggaagcccgcgctcggggcgcacggcgcgggctgcagcagcatggggggcgccccgccgcctacggacccgggccgcgcggggctgcgctcatggggggcggcggggagcgcgcggggcagcgaggggcgcccgtccagccgccaggcccgaccactccggcgcccgtcccgccgtgcgcgccgacgtgcgccgcgctgcgctcccgaccggcgctgcggggactctgcgccccggcaccgcccccgggctttgtagcctgccgcccccgccagctcagccccgcccccagccggccccgccccgccccgggcgcgcggggaccgccgggaagcgtagttctaaccccgcccagccgcacccgggcgcgcggcgattggggggaggggggaggggagcgcacgcgggctgagggcggatccgggcctgggggcgctgggcgcgcctttctctcctggctgcccccgcgggcccggccggttgcaggcactaagcacaaccctgaactagggaggccaggccccttccctcgtggagcgcaccgtctggtgaattaaacgtaaaaaacgtaaaaaaacgtaaacggtttttagcatcttgttaattgagtcggtatttaacccagggcgacttagggaagagccacgtgccatattaaaaaagggaaatgatttctgttttatatgtaagattagttcatccgaccgatatttactctgggcgcgaggctgcagcggagcacagatcatattccctggccccacggagcgtccaggactgagaattcggctagtaaacatacagcatacgaccccggagggagctacaccacggtgccgcgatagaagcgggtcccgggcggtctcagaggccccgcgggagatgaggtgggcagaggaagcaggtgtgggctctttccagctccaccccgttctgggctggtgtcagggacccttggggcgagtaagagcagacccgggtccctcatccggcccccagccatagaaaggcggcgcatagtggggctctgtgagcttcacaccaggcagggccagccacagaattttcggggcccagtgcaaaatgcaaacgcggggccccttattcaaaagctaggaatttcaagttggcagcggttgagcatgaaactcagccccgggctttcctgagcgaagggaagggccgtgtgactgcacagaccccgggatcccggacctgcgggtcacaccctccacctctgaagccgggactaggggcctcaagcccgcctcatctccagcccccgcggttgggacctatgcagctgggaaacagcagctctaattggggtcactcccggccccagccctgcggcctcctctcagcacagggcgacgcaggtggggtctgtggggactgggagtggcactccgtgggctgtgggggaccgcaaggccggcgaggagttcccctcgtttcctccagcaccgaggagttctccgcgtttcctccagccctctgccctggctgccggcggggaggagtctgcccgccccctcccccactccacggcccacgctccacgcggcagccttgacctctgacctctccctcccccagctcccgctctagccctctgcacagtggggatgggacccccgagtcttccggaagcctgggcgtcctttcctcccttcccccttcgttcctcgttcctggcgctcctgcccccgcttgcggcccccgttgcccttcatcccgcgtggtttcctctccttccttcgcggagtttcccacctccccggccctgtgtgttcgcctgcctggagcccctcccctgctatttgggcgctgcgagaacagggacctgggatgttttgcccaagctggagggcctggcaaggagagggctctgggatatgtttgttgagtgtatccacgatggaacaaggtggggtgggggaaagctctggcccagccggaggcccttcgaagcgactttgaaaactttcatttaagtgtgaccttcacttgccccctagaggccgggggaggcggccactgcgcggccgcgtgcttttgcgccagctggatcccttcaccaggcctcggtttccccttcagtttttccaaggctgtccccagccgtcgcgttgcctgggcaggctggagccgcgtcggtggcgtggccacgggcttcagcccggaggcgcccgggctcccggcctacaagtcccagcgccgcccgggcccgcctcgcccgcgcccctcccggcacgacagccccacaaaggggtgcggccgctcggctgctgccgcgggggccgggcccaggcggcagggcagccccggggcctctgcctgcccggaagggggcgggacagggccgtggaggctggagacgcggttgcccaggtgcgggtccagtcgcactccttcgccccccgcccccgggcccccttgggtatctggatcaccaatccctccccccctccggcggccccatgtctccacgggtcaccagcttctgcctgacaatcagtcattcacccaaacacacactttttttttttttttttttgagacaaggtctctccctgtcgctggagtgtagcgatcatagctcattgcagcctcgacctctcgggctccaagccatcctcctacctcagcctcccaagtaactgggattaccggtgcgtactacgatgccgggataattttatattttgtgtagaggctggtctcgaactcttgggattaggcaatcctcctgacttggcctcccaaattgctgggattacaggctgagccactgcacccagcctcaaacacacatttatgtgcaccactgcactccagcctgggcgacagagcaagactccgtctcaaaaaaaaaaaaaaactacagtctcatcagcgccactacttgaccttgttgttgaacgcattgatgaagaagacattgcttgtctacattgctacatcacrtatttgttttttaaatattttcatagccgtttttatttgttttaattagagatggggtctctctatgtcgcccaggctgatacagaactcctgggctcagttgatcctcttgcctcagcctcctgagtagctgggacttcaggtgcatgccaacacacccagcctatattttaatgtgattgttttcctttgctaatctaagcattttattttatttgttattattattttttataaagacagggtcttgctgtgttgtccgggctggagtgcagtggtgtgatcatagctccctgcagtctcagcctcccgagtagctggaaccacaggcatgcgcccagctgattttttaaatttttttttgtagagtcaaggtctccctttattgtctaggctggtctcaaactcctagcctcaagcaaccctcccacctccgcctcccaaagcaccgggattacaagtgtgagccaccgtgcctggctggtaagcattttaagtgtttaatactattaccttaggtatcagctgactgccaagggttccatggcccacaaagggcccctggaaagggaacacagttttgtgagactaggctgggagccaggctgggcagaggtgacttgggtccctcaggcctcactggggagcgggagggaggactggcaactgtgtgtgctgrgtgagaaaatggaaattgcaggagcttggaacgcagaattcctgctcagtgtgaggatgagcccagcactttctgtgtgttatcttagttcatctcacaaaagccctaggaagagatgactacgatgatgcccattatatagctgaggaaactgatgctcagagaggtcctctcctgcctccctcgcaaatgtgtgatgtgtgcagggcacaaatgcagaactgcctggcctaggcctgctctctgctcccagctgtggctccagctgccctgcagaggagggagagtgagtttaccctgatgaggatgtgcagagaggagcaggtgaggccggccactgcgatctgaaacagcacagccccatccaggcagggctctggtttgagtcttcaggccccgcgctcttgggcctcctctttttgtttgtcgtgttggtgtttatatcaaggctcttcggggactcagctttgggctgagcttggtgcaggtggcctgtacacccccagcctgcagcccagctcctttgaatccatgggagccccaggttgccattttcatctgccaggtgcagagcagtgagcctgggaatcccagcactttgggaggccgaagcaggtggatcacctaaggtcaggagttcgagaccagcctggccgacatggtgaaaccccgtctccactaaaaatacaaaattagctgggtgtggtggtgcgtgcctgtaatcccagttactygggaggctgaggcaggagaatcacttgaacctgggaggcagaggttgttgcagtgagccgagattgcaccactgcactccagcctgggtgacagagtgagactccatctcaaaaaaaaaaaaagtttccccatactactgggcacagaggccaaaatgcaccagcaggcactggtactggggagaggaaaggttcagcccctctccaggtggcaatgacaggctcagtcgatgctgtcacaggccgccccagcagcattggtggacagctcctggagcagcagagtgcacatgcctcagtttcagctgcaaagacagaaagacactggcctgtgtgcatggccgaatcctggcctctgcatcctaatccctggaacctgtaacatggcaccctacttggtgacagggactctgcagatgtgactaaggatctggaggtgaggagagtatcgagggtcatccagagggacccattgaaatcacaagagtctccatctgaggacggctccagatttgactaaggaacgggaatagatgtgagcccagaacaggaggctggagtgatgcggtcacaagccaagggttgctggcagccaccagaggccaggagaagcaagaaatggatcctcccttcaggcctccagaaggaaccagccttgctgccaccttgattttagtcccctaatagtcattttggatgtcaggcttccagaactataagaggattcacttttgtggttctgagccactaagcrtgtggccatttgttactgcaacctcgggaaacaacacagctcacattgaaagctgagccctcatcccctagggaaaggagtgtagtccaagtggcaaactgggggtgcagaagaatgagaaagtggggaagagcctgctactccctgtcaataaccaaatgacctgattggtctcctgtgccaaaagttgttcgttgccccaggatctttctcatgaagagggaggtggccttgctatacagtgtggacaggtgtgtctgcgagggcaggggctgcatagggggcctaggcaggtgctggcgccagcctgcatgatggcacttgcccctgggctcggtgtcccctcatcctttggcttcaagatggtgatgagaggctgggtgctggtgggtaatcccaacactttgggaagccaaggcgggtggatcccttgaggtcaggagttcaagaccagcctggcctccatctctacaaaaattgttgggcgtggtgcctgtaatcccagctactcaggaggctgaggcagaagcatcacttgaacccaagaggtggaggttgcagtgagctgagatcacgccactgagatcacgagatcacaccaccgcactccagcctgggtgacagagggagactccatctcaaaaacaaacaaacaaacaaaatggtggtgatgaaagctctaggaaaaggaagtgccacgaagaacaagaattcttgcgagctgagctgggcggccgagacgtcaggtaagaagctggacagctgcaggcagcgccttgatcaagccaaggaaagcagccactgctggcaggaaacgtggggcacaaacgccccaactctctcagggacgctactgcttctggttttctggcaccttgcaggttagcaggtgaagggaagcctgcagcgaatccccgagctgtgagctgcacgtggcgctggggcagcgaatccccgagctgtgagctgcacgtggcgctggggaaggctgagtttgtttctgcagtggctgtgagggtggcacaggccggagatcctgcccccaccagcgccgctacaagacgctcaacactgcctgccctgggagcccggtgcgcggtggctggtgctgtggatcctgcagacaccaggtcatgcagcccaaatgcaagtggccactgcggaagactgtagtggtcaccttgagctgctgtcacaaactaccacaggccgggagaccgagcgacagaagtttattctcttagagttctgagggcacaagtctgagatctggatgtctgcagggctggctccttgcaaggccttctctgtggtgtgcggacctcgccctcttcctgtgtcttcatgcggcccttcctctgtccttgtctgtgtccagatttcctggtctaggataccagacctattggaccagggcccagcctagtgacctcattttatctgaattgactgtttaaagaccatgtctccaaaatacagtcctaatctgaggtactaggagtgaggacttcaacatatgaatctggaggacgacagctcagcccataacaaatattaatactgattttccttttgtaggcaaccgtcaggtgctaagcagaaccatgcttgggccttccacaccagtcaaggtactctcacagcaaagccccaccgaaggggcccacaggttggattcgaggtacgtgaagtcccaagagatgacatgaagccccaaatggatgccctggctccccagcaccagagggaaacgccccctcaccgaagacagtggcaagtgccatgcttcaagtaacacagggagcggcctccagtgcacctgttttagcagccagtcctggaggcagaaagatttacaagggagtggaaaggctggcaaacacaggacacatggagatgcccaaagtcagtgggggtcagggttcaacctggaaatgcagtcttctcagctgaggaaggcagtgagtcctggccaggaagccggtccaagcccctgcctcgtccccagttcacctcgtgaaagctgatgaatgaccaatgcttgcagaggggtctggagtaatggcggcaccgtattaaggggcgatcaggctgtatcttgacactgggattcataagagraggaagaaacctatcatgctgacgggtagtgaagaagagaaatgaaagacaaaagacacaagagaaggccaggtgcagtggytcactcctgtaatcccagctacctgggaggctgagacaggagaatcgcctgaacccgggaggcagagggcgcactgagctgagatcacgccactgcagtgcagcctggacgacagggcgagactcagtctcaaaaaaaaaaaaaaaaaaaaagacaccagagagtgctgccgccagtgagctgacggaatccgcagtgtggattcgggcccgtaggatgctggggattgtcagtgccttctttgagctttgtctcctcccatactgcctcctctgcaccacagtcaggagggaaaaagaataaaagattaagaatgcaggtcagttctttttcgggagccgatttacattttaagcaagtatgcaacaggtgtttctcattggctttcgaaacagccctcacctgaaaaaatatttttcaatagattgatgcaaaattcacaataggctcttagactgtggtgatggtttcatgggtgtatgtttatctccaaactcatcaagttgtataagttaaatatgtacagccttttatatgtcacacttcaataaagtgtaaaaactcacacagtcggctacgaaactgtttacactgcccatatttgccttacagtgacctaacacctgtcataataaaaccctcaaaggtgcagccacaacctctcctggcttctcccatctccgtgggataaatgtaggccgtgagataggggaaccgcagtgagcaggaagacctcgcagagctgtgaaacattgccaggctctgattaacaagccagtaccttgcaaggaaatacaatgcttgtgttgagactgcctttcctaaacactatagccaggccctggggtctggggcttatacagctttttaagagcctacaaaaatgttgaagggcagagaggtagaaagaaagaaaaagagaactggcttgaagatatttaaaaacaacaaccccagcctgggtgtggtggcttacacctgtaataccagcactttgggaggccaaggcgggaggactgcttgagcgcaggagtttgagatcagcctgggcacacayggtaaaaccctgtatccaccaaaaatacaaaaaaataaaaaataaataaaaaacagagcctggtgtggtggtgcacacttgtagtctcagctactcaggaggctgaggtgggaggatacttgagcccgaaaggcagaggctgcagtgagccgagattgcaccactgcactccaacctgggagatacagcaagatgctatcctccccccaaaaaaaccaaaaacaaacaagaaaaatccccaaattaatccgtttaagtaaaggcctacaaatgtaatactggagacctcacaaactatttagtgttctaatatccaatcaatttgaaaacaatttgtagctttgtaggaaacgctgcactttgtgagaaattccctattattcgaggtcatgattaagaaatcaacatggagtgtacgcttacggccaaatcatttcagaagtaaaataggaaagtttttcaaagaatttgccttcaaaacaatgtgtatttaaagcaggatgtgggtgcattttaatatttggtgtggagtggtgggtgacacctccaaaagtcagatgacctagtgcagtgatgtcccagagaaagatgaatacaacatgagccacgaatggaatctacaatttccagtagccacattttaacaaatataagcaggggaaagttaaattatccaaaatagtatcatttgaatgtgtaattggtatgaaaattaatggcatttacattaatttcaagagcatgtgtttagttcattttttttggcgctaagcctttgaaatctgctgttttaggtttacatctcaattccaacgggccacagagcctcaaagttactaacacgagtcttaaagtgacctgtttgccaccaccagggatttgtgtttcccatatcacggcagggatgatgctatggggcacgggagtgctcagaggcccccacaccgcgggcgccaaggcttcagtgttccacgaggaaaccatcgcggacattaagtttgaaacagaaaaatcagggtcccacctctgacaaattatctcctttagcattttccaaggaggccttcaatctaagtgtgttatttttaagacgattcttctgacagcataagcaatgttttgattctacttcccaaatatcctaaaagcttagcaacacaacaaaaaatggaagggggtggccaacacttcatttcttttaatgaactcaagtctgtgaaactgaacacagaaacacatgctccaatgttggcattggggccattcgcgccatctgctggccagacctaagcacaacacccggctcctggggaaagaatcttagagacaagcaagatctccagtcacttggtctctggacctttttgtcccgcctgtataccgacagcacagccccattgagcaggagacttctcatggatgtcatcctcactggcactcgtagtagcagctacattcaaactccacatcacgggccagccacaggggcacttttacgctttaactctttgactactcacacaaccattatgatagctacttttaatgtctcccattttacagatgaggtcactgaggctcagagggttaaatcacaggcttaaacaaagggtaaatcacatgttagcaaagttggtgacagagttggaattgaaggtgggcagtccaatttcaagtacatgtttttttgttttttgagacggggtctcactctgtcgtgatctaggctcactgcaatctccacctcctgggctcaagcacttgagcaattctcacgcctcagcctccccagtagccgggattacaggcaggtgccaccgtgcccagcaaatttttgtatttttagtagagacgggttttgccttgttggccaggctggtgtggaactctcggcctcaagtggcccgcctgcctcggcctcccaaagtgctgggattacaggcatgagccaccgcacccagccccctgttcttaattgcaatgttataaggttatttcaaatataatwaatataatcatccctcccattttggggagacctcaagtgcagttatggcttagtacttgaggtcaccgaagctaagaactcatcctaaaccatacaaaaagtgacaggcacagagaagaatcccaccccaggatatgaaaatatctcatacatacatagattctgtgattttgtgtggctccactaaaagaaacgctcactgcaacaactacgttcatttcacaacctacgaatgggtcatgagtgaattcggaaaaggctggcttaggcactcccgagtgttcaagaacatgtgtttagttcatgttttagagtctctcctccaaaagagacgaaaattttggttgaatgagaaaaacaaacatttcctacatgactcaataaaatttctttgagacagggtcttgctttgttgcccaggctggtctggaactcctggcctcaagtgatcctcccgccttggcctcccaaagtgctgagactccaggcgtgagccaccacgcctggcccttgctgtttaccttctcttggtggtgattttctggtgaaagtcagcaagctcactgccagcaggccaggcacttgccgcatcctttgttcttcctctgccagaggatctctggtgtgaagctaacccgaaaacggggtgaggcaggcgggttcagctggcccctttgactgagagggttttcacaggcaggctcacatgcacacrtgcacacacgtgagcacaggctcacagacaggtgtctcacacaaacccaccacagctccatcctgcttccaaccaaacatgacaggaaccgagtgcaccttcctgtgcccaccctaaatccctgccaccttgttgcagcagcatctttacacaaagttcttcccatgaggccctgttcccacagtgaggaaccaaggaagcgatgttacaacaaagactgggaggaaagccaggcaaaaccaagcagaaaatcaagggaaaggtgagtgttcatggtggcatcctggtggcaggcagatggcaggtgtatgttcactgccaaaaccctttccacttttgtggatgttttaaaattttcatatgttggaaaaaattaagtgaaagaacacaatttgtcttctccatgaggtttatatactttactttcaacgaaagcagctcttaacagggtgtgcagtcaatatttaatggcaggacrgcttgacatttagtgaaacaaagagccaagattacactagtatctctttgaagtagaagatgccatcaaacttatgaatacttaatgagcacctactgcatgcaacttacaggtgcctgcaaagatgctgaagtttaagatgaagagttcctctaagacttcatatgcattttaggaaacatgaacataaatatttgaagaagcttaacgatctcagtgaatacttcctagatcctcattagcaaacatgtagtgtgcttttatgctttaggtcctgggcagcagagaaatgagcctgggcctcatctagggttcacatcctggtggcagcagagctccctcccaggttctgacagcccagtccaatcttggatttatgcaaatgttttaaatttgccaattacaaaaactatccccttggggaggtggcaaggtcccatcctgggaaagcgcactctaaaaggcctgcaatttagactcattttccaccctagcccgtcactargggtggtaaaaacaatgaaactctggctaagctaaagctgaatatgaaagttggctgctgagataatcaagcttcaatctcccctcacagcagtcttatgctagctagatcttccccacgttgataagaccacaggcttgattcataaagtgaagaggaaaatgagctggaaaccgttaacctgaaaattcagatatttttctagtgcacctgcttttttatctctaaaaaataagttttcgggctaaaaaaacagggctggagagtgggtgggtctgaattcattgtgacctaccaaagaatttaaaccactgagtgcaggtggtctcttccagtagaaaattttattttcattgttttttatgagtaggcaaacacatcttacaacactatcgatactagaattttacactcagcaagtcagacttcacacattagtccaaacagaaaggcctaagaagcatttgagatcacaggtgagaaatacagtgacagacccaaaagtcacactttttctcagcccagctgaatttcattttgaatacttaccaaccaggaattttaaattacacaaaatacaaaagaacagccaaacaaccactactgagggttcagggcaattcccatgcaggggaccggggtgggtaagagttcagggcaattcccatgcagggggcttgggttctaacttgaaagtcacgcaagtgtcacccacttgggccttaggaggttacccacaaatggcctgtcacccagcacaagtaacagtccccatttgagtcactcggaaatctgagcagcaaggccagaaagcactggggattttgaagatgggaatgagggaagcaaggaaaaacacattcaaactctgcccaccagggctcacagaggctgccgttccrcgcagcagaagtgagcgcagctggggactccctttcccctaaggttgccgcatttcccagagggtgtctgaaatctcaactcaaaaccccacgctgatgctgggcaggacgcatgttcctgaggttacggggtgggcaaggggagaaaaggacaaaggaagctcgggaagcaatctgcaaaagactttattacaaaatacagcacggggctcacagacgcttttccaatattctctaacacgtacactgaagcgctgcaaaatccctggcggtgcccgcaatctaacgtctacaataacctcaacccccttagttacagaaaaactctgcaacaggcagtggaatggagagacggcaagtcgccgcggacgcctgggctctcagctgctgaacaatgacatcgttttctccaggggttgaaatccatgtccatggctgacaacccaacaaggctgggacycaaattcgtacagagatgaggcagagtggagagaaacaactctggctgagccagagtctccagccactacttcttattcctgggctttagctcttcggctgcattacgcaggaaaatgtaattttttttctggggattataaaattcatgtccctaaagagagcaaaaaacaccaatgatcttattattcaaaagaaagttagcatttgtaggtgctttttctaggtgaagtcctgtgctacaatactggaaacatataatctctcagagaaataaaacaacaaagataaagtcaaatgcgaagcagaacttcagtcctcagagaaaggcctaaggatgtggttggtaccagtgtgtcatcaatgtcctactgagagagtctgtgagtaggaacctgtgagttccttttcaacactgagcccccttttaacaccccaggactttaacgccaggataactgccttgggtcccttggtcagaattagttctgacctgagaatgcttcacagaaaggaggacwtctgacctgcggggtatcatggggatgaaggaggacaccccgccccacatggaaggagcaacagacacggagcacagcagaggcatgaacggtggtgagtgagccagaggygtgtgcggaggtgtgcacgtctgcccgggcccacaccggaggggatgcagggctatacagcatcgaaagacccccgaaatcaggatgaggccagactacagggctgtgaatggcagagggaggcctttgaacgttattccccagggaaaaggaggctgtaggcaggtcagtgatgtgatcacatttaagttttaagaagagaggtgagtggggtgggccaggcagatgatccggaagaaagacagcaggcaggagccgcaggtgggccaaaggactggaagagggaggtggggcatggcgctgggtgcactctgtcacctgtactctgatgacacatttttattctcttcccaacaggcatgccaagaaagctctagaagttttgctcaacagtgaccactaaytctcataatatacaaagtgtagtttttctgaacagtaactcaagcagcaagctaataacatcaatcatatgtgatcatgactttgcactggagataactgtccttgaactaagaacaatgaaaaacccctgaagcaaatttctcttttaaactaaaaagatgctaatttatgtaacccccacaataagctgacattaactgcttaaatgaatgagattttacttcaatttttaaacagcactcaaagcaattacctttctcactgctttcaatttactacattttttaacgcgtataacgtatagagtcccgcgtcatttaagttaaaatgcagaattttgatgcagctgctgggatgagtatgcaaagaggagattcaatgaagagcccgatgtgggagctgaggcctcgggctccacgcacgccacagcctgtccacccccagccaggcagaaccaaaaaagtacactcttgtcacaaaactgagtgcatggcttacacaggtgaatggataaacaaatggcacaccccacccgggaatactacccagcactgaaaagtaacggacaagtgattcactcaacagcatgggtgaatttcaaaatccttatgctgagggaaagaagctggggcgaggggaaaatgtagcgtagggctccacttatataaaattctagaaaattcagactagtccataatgccagaaaacagayccatggttttgtgtgtgcgtaagggaagattacagtaatatacacaaaaacctttcggggagatgactatggtgatagtttcatgggtatttacagatgttgaaactgatcaaattgtacactttaaacaatgactgtatttcaattgtacctcaataaagttgctttaaaaaaagaacacagcttcatggctcacacagcaaaccctcaaacagggaaacacagaagcagcagcaggcctggaggggtcagagggatggaaggcaatcagctggacttctgtgtctaagttcggggcctcagggagactcaggtgcagccacgctcctgagactgggaaatactaaaggtggagcgggcagggcccgaaccaagggacgtctccagtcactggcttgtgtggcagcaggtgtcttgggaatgcaaagcgctgtttagagccctgtggtggccccccaggctgagatagcggggggccagcaaggcaagaggggcaggagacaggagctggcaggaggacaggaaccacagcccaaagcagaataaaccaggacatggccaagaagcagggaggagagctgtatggaacaggaagggacgggtgagtgaccggcacagacagaaaggaagcttctggactggatgaggaggacgtggccacagggactctgagtacagctgcaagaggccagaaagtacctggcagtggactgaggaggggccagagcacagggaaccaagagggtaggtgctgacaccactctctcgatagccttaatatacatggaaatggttcctcgagccttccatgcttagacagaggggaggagctggtggacggggacagaagacagtgggagaaggcccagaaaagagccatgagggtggaaggagacggggtcagcgcaggcagacatgaggtgagcgggaaagacactgcaggccactggaagcccctcctatgtgaagcaggtgacctccccatcggaagccagggcagggtagggaaaagtctagaaggctgttgtgggcaaagggcagagtggggtgggaggagaatgatgaaaaccacaaatacaatgatgacaacctctccagaagagctgagcagtggagaaacacgcaggctggttgaaagccaacacacttcccatggggttgggcagagtacccgagtctacacatttcaccatcatgcccaaaggcctcaaaaatgcagccccactcctgccagctcctaactccccctgcccaaaccaccagccaaccaagcaaccaacagcacccaggcgaaagctccatgacccgccctgccacccccttcataaagtgcagcccccggcttgcctgtgcttctgtgcccaggaacagagcagcccgtaatggctcacactggccgagcacttcctgtgtgctgggttctggccaaaggctgtactgaatccccacaaccatttgaggaagtcctgcaatttccccttacagggaggggacggtgacctgcccaaggacacacgtgagtcctgagaagagtcacaactcaggcctaggccttctgaacccagagcctggctctgctgccttggsgcacccagagcaggcccgggagttctcacctttgaccagtcgtagctggaagcgtatgcaaatatgtttccattgtgattgaaacagcaagctgagatgggctgatctaactgttccgaagtttttagttttgttctggcatctttgtcccagaagctgaatctaccatcagatcccacagttgcaagggtgccatgaacaggatggaacgcgattccatttacctgcaaggattgacatgcacaatgagaagccaggcagaggggcgcagagaaggttccacccacgcacacttcctgcttgagttaggyaacaaagcgcacaggtacatttccttccagctgctgcccgctgatagcaagagaaactatccaggcttcctccatcaaatgccagcccagaacccaatcttgcctcctgtgagggctgcacaccagagaaagtgagcatgtggacagcaagaaacaaggagcagacctcaggaaaatgtttcttttgagcaaacagatttctcagtctgagctgtgggtgtgaactgtctaccagcgctcctgagggagggagaagactctcggcaaaacatcctaagcttatgttcagaaacaaatacacaacactgctagttaggcggcacgttaacacagaaaacaaggccaagtgcggtggctcacgcctgtaatcccagcactttgggaggccgaggcgggcaaatcacaaggtcaggagttcgagaccagcctggccaatatggtgaaacgccgtctctactaaaaatacaaaaattagctgggcgcctgtagtcccarctacttgggaggctgaggcaggagaatcgcttgaacccaggaggcggaggttgcagtgaggtgatatcacgccactgcactccagcctgggcgacagagcgactccgtctcaaaaacaacaacaaaaatccacagaaacctgaagcctacagcataagccacttatctccggacatgaacacacaagctcttcagtgatgagtcttttctgatcccacaattcctcagccacctccaagtctggtttccagatgtattaccacggttaaagtgtctaaaaacgtaccgcataaatgtcctgaggagctgaagtgttggttccattagatcgatgacatttaaaggtgaagttatctttggcgctgaaagacaaaggttcatgtaagtcttcctttgttaaaaaaagtccagtgaaatctgcaagctgacagagtcacacttacgggttcggggggttgatatagtgaatagcaactctcccctcgatacttcccagggcaaaaccagtaggrttgttctgtttgtctttaaaaatagccacacaccgatgctacagttaaaataaaaaagagacataatcacagcataatataagatttcatgactaacgtgaaggtaagtcatttttaccccatgtttaggttttagaagaaccagaaaaaatcactcaaatatgatacagcagtaagcattgctttctaactccttagtaactccatctaagcagtgagtttatgacccaactgcacaccctgtgctcctcccccgcccccgctgctcgctctccctctgccaccctgcaaggccgcgttcacgccagcagagccccatgggctgcgaggcagacagcggccctgcctgtggggaatggagacgtccctggctaggcagacacccctcaggaggtcacccgaagcttctgcgcttctgcctccccagctggaggagggatgcaggctctgccgcacccgtctcacagggtaacagggtgaaggggacggtgggtgcagtggccatgctacagacaagcaacacgctgcacttcgcccagtgttgagtgtgagggcccaagggcaggtctctattctacagaagaacccagaaattccactacccagcctcctgggcagaaaagccgaccaccccgaggagaagccaactttggagttaccacttcctccttccagtcgtggcaacctggccaaagcttggagggccatccaccctgcytaagctggtcatctgagcttccgtgtgagttcaggggaagcctggcaggacccaggcaggggccaggcaagacgaagggagaagcagcctctggcatcgtgacagctgctggtgatgcacgtttcctaagtacgaaggaaaacggcctcctctttcattcctgtactgtttgctcccctgcctttttaaaaactgccagaccattacttttgtgagtacgaagaaaaaaagtaaagcaaactgacaaacatctgtaagttcttagatgacagaaaaggccatggctggtcatcagcacagggtctactgtgcggcacaccaggaactgcacaatgccaggggtgtcacttgcaccaagagccacatgcactggccctgtgcaaaggccgatggcaatcagttctcaacaacggagaggccagggcgctagcaccgggtggcaggaagtgaagccagatrggaccaggttttttttggattcaaccaaaaggaaatggggaggcagggaagggcttaggctggggtccggcaaggccagtggtgccgcttacaagagcccctgcctcagctccggaggacgccttgaaccagggccaaggtctaagtgctgattttactgtggtaagaagagtgaacatgagagccaccgcttaacacatttctaagtctacattattgttgactacaggtaccatgtagtacggcatatctctagaacattctcatcttgtttaatgaaatttcatcccattgattaagtagctccccatttccctctcccccaatcccctgatgaccgccattccaccctttacttctgtgagtctatgctggatatcacatttaagtggaaccatgcagtttctttctgtgtctggcttatttcattttgcataatctccttcatggtcacccacgttgtcacgaatggcaggatttccttctttcaggctgcacgcacagcatcctactgcaggtatacacttcattttctttatctgttcacttggctattgtgaacagtgctgcaaggaacactagcagtacaggtctctcttcaaaatacccattttgattcttttgaatcaagacctgtaagtggaactgctagatcgtatggtgattctgtttttcatgttttgaggcctccagttttctgtaacggttgtggcattttgcatccccccaacagtgcacaagggttccatgttccccacaccctccccagcgcttgttatctttgggctttctggtaacagtggtcccatcagctaggagatggtatctcactgtggtttttgtttgcctttccttgatagttaggatgttaagcacatttccatacacctgctgggtatttgtatgtcttctttggagacatgtctattcaagtctttggtccatttttcacgtcaccagttttctcactattgagttgcaggggttccttacgtattttggaaatcaatcccttgtcagaaatagcctccagatgttttctcccattccacaggctgccttttcactcttttccatggttccctctgctgtgcaagagctgttagtttaacacagttccacttggccatttttgcttttgttgcctgtgctttttggtgtcatatccaagaaattactgccaagaccaatgtcatagagttctgatctaagtgctttccaagatttgaattagatgtggtggcaggagggagggagaaaaatgaacagattcccaaataatttcagggtagaggggaggagactgaggattagtgagacaggagagggaaagttccaatcaggggtgacctcaagatttctggctataacaaaggagatggaggtcccattgaatgggctgtgaagcacatcaggagcaacaggctggtggtggccgagaggggcaggttcagatcaaatgttcactctgcaaatattcacagagcaccttttacacttaaggccctcctccaagtgctgggaggcagcaacaaatacaaacaaaaatctctgctctcatggagtttacattctagtaggcaaaagaagggaaatatttagtatgtatatgacatccatacatacgtataaagtagatggtactggtggcagtagcaagggagaatcctgaggcaagggtaacatgtgaataaagagctacagaatgtagtcttgggtttggtgtgggataccgtagcttcagacgcctgggagacacaccaaggagctgtccgactgggtgtccatgtcaggagcacaggaatgaggtacgagtctccagtccacagggcgtggctgagcgacagtggatgggagatcagttgtgcttgggtggaggaggcagcggcttakggagatgtctgtggaacctccacattcagccaagagccagcaaggatagaagagccacagaggtagcgggtaagaggctggcaagacagcagccaggggaaatgtttcttgtaagaacagtgaatgaagctctgttccagtaagaggatgggtgtccagggtcccctggaattaccaatgaggatgccactggtagtcacgccaaaaacagttctggtggaacaatggggggcaaaggtctcactgagttagaaatgagtgggaggtgagggaataaaggacatttcatccaagatgccccactgcggaaggaatagggacgcgggcagtactggaggaggatgtggggatcaagggaggtgtgttttctaggatcaactagacttgagctagtgtcagtgctaagggagaagtactacgcggcaggagagacgggtgtatgggaaagaggtgatactctgcatacggttcctgagaaggctggagggcatgggtcccaccacaaaactggccttagcaggacggcttccacctcatgggggaaaaggcaggggaggaggcaagcacgggcagatttctagatctggcaggagaaagaggaggaagttcccattagcttcttttttctctgagcaagagctgatctgattggctgagacaaagactaaaggaaggagaagctgacaagagtgcaggcccagcagccctgtggcaagtggaggattgagctaaggtgaaaaagctagcaagcatctaggcatgatgcagacagagttgaagttggaagctaggaatttacaatggaaccaacccatccagatgtgtaattttattctcaaggaaaccaaaatattttgccccaaaatagacttctctgacatatttcaagatggctatacagaagggctggaaataatagctgaaaagctatctttggtggggagatctgcatctgcagagaaaatcggcattgatgcagccaggctttctccaaggcccttcccttgtcctgattagggaagattaactgcagtctgatgccgttaaaggtctcagttctctccgagggtgctacctgtggggtttcctccacattaacaagaccacctttgctacacagacctcttcttctcttcttcccataacctgtcttgccacgagaacccaatttaccatgaaagcctgttttgggccatgccctgagcccccttctttctgtgacctcaagatggtatgaaagcatcaaccatattgcctttaagatcgttgtaagacgctgtgcacatcaatacatttgtatgccatttctcctattaatctgtcttttaccagctacttttcagtgaaccccttcagagggcaaaggagaagttttcccttggcccctacaattcagtagcactcagccatccaggggcatgtttggagaagacataaattcagttcatccagggataccttagtattacttaatattcactcactaagtatttgtgtttatatccttcaattcacccctctttgaacatacttacaggttttacaaagtacaactgtattccagatgtgagcacaatcttgcatacaacaggtgctaaatacatacttcttgatttgactaatgacgcacctgatgtttcagtggagattctatcctcctgaattcagaaggttgattctctagctgatagacaatcaggcccctctctgcagttgccaccacagccatggggtatatctagggaatggaagaaaacagagatgcgcttcaggtgaaggagtgtgctgtttttatactaatgtatttgatcaatttttggttacaacattaagtctggattttaataatcctgggattatatttcactaaaacctagagaaatagtatttgaaagtagaacattcatatattttaaaaagtctcgtgttttaaaactaactataaaatatgtggatatttagaaaatatactcaggaactaagaataaataaaaatcccctacaccactccttcagttgctgtcactattccagcctttgttctcagcgttatacttggtatgtagcatatttctgtacagttcatatcctttactcaaaacatgtttcataaggtccacgtcacacactttttcaagtactagcagtggcttctaacgtcccctcaaatgaacctaccacagggtttatttatctgtgtcttggtggccccttaggccacttccaatgtttcactatattacataaaacaaagaccagccgggcatggtggctcacgcctgtaatcccagcactttgggaggccgaggcaggtggatcatgaggtcaaaagatcgagaccatcctggcctacatgtgaaaccccgtctctactaaaagtataaaaattagctgggcctggtggcacacacctgtagtcccagttaacgggaggctgaagcaggagaatcgcttgaacccggaaggcagaggttgcagtgagctgagatcatgccactgcactccagcctggcgacagagcaagactccatctcaaaaaccaaacaaacaaaaaaaacaaagaccatctgtatctatgattattttcttgtgataaattcctaaaagtggaattacgggattgttggtacaaaactttaagatgtgactaaacaaatggagaaagttccatttctttttctttccttttttttttttttttttgagatagtatctcactctatcaccaaggctgaagtgcaacagcgtgatctcagctcacttcaacctctacttgctgggttcaagcaattctcatgcgtcagcctcccgaatagctaggattacagacgtgcgccaccatgcccagctaatttttgtatttttagagatggggtttcaccatgttggccagggtggtctcgaactcctgacctcaagcaatccacccacctttgcctcccaaagtgctaggattataggcgtgagctaccatgcctggccgagaaagttcaatttctatcccactcagaaacagtccccaaagacctggtaccacctcacaaacttactgcaagttttcctactgccatggaaaggacatgatagatgtcacactagagatggcatgtagctagctgcatatgttcaaacgagtggcaggaaaacttgacatccagcatttagtacttctaaaagaaacgcagcacaaaaatctcccaattggagacgactgaggcaatctcaactcgatcctttatatctattactaaagctagcaggatttttatattatccactcactaactgcaggacgccacaaggtgagaatacttattttgttttttttttaaagtaaatacatattaagttgaaatcccttaccacgtcagcacagtaacacctttcagggagttgcaaaaccatcataggatttgacgatcgagtatcccaaaactaaaagcaaaaaagagaagccagtatgtgaccattcagagcagaagtcgaaatggtgcaaaaataaatgacaatcctgatggggccaaacaatgcctcaactgcacattatacctttaaagtcttatcccagctcccagtcatcacacagctgtagtttggagctttgatccaatggatggttttaacaggagcatcatgctttcaacaagacaaaaacaaaacagatcaaggtaaatgtaagaatgtgctgaacagctttagttgtggcaattcaaagggaagaaactaatttaaatactggggccataccaaacaaaaaccaaaacatacttagcattttaccaatccttcctcactgacagagtttgcatgtccccaccaaatcccatgttgagatgtaatccccagtgttgaaggtggggcctggtgggagatgtctgggtcatgggggcggatccctcctgtgttagcacagtcctcacaatagtgagttctctgagatctggctgttg

SEQ ID NO: 18014 - DNA, 40000 bp, Homo sapiens
ctcccctgccagctctctctctgcctctcttgggcctcagtgcccaaggcttcctgctttctgttctagggccacaacttatgctcctcctctggggtcctgccctgaaggcaaagctgtgggcagcagggctgtggacaatcaggtgtggcagcaaggcacaaaccagaatggtgaagctagctggctctcctccaaagaatgaggggtttggccctcagatgacaccaagagacagtcagaggaagctctgagagtggcccggcattcccagtgctggctgggtggctgcctctgccactcaggccggagctaagctcctgtgttggcgggaattccaaagctccccacacatgagctcatggatggccaggtgcccagccttgcagttcatggctttggaatgcgttctctgagctggcctgcttcagtacccccatctcaccacagcaagtactgctgcctgctcttggccctccaaagacaggcaaatcccataaagggcttttttctaaaactgctaaattgtgcaagcacatacatgcgtgtgtgtatgcaagcagcatgtggacaaagcatcctgtgtgcatgggtgagttcgtgtgcacctgtctctagcatgactgggcatacatgtgcataggtatatgtcgtgtgtgtgtattctgtgcatgagtagttttaaaagaacacagtgggatctgcttggggccttgtgtagctgaaccttatttatagctctcctctgtctggttcgtttcctctaacttccctgcagaatgatatgaatgaaaatgacactattgactatcttggtaaccataaaagaccttatagaaataagatttttatagtgtgtggactgggagaatcaaaagactaagagttatggactcagaggataggagagaaccaagctgagccagtcggagatgtccccgtggtggatcgtctgtgggttttttaaacaaagtcatataaataaagtgattgtcttgaaagagttatgagagccctgaatctggtgggcaatrtctctgtggcctctgcataggcgggagggcaggcgtgctgtccacctgagaggaaacccacactttgtctgagtcctggctcccggcctcccaagggaggctatggaggcagcagcagaaacaacgctgccctttgttctggagagccatcgtatttggcagccccgggagaagagccccagggctagccccacaactggctaatgggaatgtgaagacccaacgtggacagccagcccctgaggctgagcctgcagattctggggctgcagcttctccatgcttgaatggaaaggaccctcccaccccatgaagagtgagcatttggaccctgcacagggacttgctcaggcccttcatgggaagccacaacagcaaccctgcctagagggctcccgcctgaacaggtcccttttagcaaaatccagacccagttccacacatctttaccagctcccactttgcatttgtgcttttagagatgaagcagagctcgccctgccctcaaggagcatcctatctggtttggagggtggagaagggaagagtgggcagaaagacattcctgcaaagactgatgcatggaaaccagggcacactctcccactcaggtacacaggttcacaggtagacaggtacacaggtaggcaggtacagacagagagcagtgttgaaacttggtgataaaacttctatcctgttcatcccaacagactcagtgctgggccctgggcacgtaaagctgagtcagactcagtcccaaccctagaggggaagctctcacccaaagggcagatggacagatccccacaacatagtatgttaagggctgaattgcatgagttccccaggagccaccggtgacctcagcctggtcgggtaaagctcctcaaaaaaggagacatttctgctgagcctggaaggacaggtaggaaggagcttaccagaaaaagaaggaagagagggcctgcctggcagggaaaatggcaaacacaaaggcctggaggtgggaatgtacaaggcatatttgggaaaccactcaggtgtcctaaaggtttgctggctggcaggaggagggtatcttttgaaagggatattggaagcagctctttcaggaaggagggaccatctggcccaggggtccaggcagtggcagtaacattgtcagagacagaaagtcaaggaaagacgggaaaggctcctccccagctttccctctgaagacttcttacccttgctgttcctgtctttataggcaaagaacaggacagctcccttagcagccaaccagccaccagcccagctccccaggtgcctctccttcactctcccttcttattccaatatcaccaccctccagcccaaccctagcccactggggcaacactaggtccatgccctcttccaccttgaaaggaacaattctaaaaaccagagagaaagccatctggtcaggctgctcatcagaaataactgccaagtctgagaggtcatcctgtctgtctcctctccccggggacctggggacatggggtgagggccaaggagtgcckgtggcacctgtcaatgcacggactccttgtctgcaggcattgatttctctccttcctgacctttcaggagaggcgccctgaattccatgccgggtcattacagagccagtggcggagactctatgagacccagccccactggctgcagccccttcggatgcatctgcgagagcagcctggccgtcacccgccggcctggcccgtgctgtcagccggccagagcgtgtctgaatcgaggaaagctgactggggctcgattcacactgactcgagccgcaaggcgagtttatggttcttgattacacccagcagggaggccttcttagtgatgagagagaaaatattcaacaacctgtctttgcaatgtgctgatctcttggagagagagagagagagagagagagagagagagcagagaaagtggaggaggggtttcaaaggagggtgatttatgagtggaaagaaggcttttttaaaaaaaaatccagggctcccccaaactgcctcaacatttcctctttctcatcgttgggttttgccttgrtataactttgaggcacagtgattgcatccctgtgggtttctgcaagctgatgcaaagcttaaaaggatgcaggcccggaaggcactgtagtccatccagccttcactcagcattgcctcgcagctgggagaggtcctggacagcgctgcctgcagaggctccgtgcagcccaatccccaagcccttctctccttcacagcccttttcacattctgcttcatacttaaactgcatctgcttgcactcggcacccaaacacggtgcctggctcatgctcggtgttaataaatgaacaaatgtgtgaacaggtatgcatctactctcccttaccaggccgtgcctcccaaagcccccatccagtaacctaaacaaagtcagccctgatgatgtgttgggatgaatgagtgagtaagtaacacagtccacaccctgtagagtctgggcactctcactgggctgcttcaccctgcatgttgtttctsaagctcactctggttttaaatgacacatcctaggcccccagaaaatgggatgctggaggaagaaggggaacttttctgaagacaacattttcagttgcttcttaataattcatgggaactagagttttaaaccattggatctgaaagcacctcccagcggacagtcactgagcatctggtggggggagggaaagaggagcccaggtttctccaagaaccccaatctcttccttcccaagacatcagaaaggagtctaggggctggccgtgttcccttttcttctctccctcacaccctctctctgccccctcggcttccctggggctctcctatggcccaactaagtctcctgccacttccctttctgcctcagcctccctacttgagggatggggaaggcatctcagaagaaagaaggcacccttatcttcatataaacatcaggattccagcctccaggatgcgtcctgggttcctatgcccaaggcaggagggagccagtgtgtggagggcggtgataccaggcttgccaccaccagcagaagtgagacgagttcagcccagatcaacccccgacgggaaccttgcaaaatcaccaaaaccctgcaagctcagtgtctctgccccagagagaggcgttggcacctggtccccactaaggcaggctgggtcagccagctggggggctctccaggctgccagggagaacagccactgaaccccagggctgctgagaacccagccagctctccttgactctggctctgtgaagtttggtacccaccgaaaggggagggggcagtgtcacggggacggtgcccaagctccaaaactttacactgaaagttaatccactgaagcggagcccaaaataagcgcactgcctaatgtgccgggaactgccggtcgcaaggccaggctgctagcggatgccggcgcatctccgcccgcccggagcctgcatttagcgccagcgagggagtctgggctggagcgctgctttcacaccgactcgagccgcgagtttatggatcttgattgcacccagcagggaatcctttttagtgatgagagaaaaaatattcaacaacctgtctttgcattgggtgtgttggacacacttccctgcttcggaatcagacatatgtgagttgtgggagtagaactgctgtcagcaggccagaacgcgcctctcctctcttctcctctcttctcttcttctcttctctcctctctcctctcctctcctctcctctctcctctcctctcctctcctctcctctctcctctcctccccgcgtccccatccatgggggcaggggagccgagagggggttctgtgtggccggccccagctgctccgggagaagataggcagtccccccaaccccgcgaggcccccaccccggccctgggccctccgcctgctccgccgccccggccgccgcctccctcctcggcctgcgctgcgcggctgggccgtcctcctcggggagccggctcccgcgtggggcccgctgacagcgcgcccagtagaatattgtattagttggttgtgagctgtgttctcgtcagggtatctgagtttcacagaacagacggggtgagagtttttgtgctatatccagattggcttaaaataatgtcgtttttgtagcttattaaaccacagaaactacaccaaagtcatccaggctgctgccagcaaactctctgagttggggttggggtaagagccgagttcargccaggggtcaggctcctcgctcccagagctggagccagggagagagggaagtgaccaccctctgctgccttccttgtgggctctgactgtgggctctgaccttggaaggatgtagatgggtctgcggcaaggctgggtcctgccccgacctcagaactccctctgggtcatctgagagctcagggaccacttgccctggcttcgggttgggacctgcaggcacaggacagctggagttgaggcactgccctggtggggagaagctgggctgagctgggcactgtctgcagccagggggaaaggctgagacgtggcaggtccaaatcctatctggagaggcccatgcctaggcaggggagatggtgtggcggggggatggggggttgccattttttttttccaggattgcgaggaagaggcagggcctggaattgccaggcagtaaagacctacaggcacccctccccttcttccccatccccagttccaaaagaatagctgtgtcccctccctgtggaggggggaggcctcctaggagacatgccatagcagccctgttccctgtcaccctgcacagatctgagcatcattacgagctgccatggaggcccttcactaccttaaacttcacaacaagcctatgaggtatgtattagaatgatccctaactgccagatgaggaaactaaggctcagagaggtagagtgatttgcccaagaacacccagttacaaagtgataattttgaaatgtgaagcccagctaaccacagaatgagagttctaaccactgtagcacagggcttctctggaatttcagacttaagaatgaatgatgaggccaggtgcagtggctcatatctgtaatcccagcactttgggaggccgaggtgggcggatcacttgaggtcaggagttcaaaactggtcaggagttgaaacaccatctctaggaaaatacaaaaattagcaaggcatggtggtacgcgcctgtattccaagctattcacgaggctgaggcaaggggatcgcttgagcccaggatgcggaggttgtagtgagatgagaccgtgccactgcactctagcctgggtgacagggtgagactccgtctcaaaaaaaaaaaatgaatgaatgatatatagttttccttctcctgccatctcctgtttgagtcttttagaaacagaggaggctaaggaaagtgaaaatgattccaaaggaaacaaatccctgcccccatttcctgatttgtccactgccatgcctctgacctcctgcctcctcagtctctggtgtccagcaggaaagaatccagggctccaaatctctccagggccatgtgataccctggcctatgggaagatgccctggtcacttttcctaggctcctccaggtagccgagcctcagccaccagggccacagacttctctgctgccttgagggacctacgggactagcaggagctgctcttcctcgtacgacttctacccacccaggtaaccaaaaacctaggtgtccttctcagtgactcccttcccccaccccaccatgtccagtctatcyccaaacactgatgcttctacctcttaagagcatctccccagttccacctcctgacccagcccaggccttatcaccttttgcctgggggttttggcattactcagctcatcaactgctcagcctccagtctctccttctccagtccacaccrcaccagagtgagccttctaggatgaccatgccactctcctgtgtgaaacccttatcaagggctcctgcctccatgctataggatggaggtgtcatgacttagtctggccgacaaagaccctttacacatcacctctgctcacttctctgcctcatccccctacaacccctgcatcctgccatccaggatgaatggtccccccaaacccaagcttctttgacacctccctgttttggctcagttaggacctcccgcctgatacctgaactttgtgggatcaacttcacatcccccaaaacagacctgctggggacaaagagcatgacacacagagcatcaaagtagcagtccagaagccctgtgcaggaggcagggtccaggaccatgccctccaggacaggctgggggccgcagtgcccctcagtggtcatgacttggacctgggcccaaatcctagctccaatattggggctcatcattgaacccctctgtgtctcagtttcctcacctgtaaaatggggtaataatagtatctacctcctaaattggttgtgaagattaaaatagttaattatgtaaagggcctggaacaggcttgtcatacagcgttacataaatgctagctgcttctattattatcacagtccatccaagccctgcctcctttgaccttgaccctttgatcgccagtgacctaacaattctctttctcttgcacacacatcctcacatacatatgtgctgatgtatacacacacacccacgcatacaagcatgtgccttgccagcctccccaccctcagaactcttctcgcacttcatggtccttctgagtcagtttcagagcccacgtttctaactctctacccatttgccacatcagagttcaaagtcraaagcttcccaagaaccccacccaggttcctcctgccacccagaggattagacacatggatccccagctattcctggcccctgctacactgctcagcaggtggggtgctggtgtctggtsggggggactgaggctggtgcagtgtaaccagcaggcatgtggacaaatggagatggtccctgggaagatggggagttccttccaaaatgattccaactcaggaatgatgcctccttttttggctcctgctccagcagatcccagactcaccccactctatagcagaccccaaagcaggagctctcacmcgaattagacatttttgtttcctggggagtttgctgtagtctggtctgcaaagtgccaagggcttgctgacgtgccatgggcatgaaacaggacttccctcatggtctcacagaagcttctagacagggcccttgcacaccaggaaactgtaacacccagctcagactagcactttcatacacccaagcgtctaaytggggggaaagggggagggaggtggagtaaagcagaatggaatttgactccattacctcccyactgtgtgatttcagggatatcacttgacctctctgagcctgcttcctcctggagacaacagtgtatactcagggctattgcggggaatgacaaggaaaatggatgaaaatgtgctggagaaattctgaggcatcagtcagatgaaaggttgtttaccatcaccttggaagctgtgcttgctctgtccccaggttcactttctgccctgttctgggccctccaggggccttccctatgaagtgtgtctcccaggctctcccaccctctggcttccagtccaggccagctaatatgtggcaccagcaaggaatcaagggcaggaaaagagagaggttgggaatgtgyctcccatctcctctctgactcactgcattcaggcactggctgagctattctatggccacagctctgtccagcggcccctcctctgtccttccttcccttgccccttcaggcctaagagcggccacagcttccttctccctgttgctaaagtccagatgcttcagcatcttgtattctttctcttagccctacctctccctctcaaatcagagcctgtttggcgaagacttttcaggtgtgccgactgccccaagctgacccagtgcggatcctaactggccccaccagcatcttccatgctcacccagctggcccatgtcttgaagatgccctgggctcccagctctgccaccccagctttctgagtctccatggatcgggatcactggggacccagcaggaagaagttggagaagataggaaggcaggacgggactggaatgattctaggatgaccaccccactggcccctgcagcagaaggagcctcagcctgggccctgtctctgccaacgccccctcctggcagaatgggcagcctatctgggtaaagacctgcccagaccccacagccaagggcagcccctcagagattcaggccaggagcggcctttgttccccacacctggagctcagagcttgcttagcctgcggtggaagctctggtttaattaaggatcttaggagagaattctctcttgttattttctgaataaattaaggaagtaactttgatgcaatatcattttcatctaatcaggaacattctgaaattaccatattgttttccattagaaaccccatcagcccctaaatcagataaccaggctggaggctgccagggcccctctgtcctggggcgggtgcgtgctgtgctgtgaggacacaaagggactctctgctcctgccatgatcccttgttaagttcaggagattgctcgtggctcttagcagggctcctgggccttggccgggcctggggaggggtcccccaggcaaagggcaaatgaggagcccaggaggcctgcagagcaggttgggatggatcagaacctgcctgggagcttcttgacagttcggcaggaaagaaggagaggtcaggctccttatcttgagcccccagtcccacccctgcctaggcagcctcacagggaccagaggacgggactcatcaggtccaagcccacagccagggacaaaggagggcgacccgagatcgaggatctgaggaaaggctaaaggccacccatgtgaggtgtggccagagggtgctgagaatgcacaaaatcctctacaaagctcatttccaatctctgaagctccctgaaggcttaagctgaggggtgtcaagacctcaacaaggtgggggccatggaggggaaaacaagagcatcccagggccagagtgccctcagagaaacgtcactgccactctccaaggtctcctcctggagggcacactcmggccctcacagcaggggtagggactgtggccagctgcagctggagtccaggacaggacccgagccctttctgaggccatcccagggctgagcatcacatgctgcatctcttcacacactgagatagagccaagtgcatgcctaagaaaagtcagtgaatattttttttttttttttgagacagggtctcactctgtcacccaggctggagtgcagtggtgcagtcttggctcactgcaacctccacctcctgggctcaagcgatcgtcttgcctcagcctcttgagtagctgggactacaggcacgcaccaccatgcctggctaattttttgtattttgtggagacagagtctcactatgttgctcagcctggtcccaaactcttgaactcaagcaatctgcccatctcggcctcccatagcactgggattacaggtgtgagccactgcctggccaacagtgatctttaagaagtgcctggtaatagagtcagaatmtctgtctgttggttcgtttgtcccaattctatttctcggtcactgtggctttctttcactcttgtttctatctcccattctctctctctcttccttcctccccctccttgtcctccctcccctccctgccacrcttcaggccctcaagaagccaaaacccctaaccagaacccagtaggggcaacctccacccacccacttgggttccacctggctctgctcctcccagcgccaaaacaggagtgtcagctgccagagagggatccgagaccctccacaacactcccgccactgtcccagaaccaagagaacacaaccaggccaccaggtgttgtcatccagtcaaagcagagtgaagaaggaaaaggaggggtggagcagaatggcaaggaggaggagggtggttgtcacatggtagagaaaagtgtgtgagtgtgagggcagaaatgggagtgaaggtggggaagggtccaggaaggatataatcccagaatggaggggtggccagcctgagggttctgccaagccccagagtcactgggtgtcctttggaagggatgagctaactgttctcctagtctctgggccccagagttcagtagaaggccaagcacacagaaagcccaggaaacatttgctaaacaaaaaaygactcagagaacgataggcagagatactggcaggggtcccttataagcacacgggggaaagggagctctgaacagcagctcatatccacaaggcagggaaagccactaccaggtaatgttctggagagcagggttatggcctttagccctggggcaaatgctgtctgcccccacttccctgctggatttgggactctgarcccacagaaaaggagcatggccagaaaaggtcwcggctcacagatggatccgttcactcattatgcaaagatgtctcgacggcatgctctgtgcgaagctcctgggtgaggcccacttgcttccctgtgctttcggatgtgggatgtgcatggaggtggtgggtgccagtgtatgcaggggtggcatgggtgcacttatagacgagtgggatgggatagaagagcatgtgtggggagggcctgagtgtgctttcaggcataaatggggactgctgagtgatgacagggcagctgggaggggcccctagccaggaggctcgggcccactcagcagatagtcaagggtaggagtattttctcctagagccctccccctacattttcaggacacccacagcttctagggggccacccatactccaccaagcccatgtcaaccagttgactttaacagcccaccttaccacatgtgaatctctggtttcatccagaatcagaagttaccaagaggtgctttaatgtatttggcttggtaaatacttcccacagcttcctccggcttttctgcccgtgatttccaagttaatgcctgtgagcacaccactgggcacacagtggcattcttctactggcccacactgctggaccaacttcttcctgattttcaccccctgtcccaagctgagacaggtctcccagttcccctggtcatttgaaagtactgacttcccttgtttctggaccacaagtctatggcaaaattccagtcctaaattgctctccccagccccagctctacttccctgctgctcccccaaatgcaccagcccccggggacccagcaggggtgggcggagaagatccactttggttcactatcggctatttccagaagaagtattgggtagcactaggctacccagttccctgcctcagcctggctgggacccagccagcgcgttgggacgcccctgccgtggctggctgaagcttgttgtctaacccggcctgggggtacctgggagcgggtggagggtggcctggcagggctcagagagcaggcacaccctgggtgagttcatgcctgcctcacacctctggtattcccgctgatccctatctcctcccccagccctcaggttcctggggcggagatgcaggcaaaagaggtactgatactacggtctggccccagccaagagaggggctgcagctgagcctctacctgcccgtcctctgctcccaccgccatccccaccccatctcctgcctccgcaccggcagacagacaaggctggccgccccataggagagaccgcccccccctccgccatgtactgacccctcctgggaaagaccctccctcccattcctccccaaggaagccgggcaaggcagaggggccctgaaaggcaggtttccaaagggcttccccttggaagacaccccgtcccctcccacactccaccctctcagcctcctcacctctacctcaaccgaactttcatcatttcggtaaccattattagtagggagccatatggcttatcatgcaaacttttgagaatgaaaggatgattcttggaaactgactgtcacaggcaaactggatacatgggtgccctgattattgagccccctctgagcgctggactcccaagaaggcatgtgggcattttgatgagctcaggctctgagagggcccgcgtctttggcctggggctctcaggaaccagagaagtatccagccctggatccctgtactgaacagaatgaggggtggggagaggctctgcagggaccagaaaggagaggataaatgccagcaattctcggtagagttctgtatgtttcttgttccctttattagccccatccctggcctagcccaagagtcaggaaaatcaagaccctaagacaatgacagggcagactctcragggacatgatcttcccaggtgactaagctgtcctctccccttccatcccaccttccctccccaacacccccgcctccactcccttttccccctgtctgcctccttcatatgctacaatcataccagtggttctcaaagtgtaggccccaggttggccgcatcagcctcacctgggaactcgttagaaaagcacattcttagacaccaccccagacctactgaatcagaaattctgcaacagaatcaccccagagggtttgttaaaacacgttctgttgcctgcttatgtggagaagcaccrctctactcttctcaagctttaatggatgtacagatcacctggggatcctattcaaatacagattgtgggatgaaaatgcagattatgactcaagaggcctggcacagggcctggcattctgcatttctctgaagctcccaggtgggctgatgctgcgagtcctcagaccacacttagaatagccaggcttgagtacacccctggttctcaaccccagtggcactttacagtcgcctggggagccttgaaaaaatgctggtacctgggccctggctccagaggtcctgatttcattgatctgaggggagactggagcatgggtagattttacagcttccccaggtgaatccaacacacagctgatgtcctccgcctagcgtgatgagtggacgtgcttggcacccctacaccccacgcacccactcaccctctgggatcccccttctcccttcactcttccttatctgcttccacatctccttccccacatcggcagacactttgacatgcataaacacaagcacatggacatagagaaaggtatctaggcagctgtagactcagacacacaaaaatgaaagcaggtggacagtaggcatgcaggcatgagtgtgtacacacgggctgtacacatgcggaccaacccatttgtcaatgtgctgtgaacactcttagatttatacagctagatgggcacacgcaagtgtacacacaaaacatgcaagagtacatgccagcctcaaaggagccaaagacctcctccatctgtctccagtggggtgactcttggtctcattgcaccagatgatggggcccgtgggcccagcagtcctgtctgtccctcaagagataggtcagccctcaggaaaccagaagtctgggcttggctctcttttctcatttagcaccacggaggtactctaggctgggtgcggtcctccccgggaggtgttagtttcctatggcagccaactcagcctcaaggtctccgaggggccttggagacatgcctgtcccctagtgtccaggtcagccatggaggggcactgccgccaggaggctgcccctttctgggagctgtgggtgtcctctgtccctcagttcatcacagtactgctctgttggagcctcctttgggtttaaaatccggcaccccccaccccgcgtgcgggctgggaccctccatgaacagggctgatggatgactcagggggactgcggctgctgcaggcctattttatgatgtcattaggcagcttcggcagcgggaaggaatccctcttgacatcataaaggacttgatatttcgctaatgttatcttggcggcatgtcgccctgacattttctctttgcagcgctccccccaggaccaggagttgtctaactacagcctggaaaaaatgcaaaacagacaaatgcaccctcgggggacagygggagaaagctaatagaccagtccccagctccccacccacagaggtggtttaggtgggaagcatgatgtgtttgtcaaaggagacccggggctgccttcccactgccagctctccctactccagacacagcaggatgagtcagtgctgaggttccagaacccgccctgctaccctgaggctatgtgacttaggcaaagcccttgccctctctaggcctcagtgaccccatccacgctcccacacaggggatttggactggacaatttcaaaggctcttgggtgatgtcgaaggccttcaagctgccagggagggtgacggtgccacagaggaaagaaggagggatcccctcctaggctcagaactgaaagcctgcacagctgttgcgggaggatgggtgatatggtttacaatccatccccttccccaggaatggttttggaagacagacagaggagcaaggtgtttccctaccctgaagccattgtcttccaaagaacaagatcaattactggttctgaggcaaattggagatggcactggggtaaatttgttgctatgggcctggcgggtggaagcctgcacaaagtaaccattctctcattcccagggctgccggcgtggctcagggtttggcaaaagagaaagttcctacagccctgcgtacctcctagattcaccaccaaaagtagctcaggaaaaatcaaaatcctctcccacctgggcagaaatcacccaccccagcctgaccccagaatccctgacagatgggcctccagctcaccacctccagagatggggtgctcaacccttcccccaggcagcccagccatctgcctccaagtggcatcctcctagggttccaaactctgcctctcagacatttatctccacccccaggacagccctgcaaaaatatgcacaaacacctcccccaaccccaccctycagtgtgcaggaggagaagccaaggtttgtgctctgttttcacagagtggaatatttgtcctcgaaaagagtgtaactggccattttaacctgggatctatggttagaaccgtaaccattcctttgtaatcctatgtatctcattttatgcatttaaaaacactatttgggtttgggcatggtgactcacacctgtaatcccagcactttgggaggccgaggcaggaggatcacttgaggccaaaagttcaagaccagtgtggcaacatggtgagaccccatctctacaaaaaaaaaaaaaaaaattgttttaattagctgaaagtgatggcacgcacctttagccttagctatttggaaggctgaggtggaaggatcacttgaggccagaagttagaggctgcagtgagctatgatcatgccactgcactccagcctgagcaacagagtgagaccctgtctctaaaaaaaaataataataaagaataaaacactactctagaagactgctaaagaagttcatggcatttaaaaaaaaaaaaaagtaaagaaccctgttctaaaatccagacaaagccatatttagccatgaatgtgtccagactagggagatcattatgacctgggttcatctctagctctggagaaacccttgtgccaatcttggaagaaactacttttaaaataaaggtagattacaaaacattgtttaaaaaaagaaaaggaaagaaaaataaaataaaggaattaggttggtgcaaaagtaattgcagttttaccaaagttaatggcaagactgcaattatttttgcaacaaccaaatagattagaccattttcccagccaaaccccccaacccctgtcttctccaaggcctgttctgaggtctgatctgcaccatcagaggtgcctagaccacccaattcctagactcctggcctgagctgaacaggccacacagcggacgtcaagggcacctgcgagggccaggcaccattgtaagcactacaggggcaggcaaacatggagcagactcaatcctggcttcaggaggttctcgcaggtaagtagacacgttccagccacaactcgctgcctgtccctccccagccagtgcaccaagagcctcctacatgctcggctctgcccgcgctgctccctgggcctgcagtgcccggcccgtgctcttctggtagctaatcctcccccaactttccagcaccagctaaaatacctaccttagtacaagtttattccgsgttctggtgcccttacctccacagagaagcctggctgagtgtgagcctcctggaaggcccgccttagcctcggatatgcttgcagccacggggcagggagctcacagagaggcttccagggagcaggatccctgatgcctggctggcccacgagaacacactgttgactctcccgctgagttgggaaccagcacatggtacttcctcctgagctggttgccccaagcggaaggaccatggggtttcctcccaagggcccccactgcctccctaacaaagtaatgctgaaataatgccctttcagaattgcagaattctcacctctgattgcccaagttggaagatagctgctcctatgttttggcaccctccaaaatgatgagcaattcattcattcaacaaatatttattgagcgcccatgacttgccaggcactgttccagatgttgaaaacaaagacaaaacatccctgctctcaaggagctcacattctctcagggagagacaagcaacatagaaaatcagtcagcaaaaaaatatatatactggatggtgacaagtgccacagataaaaataggtcagaaagaacagggtcttccttatggagaaggggacacttgggtaaagacctgaagggggtgatggagggaggcatgaggatatctgggggaagagcattccagcaaagggcatggcgtgtgcaaaggccctgaggcaggagagtgcccgacatgttcaggaacagccaggagggcagtggggctggagggaagtgcaatgggggagaatagtaaagacagggatgggggccctggggtgagggatgattgaccatgtgaggccttgagcctgctatgatgaccttggtttttactcccaatgagatacgcaccactgcaggctctgagcagacaagtgatgtgctacgacttaaatgctaattaacaggatcactgtgactgctgcgtagagaatagaccactgggcatggacctctactatagcagtgtctgtggaaggagtggttggactctggctgtattctgaaggtgaaatgatagacacaaggcactgcttctggccttgtgcaccattttctttctttctttttttttttcctttttttgagacagagtcttgctctgtcacccaggctggagtgcaatggtgcaatgtcagcttactgcaacctccacctcctgggttcaagcgattctcctgcctcagcctyctaagtagctgggattacaggcacctgccactacgcccagctaatttttgtatttttagtagagacagggtttcgcctgtaatcccagcactttgggaggccgaggygggcagatcacctgaggtcaggagttcaagaccagcctgacttttttttttttttttaagatggagtctcactctgttgcccaggctggaatgcagtgatacagtcttggctcactacaacctctgcctcctgtgttcaagcaattctcgtgcctcggcctcctgagtagctgggactacaggcacccaccaccatgcccagctaatttttgtatttttagtagagacagggtttcaccatgttggccaggctggtctcgaactcctcctgcctcggcctcccaaagtgctgggattgcaggcatgagccactgggcctggcccctgtgtgcccttttctatcagcctcacaatcacgccatgaagtagggtctttctccccattacacagataaggaaactgagcttcagaaagcccataagtggaagattcaacccaggcttatcaaggccgaagccaagttcctcccattctactgcaccacatgcctggtcaggattccacagaccccaagagaggggaaaaaagtcaagatacttaccagctgagaacttcatgctaatttggaattgtccacaaattgtcaccttcacatgttttctctttatgttaaagctcaaatgacacattgatgttaagtgtttttatttttatttatatagtttccatttttaatcaatatttttattttaaattgcatccaaaatcatcagtgaagagagagaactgcaaggagaagggagagtgggggaggcataatcattgcaagatgtgagctggagtaccttgtttcttaccagaatcatccttcagcactgcaacrggccaggccctgggctagggaaatgtggggcaggcaggaatgaatctgcccgagtccctgcccagaaggacctctcagcaggtgagaagagaggagacatttccaggcagcacatgagaggagccatatccagggcgcagctgtctgggaatgatctgggtgactaagcaaagaggaccagccagggaaggcaggactcaggacacagacaggaggaagcgtcgccctaaatcaaatcccaggaaaggtcccacgatgacagaagggatcgtcgtggatctgaggcagaagtgctctgaagcccaagctggcaggtcttccagcaggcagtgcggctgccttttaccagcagtgtaggagcggtgggagagggctcctcaaaagggaaggagaaaaggtcatgggttctcactcggayctactgctgggggctgatgattaaaatgcaatggggcatgcaatggctttaatttacagagcccccggagactgggtggctctggagctgcatctgcatgggggcgggagtggggacccctctccagaggttgaagtgtggcttctgaaacgtcatttgtcactcccgcagcagcccaagacccagtctcttcaagcgagttgcaaaaaaggaaggaaggagagaaggaaagaaagagggagagaaaaaagggacaaggatgaggaatggaaggaagaaaagaaaaaggaaaggagatgagaggaggaaagagtgaggggagggataaacaagtccaaagggcaaagcgggtcctccttcagggacaccagggcctggtcctgtcagaggcagcaccctgggaaaccttgagcaaagcttcccttcaagcagaggaaaggaacatgagagtccaggaggcctcagccacagcgcaaagatggaagtgatgaccgggagccactgcagacacagggaagattccatcctgctcaccctgagacagccatgcctgcatcctgaagtgaataccaataccctcactagatgtacacactgcaaaatacaccaacatacaggcacagctgcagagacactcacgacaggcatggacagatttacatacaggtacaagacacatagaggcactggaaagaacaaacatgctcatagacgtagatgacacttgcacagatgctaacagaaagcacagactcatgtcygcagatactgacagaggtcatcagacacacaccagtgtggacctacctgcatggacagtgcacaagcagacatttgcagatacaggcagaaatgcacagacacacacggatactgacagatgtatgcatgcaagaagtttgcttatacacagatgtgtaggctcacactgacacagacacaccttggtacacagatgtgcacaactacatgggtgcaccagctcttgcactgatagacatgcacactcatttataagaacacacgcacccagcatacccttagacacgtgcacacacacaaagacaagctcggagacaccggccgacatgctcaggcacgccagcaaccaggcagacactcatgctgctgggctctgttttgagcttaggccctgggtctcagcttccctgagtggctgtcctcaagccaggccctctcctgccccactcctgccagctgcccagctttggcgagttccctggccaagcccgccaggcccacccaccaacccttggtcagatccgcccatcaacccttggtctgcgcattggccctgtcccaggccccaggctccaggatagcaattgctccattctaccaggtgccgactcagccaaatttcacacccagaaatggagccaggccagcagggcttgttgcagcccgtgtggggcatcagcatgggggtggtgtgagggagccaggatcctgtagtggcagagagagaagcagccccagttgccatgcagccctgcctggtgatgctgccagcttcttcttcaggtcatccaccctctccaggcctcaagctcctcacctgtgaaatggacaatatgcctgccctactgacatgccaattaaatggacatcccctctcagatgacaaagagattttgcctaagtttcccttgcctaatctttacaataacccaaagacataggttttattttccctgctttatactaggaagctgagccaaggaaggataagtaacttaatcaagggagcagacaggactggaacccaggttcctgctccaaattccatatctttcaggtaggtaagtatgcagcacatgacctcccagaatccaaacacttgcccatgggaaatgtcactaagagctcacagtctcttttttggtgaatttagacttggcctctgaatccttctcaacacaccactccaagcaccattcatacttggccagagttggcatgtggaatgaaacctactgccatcctatccctacattgaattcatctaattcagagggttgatgggacgattaaatgagatcaagggcagaaagtactttgtaagattacaagtgatgtgcctatcagacaaattgtagtacagttttcttttcttttcttttcccaagacggagttttgctcttttgcccaggctggagtgaagtggtgtgatctcggctcactgcagcctccaccccccyggttcaagtgattctcctgcctcagcctcctgagtagctgagattataagcgcccgccaccacgcctggctaatttttgtatttttagtagagatggggtttcaccatgttggccaggctggtctcaaactcctgacctcaggtgatccacctgcctcagcctcccaaagtgctaggattacaggtgtgagccatcgtgcctggcctgtagtacagttttcaaaagctatttacatccaagtcctcccaagtctccctatgctggggtggatggttagggacaagatagtcattgtcattgctccatttcacagaggaagagactgaggctcagtcaaatgagtccagggtaacatagctaggtcagaggtaagactgaggcccatgcactgacgtctgtttcagtgctcttcacagtcagggccccagccagacaggatgccagagtgtgtgggcatttgggagtcagtgctgggwagggagcaggaaggcccagtcttctcccaggagaaagggatagaccctacaactaattggttcagagtgcttcttttgaccctaattagctatttgtcatgtctccatttgcataccagaaaagatgcaaatttgcatatttgtaaatgaggccgggcctagatgtgggttctggaagagcttggcagttgctggcaggcagggaggcagctggctcttgccactgaagcatgggccgctgaggaaagaggagatttggaagacagctccttggctcaggcctgcaaggtgctctcaaagggggtcaggcaagatggcccgcccgcctcgctccctcccccagggctgaggggtgggcagggagaatgggtgagcctaatgctgctattttgattagatgaaacaaggagggggggaatataaagtaatttcaggacgctctgtgctgggaaaccttctgttcacgtcctcggatagaatctgtaacacttgcaaagggggaaacgtccccctccaccttcctggagaggaaaaggtttgggaggaaatggaggtcagggaaacacaccctaacacacacactcacacacacacacatgcacactctctctttctctcctccagactctcattttacacacacctacaattcacttaatagacgtacacactcgcatacacgtctgggccccccaggaacacccgtatttacacacgatatccccagtccccccaaaggtacacacgcaacgcgaactggagaggcacattcgcacatatgcaagcattcccagacttcccgcgacacacacattcacgcccttacacatacagacacacactcagacacttgaacatagatgtaggcacacagactcacttaagctgtgcgtaaatatttacatacacacacacaagacgtgctcacgcaagcacatccttgctaagaccacatttcctggcaaattctggtaattctgacccctctgccagagttcttggtgcctctttgggaagagacaaaggaaactagggacctgtccttcctagaaagggagtaatgtrtccccaaggaattggaccccaaacaaggattatttctttccccggaaagccaatgactagcaaatgctccagtgccttctgggcttccacctagagcttggagcaggatctgggtgggccttgacaaacgggagagcagagcgggagaagatgtattggtgggtcccaggccatgaattgcaggaaascatcattgcctgagaatttccatgttgacctcagaggccagtgtggaatggggtggcgtgagctgctgtaccttcatccctgaaggccccaagaggccaagctcaaagaagctccagactcccaaagcttcccaggatctagggcccaggggctggacactggagcttagaggcacagggtcaggaccaaactcctcaaccactgttcccattccccagcacctcctccccagtgcctgcatctcaaaaggcaagctaaatggctctgtatttgtaaattaaatatagctgcacttcagctttccaaagagctgggaaggagagaaggagaaagaaaaagagagagaggaagagaagaaaagctgccgccctcaggaaagtctggctggtacagattgcctgagtcatgaatattcatctggcgaatgaggagagcgggagtttgcataacagctccacccacccaactgaaagaaatgtcaccgcctttgccaataaagtgccaaaggaagccggtggaggctgccagccagacggtgccaaactgctgacttccactctaaggcgtggagaaagcacattgtttccggcccaaggagccgccacttggggctgggggaatgaagctggcttctgggagagaaccaagaggaaaagtttcacttgccacccacaggaagcctggtgggcagagcgcctaggccacagccctccctagggcccctctgaagacaggctcaaagctgactcttccagggcacccaccctggccaaccaccaagggcccaggttccaggctggctccagctgcgagccccatgctcaggactgccttaaagaaacctcaagaggatcctcatgagtcccaggttgttactagggaccaggaagcaaggggacaaaccagatgtcactttggggcctggaagttttccttggccccattttgcagaagggatcaccaactgcagggtcatacacacttccaaggcccaatcctactatctcttattccaagacatcttcccagattccctgtcaccaagacagagtcagtctctgtgtcctctgcacaccccagtcctgatagcttcctttgatcccagccctttctggcccatgactgcttcctcccctgacctgtgagcttagagagtgggctcttcctgattgatcggcctcagtgccccagcccaacatgagattcagagaaagcaccttgagcaattcgttgagcagagtcgattcttccatgcgttcccctccccatgcctgtacctggctctggatctgtcctttcttggaatcgtgcttgtcaagtccctgggaggagaggcattccatcccggcagctcactttgggcccactgagatcaggactgaagccgagcagctggcctcccatcctcagcaccctactccccatgaagagcacggacaggctccagctcccgtggcaccccatcctcatggcggcacccattaggtggtgtcacaaatgcgcctgcctgcccgccagccttccacagctggctccctccagtaattacctaaatgaatgggagaagcagagctgaagagaagacgttctcttagtacagaaaagcaattagggctgtgggcgtctccagctgctgctcctgttatgtaaagtttgggatgtgtatttgggacttaatgaggatattcgtgtgttcacatcttaccttcgcagactgctcatttcaagcattccaagtccgcctggctgccgtacacagcaatacaagctaggccacaggttytgagggaggagtaccactatggggcagccaaggagcccctcttccaggactcatggaaccacagaaatctatgatgacaaccccttagaacctggcttccttctgcaggattcctgctaagtccacattctgcttgaggcctctgggaactcaaattcctytaccacctccttcatgggttaaacatctgcaattgctttcaaagttcttccttgaactgagccaaaatttgcctctttgcaacattcttacatttgcccaaacaattctgtatgtctgggaccacacaggatgcgctgctccctctgccccaggtccgtcactagtcctgcaggaggcaaatcgatatggaactgaaaaagcttctgtagttgaataagcttgagaaaatgctacattaaacaagtttcttcgctgcaggacttctcaaagcctttactgtactcacgtgcactgagctgtgggtgctgcatttcctgaacacatctgctcatagaacccttttctgtgaaacaactgcaagaaactaaaattccaaggacaatgtgtttgaaagcactgcttcggcaggttaaaagcaaacatctaattccttggcctgagctccttcgagcatttctcctagatgggcatgatgcccagcctcccctgaccctggtcattttctgtgggtgagctctgcccgcgtgtctgcctctctccactgctccagagaagctctggccactgagagtccaaaagagcatttatctccactatccagaaccccatgctcccactgatgcaatcaaaacaccattagaggcccagcagccgaatcacactgagtatattccttaaaagtcttcccaacaagccactactgagccacaactccttgttctgytctcgggcactgcagttggaacccacaggcagacccctccatgctcagtgttccagacaacagagtgctgacgatgctttctctggacagccagatggtgggccgtggtgagtcctcaaatatctgtacaccaactggtagttcacacacagttgggctttttcacagcatcaccaaaaggacgaacttgttctcttgttctagtgcttggtcagctcagactcactggcagagtgctccactcatccaggctctggcctggaagtctcaccagactgagctcaccgtctatgcctgcatggatgggaggccctggctccaccaggcctcggctttcctgctccttccgtcgccccttccatgtgtttcttctcatcatcctgcaagcgtgtgttcaagcccaggcatggaaaataggttcatctcagcagccaactccaagaacctggtagcggctccctgagctggctattaggagaaagattttatggcttcatctgggctcggcagaatgactagtgatgcctgccagggctggggagtgagcagggaggcacacgagccagttattgacatctctattcaaggctcagtccctttcccttaaatcagctcccccaagctaaaatcctcctttctcccacaacaaactcccttactcccacacacgacaatgcacagcctcattcctccactgaaactgctcggtccaaggtcatcaacaaggtcctatttgtcaagtcctgtgccctttccccagcctccgtgcctttgcatcattagatatggttgacctttccctagaaattcgcccccacacccatggaatcctgagacactccatgctcctgtagccccgcgccttcctgaccacgcatcctgtttcttcacccgtcttgtcaccatggctgtgttccaggctcagtttccagctttctcctgmacctgccgatgcactctctccctctgagatttcatccctagctctgtccttggggaaaagcccaccccagccctccccttctaagaggcagccatactgcccaccagccactgccacagaacaaagctctgaaaacccagggcctccttcttcctccagcatcaactcttgctctgggtttgccatgatgcatgaagcttccgggcaccaaagggcaaattcttggcttatgtcttgactccttatccacatctgttaaatcaccacatgctgattcctcctatttagtatctgccttatttccaaaatgctacaacaaatagaattattctttgttctgattaaaaaacatgatatatcttcattataaaaaaaaatctaaccaatacttaaaagtacaaaaaagaaagtaaaaatcctacctcccagatacaaccactccaagcattttggtgaacagccttccagacatatctctatgcatatatacacatagagatctatgtatataattttatagacgaggaattgtattatacatactgttctcgctgacacctgcttttctctctcaacaatatgtcctagacatctttctatgtcaataaatagagctctacaaaattattttaattacttcatagtagtccattatatgtatcatactttatttaactgggtctttactgatgatcatttaaggatgttgtgagaattttgttctcataaacaatgttgtgataaatatccttgtgcatattctctttgctcatttttgcaacaattgccttagaataaaatccaataaatgagatggctgcaattaagggtatgctatttctattttrccactctgtccttcagaaagcttacaacagcaaaattctcatcaaccgtgcccacacattagtccagaccctcatcaagcctgggttttgtcagccttaatgtttggccagatcaacagaaggcaaatgatgcttgtttctattggcattgctaagattatagggagggggaaataaatgtctttttgttttttcaggcatttgtagttattttctttgtgaattgcctgttcatgtcctttgcccatttttctaatgagatatttatctttttcttaatgatttgtaagagctctttgtacattagaaataaaattaaactgttgtcatatatatatatatatatatatatatatatataymcacatacatatgtatatacccctcttttaaaattttcttataatgttctttaaggtacttaaatgtttaattttcatatagtcaaatttatcaatcttttcttttatgatttcaaatatcacgtcatacttagaagaatcttccccaccttaagatgatcaaaatattcactcatatttatgccatgtggtcttcatggcttgagcttattagaccragtcagagagttcttaccccaataaggagtgttgctatggctggcccattatcccaacgccatttataaaatagcccatattttcccaactcaattaaaatgctgttttatcatataaaaataccttaaggctgggtgcaatagctcatgcctataatcccagcacactgggaggccaaggtggcagatcgcttgagcccaggagttcaagaccaatgtgggcaacatggtaaaaccctatctctacaaaaaaatccaaaaaattagctgggtgtggtagcctgcacctgtagtcccagctaatcagaaggctgaggtgggaggatcacttgagcccgaaaagccaaggctgcagtgagccaagatcacaccactgaactccagcctgggcaacaaagtgatactctgttccaaaaacaaacaaaaattcccttaaatatctgggcccatttctagactctagtctgtcccagtgatctgtctgtctattcctagacaagaattttaattatattgtgcctttataaaacattttaatatctgatagagtaaatattcatcatttttcttttttggaattttccttattctcatttggtattcttccagattagcttcataattattttgtcaaaaaaaattctaatcctgttgggatcttgattggattatcttaatttcacacatttgtttaggagaattgacatccttaaagcattaaatctttctactcaagaactaggtatataccatatttattcaaactcagaagagttttcttcatgtaatgctacacacttttttgtaaagtttatttctgagtattttgtgtttgtgttttacagtatggatggagcttttattttaccttctagatagtcattttataaatagaaagactgttagtttgtgtaaatttttttgttactggccattttactaaactctattttttctgattgttttacagaatattgtcttgagttttccagataaataatcatcttatctgcaaactatgattatttactcctctctcccaacatttatactttctgtttcatcttcttatctaattgcaatgcctagcacttttggaaaagagttttttaaatgttgataacaatggttatcctgatctggtttctgattttaatgacaaaacatctagaacttcaccaacctaatatctctcgttccattctctccacctctgtagccactatcttatctagcccatcctaatttgtcaactgtgttaccataaatatggtgaataaggatacagggtttgaagtcagatgacctgtgttcaaatcctgactccaccatttgctaattatgtggtctagtcaagttacgcaagattttggaaagtcagcttaaaaaaaaaaaaaaaaaagagggatgggggaggctcttttaaggattaagtgagataatacatgaactatgtgtagcatccataaatgataatttttaaagtctcagcccccaatttctctttccaatccatatatatatatatatatatatatatatatatcccactcttacgttgatcttcccaaaatatcactgtgttcacatcacttatcctttcccttcctctgctcacaaatctgaagctacaccccattgcctacaaaatcaagcccaaattcttaaccttgcatttgagtcattccattattcaatcccagactttcttctagtctcatttcctatagacctcagccaccctcaccccactacgcaccctcacccaccctttactcccgcctacagggtctcctcattcatggctgcctaacaccaagtagactctcggctccctactcagatccctccatcagcccccgtatcagcccctgtatccaaactggcctaataaagcagattgattagttcatgtaatactccagatgcaacaaacatcaggcatagtttgactggggctgggactccatttttctgtgattttccaggttcttcccacctccatatgttggctacattctcaggttagtgttcctagtcaccagatgcctgccagaaactaggcccacatgtttcctcattcaaatccagatacaaagagattagacgtgcttccccagccatctcaccaaaaccccgagtttctgtctgatggggccaatctgaatcaattccagtgactaggagaatgtatgtatggttggtttggaaccagccaatgtgccaaggtcagagaagggggcattatctgaattggctaaaccaatcaggatccacctcagagccacacacactgatggagacagaggtggcgtcgacaacctcacttgcactacagcctcttccacttctcttccctgggacttaggcttcctttaaggcccaagtcaagccccagacctctggcaatgtgcccctccatttggctcctagagctcttactctgcttgacgcatagtaaccactgccatatataatttatttatgtagtcatttgtctcatctttccaattagtagtcacagaactgattgaagcctacaaaatgctttccacaagctagcccctttgaccttcaccacagtcctgtgagactcagaggggttaagtgatttgccctatgtcacacagccagaaacaacattgtcccagaggcctctgcagcaattgcatacacacacacacacacaaacacacacacacaccacaatccctcctctaacctgcaacattggtctgatctgaagatgcagaaacccccctggaaccacctcctttttccacttcacctcaatttctagagctcttagttttcctccaaaaagtacagggaaagttttcttgccagacagcagtttctaagatttgtgtgacaaggccaagtaaaattcaaatgactctgggtgatttaatctgcttggggctggggtggtaaatcagggcagcccaggctgccacagccgccccagaaacgcacgagccaagctgatgataggagtttatctgcagatctgcaggtgagggccctggaagcatgaactgtggccaggggagttcccctccactgcactcagaatacatttggaaggtcctatggcccacagcctctctcgacctacatgttccaccagaaaccatccttcccaaggctgcagccccagttcctccctctcccaccccccaccccatcatcagagctgtttcccaagtccacactggacttttcaggggaaggagaccagcatgggtcaagctctcactgaaactgccgcctcaatgccaggccctcatgtacccattacctcatttcatctttacaacaacttaatgagggaggcatgcccatccccagtttacaggtgacttaattgaggctcagagtgattaaatttcttgcccagggtcattacacagctagtaggaggcaaagccaagattcaaatttagtctcatgagactccaaaatccccatccttttaactctaccccattatggaggccaagaggagtaagaagatggcagcttcacttgggaccatgttgtttgagaaaagagaggagcaggccctggtggaagggaggttgttattgtgagcaaatgaagcaacagtattcccatagagaggaaacatcaaaggaaaaggtagtcacacttaggtacccactgtgctaagcaatatgtgtatatctgggtaccatgtgccaggtgctctacgtccatcatccaaaccacaactctatatgccataaatatttactgttagctggtaaatacttaccaaccagctttttgaaagaaaaaaggagtcctgatttgtagcatttgccaatttctgtggtgtaaatactcccacgatggtcaatttcaagctaccaatgggatgtcaatgcatgcagaattgggaagagatgcccaaacgtttgccagtaggaacccactccagtgggttctgttagccagtaggaacccactccagcactctactgtcagtaacagaggtgttgttaggccaggtgtggtggctcatgcctgtaatcccagcactttgggaggccgagatgggcagatcagtgaggccaggagtttgagaccagcctggccaatatgatgaaatcctgtctctttaaaaatacaaaaaaaaaaaaaatagctgggtatgctggcacacacctgtaatcccagctacttgagaggctgaggcaggagaatcacttgaacctggaggtggaggttgcggtgagccgagatggcaccactgcactccagcctgggcgacagagcgaaactccatctgaaaaaaaaacaaaaacaaaaacaaaagttgtcgttaaacccacttaacaaatgagatcatacaaaaggtgcttgggctaaaatccatgcctttataattttctaaagtccacattccctccacagctccatgttcccagaaacaaagatgatgcaaggaaccacaatcactgatctctaatctctgaaggagggtagacgccagtgaagtcctgaagggcagaagaaggccaatgggtaaaagttcagctgctcaatattcagtgtatagaagaactttctgaatgcccctctaggctgacagctacggaaaagcagtatccaggcatggctggcacatagtaaatgctcagtaaataattaatgaatgaatgagacattacacactgttccattgatacctcaaactcaccagatctaaaactcagctatctttgttcccaaaaaayccctctctcctcctgtgtgtcccatctcagtgaatatcaccaagccagaacctgagagtccttgtatcttcactcttctccactccccatagccaatcaatcaacaagtcctatctattccacttcccaaataccttgtgaacagstgctatcctcagtgtccccactctgccaccctgactgggaccatcaccacctcctgctgagctgacacacagcttcctgacctgtcttgtcagcacgtatccttggcctgtatctgctcccagcccctatcaaatccatgatcaacaaagctgccaaagtcatctttcaaaattgtacctctgagcatgtcactcccacagcttcaatgagtccccattacccaaaggatggagtcaaacccccttggtcctcccgaggtctggtcccatctccctctcctaactgatgactcgcctcctcccacaccccacattggtcttttgtggttttgtttttgtttttgtttttgtttgagacagggtctcactctgtcacccaggctggagtgcagtggtgccatctcggctcactgcaacctctgcctcccaggttcaagtgattcttctgcctcagcctcccaagtagctgggattacaggtgtgcgccactacacccagctaaattttgtatttttacaaaatacatgttggccaggctggtctcaaactcctgatctcaggtgatccacccacctcagcctcccaaagtgctgggattacagacgtgagccactgcactcggccacattggtctttaatcttcaatgtcaacctgcttaatgttcactgcaccgtgcctccacccatgcctttgttcacactatgtctcctgcctggaatgccytcttttccctcttccatcttttgctttcctttgcctgataactcctactcatcctgtaggatgtaaaggaagatagtttaagtagatgattcctggagatctttttartcctaacatttcatgattctaatgccaagtcttgatattcaaggtcctctggatattatagtcaccttctttctccttaggaccctgcaaaggtctctagggatcctgtaatccaactctaccattttacagacagaaaattggacacccaaagagggaagaggactagcccaagatcacacagcaactcaatggcagagccaggacaagaactgggcacctgcttcccagctcagggctctttctttgcactacatcttccaacctgatcctcctctgccaacatggatattctcaccacaaccatcactacccgactcagacttacctcctctcaccagagccatactcacaccttgcctgccttggcccaggatgttgccaggctgttccctcaactccactcaacttccagggtcctctacctccaagaagcctaccttcattatcaggccaaaaccctccacacccactcttacatacccttccccaaaccagccatgtttgtcggagcccagcaactagggcttggttcactcacatgcggtaggtgtcttgttcagtttcaccaggcaggatgtccactccttaaggctggctggtatctcttcatcttctttcttctcctccctttacatcccccagctcgatacacaactgctcagggtagcaaagtatagccaaaaacavcatcagaggtcagacagatggaggttcaaatcccagctctgtatgccctgcagggttgaccttaagtcatctgagcctcaaccttccttatctgtaaaatagctcctaccacccagggttgccataaggactgaatgagctcacccatattacaggcgtagyacttggtgggmccttaataaacgagagctcccttctccactgcctttctcactgaagcccaggacacttggagaaattgactcctctgggctgggagaggggcagcctcatgaatactttctctcactctcatcctcaacaggctacgagcagcctgcatacagacacatggggcatttccaacccccttccccacccccaacaatctgctttaaccttcccatcacaaatgccttgtttatttcaatatcacccgttttacttttccgttcacgcaaaaaaaaaaaaattacaaaaacagatttaaggggaaaaaaagtatttaatgagtaaaactgtctgtagctctgtttctttctcaggaaaaagtggctgtgattctggcataagagagggaagctcaacagcttcacttcattgcagctgccaggagaagcacatttcagagtggaacagaatctccaaattaaacagcgcgtcttccagccaggagcttcctgtgccgaattcagcttggcaggtgacatcccagcttaagcagagatccagccccaatgtgagcagctgcaaggctccctcctgttgcccctcctccagcataggagaaccagcctggccaggccctggcaagccactgaccaccagaaaaagggctctaagaagggaaggagacagctggaaaaggaatggatacrcctggccagtaggaactagggaaccaggagctctccccgttccagaacattcagagaccagcactttcttctcccttgacttagggtaattgggcataaagaacaaatccaagacagacctcaaacaaaaacccagagaatatgcagtgtctttcccaccttcaaaggtgtcattttggaggctgctctggrtggaatccaagggtcaaactccagaaggactctgcctcccctaataacttgaaaagaaagggagagaactggaaaaacagaaaatagcacatgaccttcaaatacctgcagtacaaactgccccagggcagagagtaaactgaggctagagagaggcccccctcccttgtcccaaacaccatacttctattaatgtagcctactgactcatgctgaacttactggcacttgagcttctaaatctttctcatgagctgcccatcccttctacaatttttcctgtagtcaagatgggcctcagcctttttccctgtgatatttcctcagctaaattcaccttgccacgccagtctgtcgagatctttctaaatcctgattctgctgaggttttctctgtcccttggagctttctaccactccaccttttataagtctgtatcctccatgtcttcttataggtccttggcatagactgatcaaagcagggtggacagccccatggcagtgtctagaggccttctgtagactgacctggttacacttacgtgaacatttcatggctgttgtttggcccaatgggagccctctttgcgccctctcagacatccttcatgtcctcaaaagtcacgagagactctacccaacatcttaggagacagtgtgatatggcagaaagggtcagacagacccaggtttgaatcccagctccacccaccttgggcaagtcacttcccggagactcagtttctcatcagtaaaatggagattgtcaygtcttgtttaatccacaagcttgtgaggattaaataaaaccatgcgtgtgaagtatccagcacacagttggtgctcaataaatcacagattcctctccacccatgctggctcgttttctttacccacgagtcattaagctgtcaagaacctaagagctgtgcccggtcttggtgaacccatgttggcttcagggatcactgccttcttttgtatgtcacagatctcaccatccatattagaccctcatactaatttgagatcggccaaaaccctggatctttttttgtctgaattcctgtcaagacagtccttccttcctggacctgtacagctttttaaataacaagaataacagtagtaatgacagcttgatccttccaatctcactatgaaattttttttaaagtatctgcattgtgcctgtcaggaaactgaggttcagagaggttacataaccctcccaaggtcacacagctggagattgtgaaagctgagtgcagctgtctgaccctgaccaccacactcacgcattagagaatatttcctaaatgctggcctaagggggcatattgtctctggccttgctgcatgtgtctttcagcctcagcccaaagtttcacttggttgagtgccttctaggtcctgacactgtcatccacagggtggcctcccctcaccccacctcccagccgctctgtgcccaccaccttcatattaaatgggactggactgaggcacagaccccaccactccctgaagactgaaacagtgggcttttcatgttggcccccaagcccacatcacaccataaactctttgatgcctgggcccccgatgcccccacagcccaagcatagggccagcttggaccctctttcccaacccctcatcagggcttagccacctgccaccaaaccctgatgcctctgaactgaccactgcctcctgaatccctggtgccaggattaccccctgtccaagtggcaccccaaggcccctcttcccagactgtccaggtgctgaggccagctgctgctcatgtggctgtcctccagcactgactacagcctttgcccttctcctgatgcctcccagcccagggctcagactgtgctatagggtgagggaattccctaagcatgaggcccagatgtgcccacaggcaaaggaaggggtggacccaggaggctgccagggacagggctcaggcctgtggccaccaggtttgcagcccaccaaggaaaagattcctagacattcctagggaagccattcatgggtctgtttgcaaatctttgacaatacccaagcaggatgccccaaacctgaaagctctatcagagacttgccctcgggcctcaaagtacacagttacccacatcatcaaacacagtcacccacatcattaaaaatgcagtcctgactgggcatggtggctcacgcctgtaatcccagcactttgggaggccaaggtgggtggatcacttgagctcatcaggagctcaggaccagactgggcaacatggcgaagccccatctctaccaaaaaatacaaaaaaaagccaggtgtggtgactcacgcttataattccagctaatagggagattggggtgggagaatgacttgagcccagggaggtggaggttgcagtgagcagaaattgcaccattgcactccagcctgggtgacagagtgagaccccatctcaaaaaaaaaaaaaaaaaaaaaaaatgcagtccttgactatcacacacccacacacactttataaacacattcacagaaaacacttcaaaagcccactcatgcccgcatgacacacagaagcccatccatccactcagtaaatatcaattaagcacctgccagctgccaggcactgttccaggcacccgaaagacatcagtggacaaactgaacaaaggttccactctttgtgagggctttcattctaacagggatactaacaattttaaaaacttaggatagtacataataaataaacaaagctagacatggtggctcacgcctgtaatcccagcactttgggaggctaaggcaggtggatcaactgaggtcaggagttcaagaccagcctggccaacatggtaaaccctgtccctactaaaatagaaaaattagctgggcttggtggtgtgcatctgtaatcccagctactcgggaggctgaggcaggagaattgcttgaacccaggtggcggaggttgcagtgagctgagatcgcaccactgcactccaggccaggtgacagagtgcaactcccactcagaaaataaaaataaaaagtaaacaacaattagtaaatcacttggtatactggaaggtaatttaaaaaagaaaaatgagaacaacataagaagaactagagagctgtggggaggggagggcagaaattttttttttttgagacggagtctcgctctgttgcccaggctggagtgcagtggcacgatctctgctcactgcaagctctgcctcccgggttcacgccattctcctgcctcagcctcctgaatagctgggactacaggcgcccaccaacacacccggctaattttgtttttgtatttttagtagagacggggtttcaccgt

SEQ ID NO: 18015 - DNA, 40000 bp, Homo sapiens
  misc_feature (1)...(40000): n = A,T,C or G, or insertion/deletion polymorphism (see Tables 1-2)
gggtttgctcagtatcactggagggcactggcccctcccagccgtccaccctcttctgcaggctccagctttcacctggggaggggcgcccataggaccagcactggcagggaaagcgcctccttcccctctgtcctgtcctgcttatggcccagcggagaacgccaaggggtccccatgttctcaacatgggtcattcctgggagtcgggtgggggcttcacacatgtgccaaagaccctactggcccacatcactagtgggtggggggcattctgatgctgcagctgggtcagagtcagcccagagcacccacagtggcaatgaagaccagtggccactgcatgcatcccaggggccagccctggaggactccacactgcgtagacgcaaacgcggtaactgcaggccggagccycagacgtcttctgagmgtcatttggttcatttggctctgggtggaattacatgccagtcatttcagaggaattatcaaagaaaccattttctctcccggatgaaacccaacctccacttactcctggggaggatccaatggcagttgcaggtggactcagctttgttcwttcactgggaaaggactgtgacgttccacgccttgtctaaactctccagaaaagtggggtgccatgagtgccaatgtccacaccctcaaatcacacagttagtaacgcccttgctaacatctgtaactataacttggcgttgccattggggatgagagtctcttgtcccttttgggtggatgtaatgacaccatatggctggtcaacctggcaggggctccatatcctcttttttttttgagatagagtttcgctcttgtcgcccaggctggaatgcaatggcacgacgttggctcactgcaacctcggcctcctgggttcaagcgattctcctgcctcagcctctggagtagctgggattacaggtgcccgccaccatgcccggctgatttttattttgtgtatttttagtagagatggggtttcaccatgttggccaggctggtcttgaactcctgacctcacgtgatccacccatcttggcctcccagagtgctgggattacaggcgtgagccacctggcccggcctgaccattttgattaatatgtctaaagcgccagctgagggtgtaccaggggcccctctgccccagccacccacaagatcagagtctgaaaagggaggtgaagcccactttccccacttctggtgtctacaccctcagctcaggacagatgtccagtaacacagctgtggccctgccctgcaactgctgtaataaatgactatttttcatggccctgctctcagatcgctgtgggatccctaaatgtttgtgtgtaactaatctcgttgggcttcargatcacagtaaagacagcttagaaacatggaagctctccattcgggcagcacctccttcttttagcaggatggggcygacctcgccagctggagcagcagaagtggccacaaacgccaccagggatggcagacggtgatccaggaaggggctgtgctcacaaggaccccagacctgctctagtcctctaggtttggaggccacgcctctcccaacggaactgcccaggggcacggggcaaggctgagcagccaggaagtgtcacaagtgttgygaggtgacagtgagggttagctggtccagctcaccttcrgcctctggcctcaagtgacacagccgggtgcccttggtyggcagtcagagggtctcccccgggcactgggctctgcccttcctcggccccttcatgccagccccttttggtcagcgggtgcggcagacctcctccaaattcactccttttagggaaatgagcagaaaagagggccgtgacttggtaattaaaaacagccctgtggtgctgggcaggaaccaggctcttcccgccctgcagctgctgtggaggccagacccaccctcaggtcctccaacctcctcggcccccggaagccagcaacggggccttctgggaagcaggaaagacctcagcagagggggcaccataggagcacactggacatccgtccccagttgagggtgtagacaccggaagtgaagacatggggcaccacctccctttccagactctgaccttgagagtttgtgggtggctgggacagagaggccccaggtccaccctcagtggtgacttgcagccctggtgcagggcgggaccgtgacatccagggtgaggacagaggacttggccagcatgactcaggccagggtgaaaaacgcctggaatgacaactactcagaaaagatattttgttggggagggtgcggaggagggtggggcagagaaggtaacagggtgcacaacagagatcagggaacagaagcgcagcctcagccggggccacaccgcctgccagcgggcacctgggggtgctccaggccctgccgccccagggaatgctccctccccggctgcctgagattctagtgcacgtgagctgctggccactgggtgcccgtctccatggagaccagctctcccatctcacttcctgcccattcgttttggctcctcttgggaaacagcatctatcagagcacctcagccacgcagagcaaagccgccctctctgcccagccttcctgccgccctccccaaccccagggccctgccccctccctctgcagctctgggaggacctcggggcccacgtcccgctgccctccctttccctggtgggccagcaggtctcatgccagagcctccggctcggcccttcccattcacgtgctgctgaatcacttgaaaacaatgcaccagaccccgggaggatttgctgagaacagtgcggctttgtggagggaagtgcagctctgcattttctccgtcaagacccacggaacagccaagctcagccctgcaaaccctaagccagagccggagcagggacaggagcaggaccgtgcagggcaggaggcagagggagcctggagaggcaccgaggaaacccctacccatccctgcaacccgcccccctacaacagatgagcagggggccagggtgacaactccggagccaggggcagcagcagattctctcctcgcactgttgctggggggctgcgacagcgcgaggtgggcagggcactgttcctcccaagccgatccatttttggggacgaacgtgaggtccgggcccaggcttcaggctcattggcactgactgtctttgagccctggctgttcgtcggacccagggtcatgtggcctgtgggctgagcctgacttgctgcatttctcaggagacagaaacagggacatgaaggacatgaaggctggaatcccagggtccacacacccaggaaagaatgaaagcaggggggctgaggtccccactcccctttcccttcctcctcagcacagcttcccaaacaagccccatgctgagcggcgcccccagactccctaagcttgtcctrgggggtgtgcatctgtgtagccccgtctccagctggaggacttggcctgggctgtcacagcagctgcaagtgcaggctgcaccccagccctccgccccgtgtcttcttggagatctcgatataacccccttgccatttgcacgaactggaagaatgaccacaggtcagggagggtgctctacccacccgtccactctaaaaaccctatttccttttgtcttatgtgtcggagatcctggtcacacagggcttgaaggggaagggagatttgtgcggagagaagatggacgccccagggcagctctcagggtggggtcacatccaaagcccaactggccagcaggttgggggggagcaggccaggaggtgaacaggtagcacctgccagaccctgctggcccccctcagcccatggacagctgacctcggcagaaagcacaagcaacgctgctgctccccgtccaagcctcacggaccaacagggcgacccacgcaccactgctcagccacggaggccttcctgggtccctgtggtttggggagaaggacccacaaggcagggagcaaagatggggccggaggacgaaggttccagcaaatgcagagtgaggcgcgaacacggaatctgtcccccaagggtgggggcagaagcaccaaaccagagcagagctctagaaggtgcaaagtgttcggagcaggagaaccgtgcggggtacctggaagtgccttaggatgaaggtgaacacggccaccacatctgggatcctcaccgctgctggcatggcagtgctctctggaaacctcaggagccccacacccttccgggtggctccatcccttgttttacagtcaaatgaaggctgggcaagggctggggtgtgagtccagggggcacccctgagcccgccaacatagccctatgaggtgcctggcacttcggggaggatttaggctcgcaaggcagggggcaggccctgygcacttgtgtccggaagagaggtggtgggaagagagatgctggaagctgggtgtgaggggtgtgaggggtgtgaggggcaggaggtggagggccaggccttggaggaagtgcagaaaccttaacactctgcccaggtcacctagctgctggcaaatggcagagccagggctccaaccccggcagtagggctctcaccagctcctggtggaggctctgggtggaggcatgggacggggtgagccaggggaagctggaggctgctccacagccctttctaccgcagtccagctgtgccaaggtgaccaaggggggaggggaacacaggcactgccaggccctgggatggaaagttactcatgacatctccgtaagaatcactggagggccatggttttgggtgtggacatcctggagggctgttttagtgcccacaccaatgccctagttaaagaaccaccctgtccccttagccttctgcaggacaggtgggaaagggccgggtgtctggtcctgctgccaggggacagtgcaggtgtgaccgtccgggcagagatgagtcaccctccacactgtcttgctgcccgtctccacgcctagttttagctcgtgtggtcaagaaggggcgattcctcacctagaacacatgggtcacaaatgctacctttgaaaatggaaacaaaaataacccactcaaaggcaggctggttcccccatcagactgtggcttccaggctaaggcaggaagacctcggctactcaatgtttgggccccattgtggccatggcttttaactcagtcatgccataacaccctctctgccctctcagacagaggtgatgctacactgacaggcggctacgctccaggtctccgtgtgcaaaaaatagctgggcacaaggcaagtgcagaaacagcaggagcacggtgacaccccaccccgagaaatctatgtggcttttgaaaaacagcagccctcctgacccccagtttccttcttaatcatgttgagcctatagcaaattgtggagtggctttgcaaccctagcccatgacattctggaagcagaggatagaaagaaaccaggctaagatcaaaattttcttcttctttttttttccccctaagacagggtctctgtcactgaagctggagtgcagcggcgcaatcacagctcactgcagcctcgacctcccaggttcaagagatcatcccacctcagcctccctagtagctggaactataggtgcacgccagtatgcctggctactttttgtttttatagagacacaatctcactatgttgcccaggctggtctcatattcctgggctcaagccatccacctgctttggcctcccagagtgctgggattacaggtgtgagccaccatgcccagcctcgaatttcctctacttggcctgaagcagaaagccacagacaacagagacctaagctactaatgattaaagaacccaaaagcaaaaacaaaagagtcttgtgggatgctactcccgccccgtccaaatgagcgtaacgcttgttggttccacgagcttcgcattcgccagggaagtccggcttgagtttctcagaggcgtgcacttggggtcccactgagcaccttgtcctgcacagccatagttccagcttttactcactcatcatctgcgtcctccaccagaacgggagtcctgtggttccatgtgtgtggctcactgctcatctctagtgactgggacagtgtctaggactcatatctgtaaatttatttatttattttgagatggagtctccctctgtccccaggctggagtgcagtggcatgatctcagctcactgcaacctccgcctcctgggttcaagcgattctcctgcctcagcctcccgaatagctgggactacaagtgcgcgccgccacgcccggstaatttccgtatttttagtagagacggggtttcaccctgttggccaggctggcctcgaactcatgacctcaagtgatccacctgcctcggcctctcacagtgctgggattacaggtatgagcaaacgcgcccagcctcatatttgtaaattaaatattttataagagcaggtcaatctttttctggggaaaaaaaaaaaaataggaaaaaaaaaaaaagagcaataaacgggatctttcccacacctacatcccagctgtgccaaaagcactttttgacacccggtcctttgattcaaatgcatcagagatatagtcctctttttggaaacaagcacgaaactggagaagctatgatcctggaaagaagctcatacacgcgatgaggatatgctgcagtgaaaatgagtaagaggcgtttgtgtgatgtggatgaattcagtaaccgtgccgaggccaaaaaacctagctttcaaaagactccacataatatcctttttataaagttcaaaaccaagtaaaactaaacactatgtttagcatacatatatggataaagatagggagggctaaaccccaagttcagcaggtatataactttttgtttctttttttttttttttccttttttgagatggagtctcgctctgacacccaggctggagtgcagtggcgcaatcttggctcactgcaacctccacctcccggattcaagcaattctcctgcctcagcctcctgagtagctgggattacagatgccaccaccacgcccggctaattttttgtatttttagtagagacagcgtttcacagtgttgaccaggctgttctcaaactcctgacctcaagcgatccgcccgccttggcctcccaacgtgctgggattacaggtgtgagccaccgcgtccagtatctttttgtttctgagacagggtctcgctctgtcacccaggctggcagtggcgtgatcacagctccctgtgcggcctcagtctctggggctcaaatgaacctcttgcctcagcctcacgagtagctgggactgtaggtgcaggccgctatgctcagctaattttttattttttgtaggatagggtctccccatgttgcccacgctggtctcgaattcctgggctcaagtgatcctcctgcgctggcttcccaaaatgttgggattgtaggtgtgagccatcagcaggtatatgtccaaggaggcagcagggggatggaaaagggaggtagcgcacaggtagtgaatattctgggtcttgggtctgggtgatgggctcatggtacttcattatattgtctacaaaatatacataagtaaggccattcgtggaccaatgatactaatgtgtcatgaacaaagattggttgatctaagtcaatgtatctgaggttgttggaagggagggagagagacagactctgaaaccatcctagtacagggatcagcaaactatggcacaaagggcagatgccgcycaccacctatttttgtagagtctcattggaacctggccacgccctttcatttacatctcatctgtggctgcttctgagcagctgcagtagagctgggtaattaccacgggggctgcacagctggcaaaggctaaaatatttactctctggctctttgcagaaaaagtatgttgatccctgtgcctgtccctaagactgcaattggcagaagagaagctacccagtgtgaggtctccatggctctggtggatgccaggtcagtggcaaagctagcggggaggaaactgatcaaacacccaggtgccgacacccttgccagccccagagggaatcacccagcggggcgagggtggcttgtcttctcttttccgtctactctcttttctcttaaagttataagaatgtattaagcgacgtgctatttaaacaatgttggttttgttgtgactttgaaagactaagaggttttagctttggttcaatctccgttaatgtctcagccttggctaagcactaagtgatctatctcctgaaattgtgcccgtctgaccttgggtgcccctgaaaggccagtgtttatttggctaaaacatctgaagggcttaaatgacctggagtctccatctgtgcctgtggcccctgaaaacagactgtcacccaggctggaatgtagtgacatgatcggctctgggagatgcatccacagcacatgggctagacacacccactgaaacccacacgggttcctatttttgtatataggtggtttcccaaaagggacttcgttttaaaggcaagactaggccaggcgcggtggctcaagtctgtaatcccagcactttgggaggccaaggcaggcggatcacgagatcaggagttcaagaccagcctagccaacatggtgaaaccctgtgtctattaaaaatacaaaaaattagccaggcatggtggcaggcgcctataatcccagctactcgggaggctgaggcaggagaattgcttaagcccaggagacagaggtactgagtcgagactgcaccactgcactctagcctgggcaacagagcaagactccgtctcaatcaatcaatcaatcaataaaggcaagattagggaaagagtccctgtgagggaatgtgccctggaggacggtataatgacagattgctttttttttttttttttgagacgagtctcactctgtcacccaggctggagtacagtggtgcaatctcgactcactgcaacctccgcctcccaggttcaagtgattctcctgcctcaatttcctgagtagctgaggttacaggcacatgccatcacacccagctaatttttatatttttagtaaaaacggggtttcgccatgttggccaggctggtctcaaactcctgacctcaggtgatcctgaggccgacctcggcctcccaaagtgctgggattacaggcgtgcgccactgcacccggccccagattgcccattttaaagaggcctaatagtctctgaggcaatgacgcaaacacagatcttagagacccgggtaccagtgctggcagcaccattatcagtgatgtatttaccccgggtgggcctctcgcatttagcatatgttctgaaactcccgcaagcatttccgggcttcttcaagaaactgcttgtgcaacctgttttgctgtaagatctgctgctgctggtctcggatcatctgactgtgccggtcgtcgtcggcgaggctggtgcccgatggggaagtggtgctgagctcagatcctctctccctttcctgggctctcgtggaggaggacttcagatgggccagtcgagctcttctttgctccctcctctctttttctagctcagctttgtagtggatttccaagctcatatctgggtgttccatttgttcaagcgattccagttgtttttgtcttctctgctccatctctgctttctgcctttgcctggatgccgtcgagcccactctgtctgcctggtcttgaaggtggagctgaagggagccctctgccagcgtgcccagtttgggggtctcttgtccagattcagtgctatacaataatgagtcctctttgttgataaatatacctgcctcgggagacaatgtttgacttccatttctaaacgtgggcttgaccgtgccctgatatttttggttctgggccttgcccatgaacgttttcaagtcggtcttggacgctgcctgctgcgcctcctcctctgctgggctcctgggttccccggcaggcagcatctctgggtctgccattttcttccctcttggggtcccagcgccacactcttgcatctctgagaaggcatgcccttccccaggtctctggtccatcctgggcttcagtgccaggtacaagcacaggtgttttttcagctttctgtttatattaaacaactcttcaaaggccaactccagctctttctgccacttgttcttctcccggagcgtgcactgagatgctggggacacggcttcccttctgcagctggaatcagctggccacagctgcccgaggtctctcagcttcccctccagactctgtccctgagagcgactggtcagggctggaacaaagcaaactgccccctttcccagttgcctcctccccgcccgagctgttcctttctctttttcctccacaagcccgatttctcccacagcagccacgagtgggtttgacctttctaggtccgcccctttgctcctccgaggatggatggcacagcggccacccccagacttggtcgaaggttctggccttccctttctcttctcaggcggggccaggtgagaattcatccgacccgtggcttttgtagtctgtggtttctctggactcgctgctgtcttccggggcctggagtgcctggggtgttgctggcccaactcttccctgcaactcctctcttcactaagggctgctctatgcttctccttggccctcgggggcctggctgatcttcgctggatgggcccctgcgagtcaggctcattttccctggcccgtcctcctccccagcccaacagacgtgctgactgcagcctgtccaggccaccgacgtgcaggtgctgtgcctcctgataccctctcctcaactcctcagccaagcgctggagctggtagtttttccacagcttggcatccgctcttctctgcagagcgagatcgcctttgccccgggcttgtagcaatttgtgctttttcctccaaagcaggtcttcgttatcaggacagaggctcagccacatggctccatccatgtttctgttcctgtctgcgaacccagcagatacagcttcccagggaaggtgcttggagccaagagtggagggttcaaggggcgcccccgggcctgaggagccacagaagccacaacgttccacagcaaacctacgaggaagggagcacaagtgcagctttccagatcgctcccaggagagtgagcaaagccctggagacaagcacacgggattctcactgtgaggacaggctgcaaaatgtgcccctccaagctctcttgacccgtgcccaccagggcccactctcagcctcccaatttctgtcctgtacacttttgacaagagcctgtagggcagctgttttgaacagagtgtggtgttgtttcccaggggacattggcaatgtctggaaacattttctattgtcacaaatgcagggaggaggtgctccgggcctgcagctgggtggaggcgagggaggctgctgaataccccacactgcacaggagggctgcccaagacagtgaataacctggccagagatgtcagtagtgccgagactgacaatcccacccaaagggcaagggttaggattcaggtagggatkgaggggcacaaagggcagcccttggaaacaaatattgagaagagcaggtggaagtaaaagaggaagtctgggcctctggagggagaattgatcgtaaaggaaaggaggaagagacggggcagggaggagcctgccaagcatgtgtgtgtgcaggagtgtgtgcacgcgtgtgcaggggtgtgtgtgggtgtgtgcacatgcacatgtgtgtgcaggggtgtgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcatgtgtgtgcaggggtgtgtgtgcakgkgtgtgtaggagtgtgtgtgcaggggtgtgtatgcaggggtgtgtgcgcgtagaggtatgtgtgcgtaggggtgtgtgtgcaggggtgtgtgtgcgtggggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagttgcaggagtcagaaaatactgcatctacattacagctaacattaaccgtgcaggctcccctctgagcactgggcatgtatccgttcatcttttttacagtaatcctttgagatacgaagctcctaccccccccggttcacagacagggaaactgaggcaggcagagatgaagatgcttaacccagatcacacagctggtaagtggcagagacaggccctctgctgcttggacgaaccccagcacctttgaccaacctcaggtggtcacactgcagctggctttgacttaagtcttctagtgggaggtccttgcacctcttggtaaatcagatcacacaattagaatagtggttaatattatatttagccagatctgccaaccaccatgatgatcaagagagaaagggagagagaaagctgggcccttcaatgcaatgattgagatttttgacaaaggtgccacggcaatttaatgtggggaaagaatagtttttttgtttttcaacaaatgatgctggcacagttggatatccacaggcaaaaaatgggaattcacagccttatctcaccctatatacaaaaattaactcacaatggatcatagaccttcatctacaactataaacgcttagaagaaaacgtaggtgtatattcatgaccttgagtcaggcaaagatttcttagatacaacaccaaaagcacaaccaataaacraagaaacggataagctgaacatcatcaaaattaaaagaaaaaaaaaacctttgtgcttcaaaaggtaccataagtaaagtgaaaatacaaggtacggactggaaggaaatatttgcaaatcatatatccaacagaagacttgaatccagaacatatgaacacctcttactacccagtaagatggcaaataatcccatttgaaaatcagcaaaagaaggacaggtgtggcagctcacacctgtaatcccagcacactgggaggctgaggcgggcggatcacttgaggtcaggagttcgaaagcagcctaaccaacatggtgaaaccccgtctctactaaaaatacaaaaattagccgggtgtggtggtacgcacctataatcccagctactcgggaagctaaggcaggagaattgcttgtatctgggaggcagaggttgcaatgagctgagattgcaccattgcactccagcctggatgacagagtgagattctgtctcaaaaataaataaataaaaataaaaatcagcaacagatttaaatagatatttcaccaaagaacatagatgtgtggctaatacagcacataaaaacatgttcaacggcagcggtctttagagaaatgcacactgaccctgcagtgtcctgccacctcacatccactccaacggctgtcgtcaaaaagacagacaatagcaactgtcagtgaggaaggagggggaggaattggaaccctgtgcacgctgctggtgggaatggaaaatggtgcagccactttggaaaacagtctggcagtttcttaaaaagggaaacacagacttaccctatgacccagagattccactcctaggtctataaccaagagaaggcctgagtccacaaaaagaaaccaaagctcagagaggttgaataactttcccagctcacatggaggagttggcctcagacaccaaagaccaccaggaacggccacagggatgtccaattaggtgtggtgaggtcggggctgctgtgaatgcccctctgtgtgtctcggaaggtgcctggaggccccaaggttcacagtctatttctgtgccaagagccgttggctcacaccccttgtcaaccaacaattagtaaaacctggacaagtcttccctgctctggaagtgcccccagcccgttcaatgacctcagtgcaccccgtgccagccccactggcgtgggcatcccaatgaagcagcgtcagttttcctggagacacgcaaacgggtaaaaacttaacacatttgggcagagatctttgggataagtctagaaaattgcagccagctccatccttcaggaatcgatccccgctctgacaccatcagatgcaacctcgtccccgctaccccagctctccttgctctcccctctgagaccctccccacttactaacttgaggcagagggcagggtctcacgtggacttgtgcaggcactggcagggaaagcaacagagccttagctgagcccaagatgaccaaggagaaacagccgttcacctgttgcacagcctgctgggatgcctgcctctgcctgtgatgcccaggctgatctccaggcagcccagtgtctctccagccctgccagacaggacgtcgggtgcccttggcaggacacttgccaatgaagacagccatggttccaatcagggccctcgctacagctcccctcccagaggcacctgccctctctggttgcttagaatattctagaaggggcaggggtcctggcgctcctctgtcctccacatcctctgagtgttctgagcatcytgggctgctttggtgttttctactcccctgctgccctctggtcctgccmccccgmgctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccgctcagacagcttttcagccaaggcagacctcacccagggaccctccacccaggcagcgtggaagtgccagggcccacagacagcacccccccgccccccgccggcctcctcaccccctccgaaggagactccaggcctgctgtgcactcctgtggcatcggggggcggggggcaagcatcacagtcatagggagtgtgaggcgcccagaatgggggctccacagtcaggcctgcaccccggctgcaggataccagatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtracaaaggctcagaccctccaactaccaggctgtgttgtgacgaggctgctggagccccaggcaccatgacgggaatgggtgaatccacccacagtgggtgactctcaatgtgatactagcccggtacacttagacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcasgtacacctctctccatctcaccgcctcaccataggaggtgaggcctattcctatccgcacaatctgacagggaaattgagactcagagaggttaagtaacttgcctaaggccacatagctcgtaatcagggcagcagggattccrggccragcaggcaggcccctgatccaggctcctagcctgctgcccagggaggtcagagctggaaaccacytccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccgtcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagtcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcacccsgtcctctcccgcactgcagcccagcgctgtctaactgagmgacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccacatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgcaatttgggttttttaagtcgcctttttagagcttcctgtgtcctcccttccctggtcataactgtctgacagcagccacacaaacaagcttattaaaattgtggtttttttggccgggcgcggtggctcacgcctgtaatcccagcactttgggaggctgaggtggctggatcacctcacgacaggagttcgagaccagcctgaccaacgtggtgaaacctcgtctctactaaatacaaaaaattagccaggtgtggtggtatatgcctgtaatcccagctactcaggaggctgaggcaggagaatcacttgaacccaggaggcggaggttgcrgtgagccaagatcgcaccactgtactctagcctaggcaacagagcaagactccatttcaaaaaaaaaaaaaatgtgttttttaataaagtaagtagagtccgaggtggtggtgggctcttccacaggaccactgcctgagctttcacacctgaccttatcaattcaaagctgtgggcatccccggatacagataacccttgggggaggtggaaaattgttgctagactctagcctagaggtttttaacagcttgcacaactggccaaatcttacaagataaaaaaaggtaatgggaacacatctaaaacttatatgtgggtccctaaatccaactatgcaagtacagaggtgggtgtgtggagcagcacaggggacaaaagacgctgggccaccagaagggccaacgtgactgtcccctgagtgaacagaaacgcctctaacatgcgagcgaatggtgcagcccagccggcccgacctcacctggccatgctaggaggcagtgggcaagcggcaacgctgtggtgcccaggacgccggcaggcacagcgccacgtccacgggcaccgccygttcccaccctgcaggacgccacagcatcagacgagacggcccgtgtgaagcgccgagaacagagtctggcttccgggarggctcaggaaatgccgagagctcggcagagacacccacgtrgtgctggattccacgcacgaggaaccgacgggcagacgtggagctaaatgatggtcaacagctacgaagtgcctgtgctctagaaayggccaatttgatcatgtcacgggataaagtttcaaaatcaataaaaccgtgatgaaatgatcaggaataaacctgtccagaactgttcaagacctaaaggagatgcacgggctgaagaacaaggagcraatctgaacgagggagaggtgtgtcttcctggacagttctcgggagaggaggagggcggtaaggacggggagaagaggccgcaggcttggagtccaggaggagaatgaactcctttggtcaggaggggcccactgaccaaaggtcctaggaagaaaagccaaaggaggtgaggtggggcaagggtgtttgcaaaggatagaaaagtctagaatggcagagtatggtgcttaagagtactatgtgacctaggccaagckacttcactctgggtgcctcagtttgctctttaggatggggatgataacaacagcagcacccatctacagagatgccagtgcttgtcaccacgagaagcacctgaaatgcttggggaagaggggtggtacttactgtgtgtgtctccagatgactgagctagaccacccagaacacattacagggaggcagaagctgacaygagggcaggaagcactgtctccagggctgtcttgaaatcaytgggctgactttgtaggtagtgagacgcccatcactggaggcatccgaaccaagcccagataaaacaaacatcagaaacatttttaactccgtttctctgagttctagcctctaaaaataccctccatgacacgctgtgtgctgccagaggcttggttttcgccctcttctccccaactcttagccacgtcccagtggyggcgggggracgggggtcccaagccactgcactgggttttggtttcactatgttgcccaggctggagtgcagtggtgcgatctcagcttactgcaacctccaccttccgggttcaagcaattctcctgtctcagccttcccaagtagctgggactacaggcgcacgccaccacacccagctaatttttgtatttttagtagagacggggattcaccatattggtcagactggttacaaactcctgacctcaggtgatccacycgcctcggcctcccaaagtgctgggattccaggcatgagccaccatgcccagcctgcactgggttttggactggctgtgttagcatcacctggggcaggggtgggtcacgttagaatgagtcctggctaggcccacagcaggcttttccacccgaatactggggccacagctcatgaatctgtgtgtatccatatccygggctgggtcagctctccagggtggagatggttgggcaggcagcctctgggggcaagctcgggctcaggcctccccttgaccagcttcacagagacagacactgaggcagactgacctccaaactcccagctgagacgccagctccccacgtggggggcttacagctgatgcaaccggtggctcactaaacatacctcgacagcgtccattaccgcttccctgcaaacctcaagatcctaagcacccagcctaggtcaggggtccccaatcccagcaggtgttcctgcttcctgaagaccccccagcccaactcctccaayaaccatattcatctccaacccagtcccaccagcttccctcactctccttcccatcacactgcctgtggggagccccgtggtgcagggactttgccgctggccttgcgaacmcacggcttggagcccctccttggcccactctccggggccctcttgggagcctcgctaaacagctgggcatggaaagaaccccaccctcaccacagatgggaacagacacagagagcctcagccccgcagtggtctcaggggcccactgaccaaaggtggccggaatcgcttccccrcctccacctgcagcccggcctctgccctggctggctactcatagcaggctgttgccatgggaacagcagagctgttgagctgtgacatcatggcaggggtgaggtcagggacagctgtgagccagccagggggcaagcgtgtaggttaggggatcaatcataaagatttggctcaagcagccgggagccatgggggcacctgaaggcactgtttaaggaggtgtgggtgaacaaggacagtgcaatgtacaaatgctcgtggccataccaggcagaggacatctttttgtccccagctggctgcatggagacctcccagggtgtcattctctctgagctgtcaggccattaaggaggtacacttcaaggtcagggttcctgacaacgcttgccatcccttctcctgtagggacagcatctgttcacgcttctaaacagctccagaaagccatcgttaaactgaaacccactggaggcgggggaagaaagaatcccgtcaaccacctgcccacacaggaggagaagccacacgtacttggcctcgtttgagggctagttccccacagacagtttgatcagaaggatgggcgagggaagctggcagggcgaggctggggatgaacatgggacactgggggagtctggccggtgcagggggtttccaggaagcaggagtagctgctggaaatgggggcccctgacctagtctgggtggttggcatcttaaggtctgtggtaaagtgatgactggcattgtcaagatatgttttttgtttgttttttagacagtcttgctctgttgcccaggctggagtacggtggcgcaatctcggctcactgcaacctctgcctcccgggttcagggattctagtgcctcagctttctgagtagctgggactacaggtgcatgccaccatgcccagctaatttatgtgtgtgtgtgtgtgtgttttagcagagacggggttttaccatgttggctaggcgggtcttgaactcctgacctcaagcgattcccctgcctcgacctcccaaagtgctaggattataggcacgagccaccgcccccagcccaagatatgttttagtaagccgccagttggatcatctgtaagcaactcactagaagcttccagcatcctccacaaatttgacaactgagaaatgtggctgggaaatcatgatttgggtccgaagaagtgaaagcaacaatcctcaggktgttgtttcttgagagaagaaggtaaacagcaggaattcggctgaggtgtccaaatctcggggaggatgaattctcaggagagctgaacctgagacaaagccctttgtcctgggctggaaggaccctggaaaggttatctggtccctgactcagggaagggaggcattctccctgcaggaatgttctcgatcacagtccaccaccacccccctacccccgcccacttttggagtccatcttcgcagcccttgatgattcattttatgtcagcttgacgggctaagggatgctcagatagctgggaaaacgtgatttctgggtggctctgggaagagactggcatctgaaccgggggactgagtaagaagatccctcctcgccaggtggggcaccatcactcaatctgttgaaagcccggacagaacaaagagacagaggcagaggcaggcaaaccctccctctgcaagagctgggacatccaggctgggcgcggtggctcacgcctgtaatcccagcactttgggaggccgaggcaggtggatcacctgagctcaagagtttgagaccaggccaacatggtgaaaccccatctctactaaaaatacaaaaatgacccgggcgtggtggygcacacctacagtcccagctactcaggaggctaaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtggccaccccgcttctcaggctttgagactcaggctgcattactgcaccagtgaccctgctgctccagctcacagacagcagattccaggacctcccagccttcatacttgcatgagtcaattcccacataaatcccatcttacrcagctggatggagcctattggttctgtttctctgggaaaccctaatacggacccatagatacaaaatcttctatatgcttcttcctcggagaagatccctacatcttttatcctctcagcgtggccttgacgcccattctaaagcaaggggagaggttctagtgaggmggaaatagcatggggaccaacaggatggcacgctaggccttcgatggcccttgcagaatgtccagcacgactgccaagtgctcgtcaggtcttttctggactgaggacatctctctcaagcctgggctctcctgacgctgccttggcaagctctagaaggcagccccatcctctggattaatccgccctgctaaatgttctctctggcatgggattcactactggcctaaggccaactcagccttgagagtctgggtccatactattgttgactgcaattagaaccacatattagcaaatgctagcttttaaaaattacaggtacaggcagacctcagacatactgcgggttcagttcccacagaatcataataaggtgaatattgaaataaagtgagtcacatgactcttttggtttcccaaaccaatatatattcccaaatataaacgttatgtttacattgtacagtagcccagtaagtgtgcaataacattatgtcttatcaatgcacataccttaatttacaaatactttattggccggggcaagtgggctcacgcctgtcatcccagcactttaagaagccaaggcaggtagatggcttgannnnnnnnnnnnnnnnnnnnaccccaggagtttcagaccagccaggcaacacagtgagatcctacctctataaaaaactaaaaatagccaggcatagtggtgcgtacctgcagtcccagctactcaggaggctgaggcaggaggatggcttaagcccagaagttcgaggctgcagtgagctaagatcatgccactgcactccagcctgagtgacagagcaaggtcctgcctcaaaaaaaagaaaaacccaaaacttgaagaaataaaaataaaaataaaaatattttattgcttgaaaatgctaacaatcatctcgacctagtgagtccagtctttttgctggtggagggtcttgcctccatgttgatggctgctgactgatcagggtggtggttgctgaagattggggttggctgtggcaatttcttttttttccttttcttttttatttttattattttttttgagacagagtctcgctctgttgcccaggctggagtacagtggtgcgatctcggctcactgcaacctccatctcccgggttcacgcgattcttgtgcctcagcctcccgagtagctgggattacaggcctgcgccaccacacctggctaatttttgtatttttggtagagacggggttttaccatgttggccaggctggtcttgaactcctgacctcaggtgatccccccgcctcagcctcccaaagtgctgggattacaggcgtgagccaccgtgtctggccggcaggcccactttcttattatttgtgtgatcacctggagtagcattttttaatttccttcacattcacaacttggctgtttggcacaaaaggcctagctgtcagcctaccttggctttcaacacgccttcctcactaagcttaatcactcctagcttttgatttaaagtaagagacgtctcgctctgtctgtcaagcttgaatgcaatggtgtgatctcggctcactgcagcctagaactctcaggctcaagtgatcctcccgcctcagcctcctgagtagctaggactacaggcatgtgccaccacacccagctaagttctttaattttttgtggagatggggtcttgtcgtgttgcccaggctggtctcgaactcctggcctcaaggtgatcctcccgcctcagcctcccaaagtgctggaattacaggcatgagtccccacgcccagtcccattatagggtaattaattggcctaatttcaatattgttgtgtctcaggaaagagggaggcctaggcagagagagagagaccagaagccgccagtcggccagttggtggagtcgtctgaacacagacaacatggatcaattaactttgccatctcatgtgggcacagttcatggtgccccaaaacaattacaacagtaacgccaaagaccactgatcacagatcaccataacaggtatgataataatgaaaaagtttgaaatattgcaagaattattaaaatgggacacaaacacatgaagtgaacacgtgatgtgagaaaaaaatggcaccgatagactcagagttgagccagccgtgatattcaattcatgaaaacgcagtatctgcagagcacaatatagcgaagtccagtaaaacaggtgcacccatggaattcatgttcattctagagcaactggaaaatacacccttgccaaagaaagtctaatgtcccctcatgtgtccaaacgttctggccaggtgtggtggctcacgtctgtagtcccggcactctgggaggccgaggtgggaggatcacttgagctcaggagtttgagaccggcctgaacaacatggcgaaaccccatctgtactaaaaatacaaaaacttagctgggcatagtggtgtgtgtctgtggtcccagctacttgggaggctgaggtgggaggattgcttcagcccagggagcagaggttgcagcgagtggagatcgcaccactgcactccagcctgggtgacaaagcgagacactgtctcaaaaacaaaaaagaaaagaaaaagctataccatgtgatgtctgcagagcatctgatgctgtgatttatttaaccacgcccctgctactgtatatataggtgtttctaacgtttccgtaagataagcaagacggagatgaatatccttcagctaaatacttccatgtgtcctaaattatttctctcagaaaaactccaagatatagggctgcctgatcaaagggaagacttatttttaaagtccttgatcactgctgccaaaatgcccttccatgcctctaaactactcaaattaaggcaaaatatacctgtcaccaaggccttctgaggacaacatgcctcttggccaaaaggagcaaagtgatgttaaatccaaagctgtgaaatctaatcttcttcccagagactcgagccaggatcattccccttggattcctggcactgccactctgtgggtgaccttgggcaagtcatcggctgctccccatccaaacacctgcctcacctcccccgcagagcctttgtaaataaggaagatgtgaagtcctttgtgctgaaaagccctcgacagtatttttatgcatttgcctggttgttttatccctgctttccagaactagtgcacagaagggaagaccaccacagactgttcctttattccctgccctggrgccaactgggccaagtggacaagacctcacaagggagagtcaggccagcaatgctcatcccagctccaccctgaccccattcctcttggcatactcagtttctgcctgggctgggcaggctggtccttggcttctggggtcagctcaggattgaggatgaaatgagaggagcacccccagaagagaaagtgctgaaccagaagcccaggagagtcatgtgtgtgcgtgtccatctaagcctttgccccaaaacagtaggtagrtcaggtgcagtggctcatgcctgaaatcttagcactttgggaggctgagatgagaggatcacttgaacccaggagttcgagaccagactgggcaacatagcgagatctggtttctaaacacaaaagtaattttaaaaattagccaagcgtggtggcacacacctgcaatcccagctactcgggaggctgaagtgggaggactgcttgagcccaggtggttaaagctacagtgagctaggatcacgccactgcactccagcctgggcgacagagcaagaccctcatctctttaaaaaaaaaaaagataaatcaaggagcccacgtgtccccagagctctcctgccacagtgtcagcacatgccttctgagcataataatccccccggacctgaagcccacgaatgacccccccacccagtcctttctccctcatgtcacgtcaagtgctgtgtcactgaagcacccygtaccccatcacctggtgccagaggcctggccatggtgcagctggacccccagctgccgtgtgaccgtgggcaaacggattatgtcaccttcccagtgttagagagacccagtggtgacaaacgtcctctgtacctagggtcaccgtaaggctcgggtctcatcgggtttctgtacatgctctagacgtgcagcgtcatgctaccgacactccaagtagccggccttgctggcactcctggctttctcccttattccaccccccgccccccacaacattacgggacccaggccgggcactgtgacccaggcagtgtggattctcaactagctggagcaaacagggaactagggcacagaaaaggcagagtcacacaaccggaggcggagtgtccgtctagtactgggacccggtgtgatgctttaaggaacacacctgccgtccttatgtgagctgggctgggcctttmtttttaatggacacataattgtaatatttatggcatatatagtgatgtttagatacatacaatgtatagtgatcagatcagggtaattagcacagccatcatctcaagcatttctttctttgtggtaggaacattcaatgtcctccgagctatctgaaactatacaatatacttttgttaatttctttttcttttttttttttttgagacacggagtctcgctctgtagcccaggctagagtgtggtggcgtgatctcggctcgctgcaacctccacctccygggttcaagcgattctcctgcctcagcctcctgagtaactgggatcacaggtacacaccaccaggcctggctaatttttatatttttagtagagacaaggtttcaccattttggccaggctggtctcaaactcctggcctcaggtgatccgcccaccttggcctcccaaagtgttgggattaaaggtgtgggccaccgcctggcctattgttaattacattaatccaacagtgacacggaacattataactcattcctcctatctagctgtaattttgtatcctttaacaaatctctccctctctcctcccccaacccttcccagactctagtattctctgttctacttttgacttcgatgagatcaacttttcttttttttagctttcccatatgagtgagaacatgccatgtttaactttctgttcctggcttatttcacttaacgtcttccagttccattcatgttgctgcaaatgacaagatttcattctgttttatggctgagtagtatttcattgtgtagatgtaccaacatccacaatgaaatactatttcattctttagccattcatctgttgttggacactgaggttgattccatatcttggctattgtgaacagtgctgccaggaccatgggggtgcaggtgtctctctgatgcactgattccctttcctttggataaatgcccagtcgtgggactgctggatcatatggccgttctatttgtagttttttgaggaacctccaccatagtgactgtactactttccattcccacccaccgcatatacgagttcccttttctccccttccttgcctgagctgggcctttctgatcatctgtccccgtcccttgaactcttgatctggactgagggaagaatggtggcagaggcgagctggggagcagggaggaaccaggctgtcgcaggagaaacagaatattgcgagccagccgtgtggaatggaaaggggaagcyggtcttcctgccccacactcctgcctttcttccttaagggctccttggacagagactgcaggtttctcagaagcactgtccaggatctcaacattctagaagggtctaggacaaactaactaactattgagcccctccagtgcttttgttgtttttgttttttgttttttgttttttgagacagagtctcactctgtcacccacgctggagtgcagtggcgtgatctcagctcactgcaacctccgcctgggttcaagtgattctcctgcctcagcctcccgagtagctgggattacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggccaacatggtgaaaccctatctctactaaaaaccccccaaaaaaaaaaaaaaaaaaaattgaactgggcatggtggcacacgcctgaaatcccagctactggggaggctgaggcaggagaattgcttgaagccgggagacagaggatgcagtgagccaagattgtgccactgcactccagcctggacaacagagtgagactctgtctcaaaaaaaaaatatgaatctcccatggcaccacactgaagagtctgatcttgcttttacagaagaggaaaccgaggctcagagaggcaracagtcgggattcagaaccagtcccacttgactccaaagcccaggctcttttctccaatacttttcatgtcgcctcttttctctgaaatgtccatttcctcattctgtccttggttaagcagcagctgttggcgggtgctctgtccaggcctccgctaccatgacgagccttggcaaagcctgccccactgccagtttgctttgccacgtctgtgtcaggaaagctcaatcaatctctcccgattacagatcagaaagggccaaataaactctcaacccaagccagattctgtccctgaagatgcagtaagggggtctcggtacccacagaacatcccaccacagaaagccaggctccagcctgaaagtccatcttccctgctctagcccacccgtgcgatgaagagcacagaagaggcgggtgaaggcattgcatcttcagcatcggcttggagaatgacaccctgcaggttccacttcttcccaggccacctgcttgcttctggaaagcagggaacaggcaatccggggagagaggagccagccacacaaggactgggaagcccagacctgtgccatcagcctgcgatgacttaggctggggatccgaaaaggtttctatgaacagccagctggtaagtaatttagactttgaggcccatacagtccttgatcaccgccattcaactctgttgttatagcacaaaagccacgtgggtttggccttaccagtgggcgtggctgtgttccaataaaactttatttgcactaggccaggcaccgtggcacaagcctgtaatcccagtactttgggaggccgaggcgggcagatcacctgaggttgggagttccagaccagcctggccaacatagtgaaaccctgtctctactaaaaatacaaaaattagccgggtgtggtggcaaaaagaaaaaaaaatatttacaacaacaggccatmagcccagcagtgggtctagtttgccaaccgctggaaaaagccarcaacattttgggaggccgactgccggctacaggacctcgccataccaacaagggctgagacccgcggctctgcagggctctaacaacagcgtttgacctgagtctatctggggaaacatcacgtgaacccacgttgaggccctactctggaagctgcaaaattagagatgatggctgtgcggctctgtgaatgtactcaaaccgctgaactgtgcactttagaggagtgacctcatggtatgtgaattacatctcaataaagcagctcaaaagcaggctgggtgcagtggttcacgcttgtaatcccagtgctttgggaggccgaggtgggaagacggcttgagcccaggcgttcaagaccagactgggcaacgtggcaaaacctcgtctcgacaaaaaatgtaaaaattagctgggtgtgctggtatggtcccatagttccagctacttgagaagctgaggtaggaggactgcttaagcccaggaggctgaggctgcagtgagccatgatcatgccactttactccagcctgggtgacagagcaagaacctgtttcagaaaaacaacaacaaaaaaaaacaaaaaacataggccgggcacagtggctcacacctgtaatcccagctactctggaggctgaggcaggagaattgcttaaacccaggaggcggaggttgcagcgaaccaagattgcaccactgcactccagcctgggccacggagcgaaactctgtctcgggggaaaaaaaaaaaaaaaaaaaaaattctaggcaatggatacaatcaggatgatttttcttgctttttgcttaagtgtcttttccatgattaacacatatagttgtgtaattattttaaagttagaaggcatttgggacgtgaatggagagacagagaagttttctttatgatggagagaggcggaagggacggcttcctctgcgagggtgcaagggctgacctgggagagcaggcagctgcgactaacgctggctggggcctgcctgacttccccttgagtccttagaggcacaggttataacccaatgttttattgcttcttgagaacattattggcattcatctgccttcgaaattttggctattcatttatttatttatttatttacttatttatttatttgagatggagtctcgctctgtctcccaggctggatggagtacggtggcccgatctcggctcactgcaacctccacctcctgggttcaagtgattctcctgcctcagcctcttgaatagctgggattacaggcacccgccaccatgcccggctaatttttgtatttttagtagagatggggtttcatgatgttggccaggctggtctcgaactcctgacctcaggtgatccacccaccttggcctcccaaagcactgggattacagggatgagctactgcacccagccaagctgttttttttttctttatagacagagtcttgctctgtcccccaggctggtacaaccatagctcactgcagcctcaaactcctgggctccagtgatcctctcacttcagcctcccgagtaggtgggactacaggcacgtgccaccacccctggctaatttttaaaattttaatttattttatgtagagatgaggtcttgctatgttgcctaggctgatctggaactcctgggctcaagtgatcctcccgcctcagcctcccaaagtgctgggattacaggtgtaagccaccgcgcctggccagtctgggctttttcttttttttttttttgagacggagtcttgctctgttgcccaggctggcatgcagtggcacgatctcggctcactgcaacctccgcctcccgggttcaagtgattctcctgcctcagcctactgagtagctgggattacaggtgcccgccaccacgcccagctaatttttgtatttttagtagagatggggtttcatgatgttggccaggctggtctcaaactcctgacctcaggtgatccacccacctcagcctcccaaagtgctgggattacaggcgtgagtcactgcaaccggcccagtctgggcttttgaaagtactgtgctctgaacatttttctaggtcataaacacaaatctgtaatatcatttgaaatgtctgctcactctgttgcggcagggagaaagattaattgatttagcttatctccagcagacaggcaaacctcatgaacaaggccagcctcaggagctcctctccctcctcagtggctccatccgtcacctgtagagcttcagcccagctccacagcctagaccattcatccccaagccaatatcagtctgaatcagcaccattctgttgatgtacctccttttaaaagccgtctctctctctttttttcttcttttttttttgagacagagtctcactctgtcacccaggcaggagtgcagtggtgcgatgtcggctcactgcaacctctgcttcccaggttcaagcgattctcatgcctcagcctcccgagtagctgggattacaggcgtgcaccaccacgcccagctaatttttttatttttagtagacatggagtttcaccatgttggcaaggctggtcttgaactcccgacctcaggcgatccacatgcctcggcctccccaagtgctgggattccaggcatgattccaccgtgcccggcctaaaaaccatctcttcttttactctgctatttcctagccagctaaccctgagcaggttccttagtgggcctgtgcctccgttggatcgtctgtacaatggggatgaggatagggaaggaaatgggttgacactagtgaagagcaagaacatacctccaagcccttggcacctctgccagctgttattgttgccatagtcattatcaccatgtcatgattcacctccctggctgctcccaggcctccctcagggcggggtggggaggaacaagaacacaaagacagggagagccagggtttgatgcagaaagagctggtgtcccccactagctccgagagcttcctgggaggcaggaaattcgcctctcctttttggaggtgtggaagtgggggcagagagaggccacctgtcccggatcgctctgctggactcaatctggggccagcatttgacccccgctcaccctgtttgctatgaatgtcagttcccctcgctactgctggctcccttccccctcaacgctccgtttcctgttccctccaaggccccgttacacaatttccactgtctgctgaagttctagctcaaatccctctcgccgagactttctggtcaccagattccagcagaactcaacagagacctctacccgcctgagctcctgaccaggttagagggcatctggctcccaggcactgggtcaagctccagaggcatctcctgtgtctgcccgcgacccatggccccgctcagggcctgccttccatctcctgggtcttccccagtgcaggtgggagctctgctcccctggtaactgcgagcctctcaacaccaccttcctcctcagtgtcatccccctcctgtctgccccctctcccccagtgcaggggccataaagccttccccggagtcccactgccaggtcccactgccgggcctccaggctttgctgctccacctgggctcaagcctggccatactttgttctaatgactctgtccccctgtggtacactctctaccacagccaccctgggctccccatacccaccccaggacctttcctcggggcttatcttagctctgataagatccacccctcagggcccacaatctcaacagtgtcctaacctcggtaagagtctctagcaagaggtgcagcctgcaagatgatcttcgcattcctgcgctcacttccttgaagatgggcaccatggctttggagtttgagaccagcctggccgacagggtgaaaccccgtctctactaaaaatacaaaaaattagccgggcgtagtggygggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaatacaaaaattagctgggcatggcascacacacctgtaatcccagctactcgggaggctgaggcaggagaattgcttgaacccgggaggcggaggttgcagtgagccaagatcgcaccactgcattccagcctgggcgacagagcaaaactccgtctcagaaaactaaataattccttgacacacttgccatagtatttctgtgtacggtaggcacccaaattctattgtaaaacaaaatataaaaacacttaagtgaataaattctgtaagaagcaggtatctaagacatagacaccaggcccttcctaactggtgaggtctggagttccctcaggccatgtgtggtccagctgtgatcagagtttgagatcaaagagcagctgccgtctaccaaggacgtcttccccatggaagacaaccacagaacctcccaggtctttggagccatccctgagaccagctaggaggccaaaggacactgatggcaccctttccccagagctggttacaggtctgcctcggactcccctcgtggtggtagtgtctgagcggatcctggctgcccagggcggccgagtgcagaatgagggtggaagaggagagaaaggcaagatcgttaccatcgctcagctccgagactaggcagatactcacaagaaacagaagactcgaaacctataaaaagactccttttaaatggcagtgacttgacgtttggagggccacaggcacctttgagaagttggcggctgccactgtccacaaaaaaaacacgtacgcgtgcacacacacacacacacgcgcacacacacactcacacacacacacacacacacacaacttcacttacagtttccgggcttgtgaccacccccaaacccgccaggcctatctctggctgggtgttcacacactctgggttaggacccctcttttataaagactgttcctcaatttgcttcttagcgtaaacacactctcaacctgacttgctggggctccggaagctttccctgggctccagtctgacctggctgactggggagtagctcagccctcagttgtaaggtgggaatcatcggggcggggtctctgtgcccttccctctgccgctgcacagccacgtcccagcaaatgcacgagggcaccagggcgtcagggcacaggctgcaggggtccaggcaggtgggccctgggaggtcctggggacaccagcttcatcctgcctgccactctgagacatccatgctcctgaccatctctccattgggaagtctgggtctgcccgccttccctcctcccagcaatctcagggcagctcatctgcctgcttactccaccccccgacactgaggtggtcagcctccacactttctgttcagacccacgggcaacaaaaacaaaaccttggccaagcactcacaatatcagatattcattaaaaaagtatatataggccgggcaccgtggctcacacctgtaatcccagcactttgggaggccaaggtgggcagatcacttgagctcaggagttcgagaccagcctgggcaacatggcgaaaccccatctctacaaaaaattaaaaaaattagctgggcgtggtggctgcttgggagactgaggtgggagaatcgcttgggccaggaaattgaagctgcagtgatctgtgattgcaccactgcactccagcctgggtgacacagcaagactccgtctcaaaamaaaaaaaaaattatatttggagtacaactctgaatccatatgctaactattcataacattcttagcaccgaggctgtactgggcacccctccggagacgactggtctatgccaactttggcgggcggcagcagcacctggagagtcctgaaactccagtgccacccccaggcccgctccagcacgcggagttaggcggctgccttctaccaggctccctgggcaacgcccgctgtcattccacagccagaacatctttggtggctgcgtgggtcccgggatggaatgcagatgtcacatgacaagccagagccgtgacatttggccccaatctccttgtgggtccccctgaatccccaggctcctctttggcctactctgtacccagaactctcacctttcctggggcagttggtcccttggcttagaacacctgtgcacaccccaccctgctgccgctaaatgaccaggggttacggtccccagtgccgtcctccagatgcggcttcttcaccctcccttaccttgatttcttcactctgccctcccctcttgaaaaagaccatctgctgggtgcggtggctcaagcctgtaatctcaacactttgggaggccgaggtgggcggatcacgaggtcaggagmtcgagaccatcccggctaacacggtgaaaccccgtctctaataaaaattcaaaaaaattagccgggcatggtggcgggcgcctgtagtcccagctactcgggaggctgaggcaggagaatggcgtgaacccgggaggcggagcttgcagtgagccaagatagcgccactgcactccagcctggagacagagtgagactccrtctcgaaaaaaaagaaaaagaaaagaagaccatcctagccatgcagccacttgccctccgtccctggtttgtgagcctgtgcgtgcaccgggggacagagagagtgtccagggcatgcacccctcctgcccctgccactgccacgtctgcctgtctttgcttccttcttatctcctcctccctgctgttgcatccctcctcgcagctgcctgggaagcctcgygcagacctctttgttgtttccgaacccaagacgttcacccctacacacgacccccactgcatcgagtcagtggttctgcatcaggactggagacggctgcccgcgcctctcagtctcccaggagtcatctatgccctgttctccatgtgctcagatgtcgccacagagtctgaacctctcagcccacaccagtggcatctacctagcaacctggctgcgacagcagggaggagggaggcagtacccaagcccacctgcagctcacaaacgacaggccaggactgcgtacgtggctctgcacccccagaagggtgcaaataggggaggcccgagaggctccgaggctggcactgtcctcagatcccagatagggagaaacgtgtgttgtccagagagctccttccagcacctgccatacctccaggctgtgcacagctctccctgctcttccagtccccctgccttgggagctgccagtaattcaggggtcagtgactcccctgacagatcctgtccctccaaggacgctgttcaaaaccaagccgaagagcctcagttctccccacagctccctcctcaacctaccatggggccttctatcctcacatcttgcaaatgcatttcacattgtcacatgattactcctgaattttggttatttcgaaagtttatctgttgttaattatttaccgaaaccacactgagtggactgactttataccacacctgggcagttgaggaggggaggcctgctcaccacgccgggcagcaggaacccccttccacaccgcctggtgccaagatgtaccaccccctgcatcccccaccacagggacaatgtcttgcttctcccttacatccccgggggcagaggcagccactccataattgcttgttgaaacacagacaagcccaatatgaaaatcaagatgaacaaaactgacaatacagatcgatcacatacttcgcacaacgagtcgccaacagtttctttaaaaagcgccacgccgccccctcgcatggaaggcctgacccagctcacatgaatctgatgctgtgttgcttttcctgagcacgtgtcctgaagacagagccatttttgactgcgtgc

SEQ ID NO: 18016 - DNA, 40000 bp, Homo sapiens
ttaagcctgggaggtggaggatgcagtgagccgtgatcatgccactgcactccagcctggtagacagagccagaccttgtctcaaaaaacaaacaaacaaacaaacaaacaaacaaacaaagaatgatgatgacacatggagccactatataaacgtttgctcttcttattagtggttaaaatgtctgaagtcaagtataggtttaaatccttgttttaccacatactggctatatgaccctgggcaagtatttaatctctctattaaaaaggtaacggttgcaccaactttctgtggttttcagaagattaaatgagacaaagtccataaattgcctagcatgctgcctgatcttaggcagcaaatggtggtgatgacaattagatgacagcaggtcagttctggaatgggaggccctcacccagctcctacagtgaacggtacagcctgggctgctgctgcttgccaagccccaggtctttcaggtgtagcctcccctgggggtccacaattaccagctgaatctactctgtttccaggacctttgacttatgatggctcagctgggcctgaagagcttttgagcataacttattgtatggtttgagtgtttagaaagatgagcatctactctatgcctgatcagtgatgagtcttgaaccccacccttctccaacttcccttggcagcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatggtaagcacagcctgcagcacatggaaagagcgtctctgctttgaacagagccaacttcggagccagctggcaaactgctgacaagcacacatgctcagaaaggcaggcaagatgaggggaaaagacattgctgactcacaagtgccaaattttaacaggcatttggggacactgacaataggaggaaaagatgttttataaaatatattaaaagtgagcatagcttggtgagtaagaacatgggcactggagtcagactgattagcctggctatgatttctctgtgactgtgtatgccaccatctctaagcctcaagttcttaatgtgcgaatgaggataatcattagacttatttaagagttcagtgagagttcctaaaggacgtgaggcagtgcctggcacatagcaattgttcagtaaatattaacttctgatgattgtggcttttattaggtagaatcctgaggcagggaaggacctkagttctggtcctggctttttcactgactcactgtgggatcttgggcaagtcagatgacttctgttttaattttcttcatgttagatgaagaggtggcccatctgagccctggggctctacctagctctgagacttggttggaaaacattgactaggagcataaaatgaactggatctttgtcctggaggactacacagtcctgtaggagaggagtcatttgtttcttcctgagcttatttgttcacctagccaacaaatatttaatgagcatctactatgtcaggcattggcctaagtgctggaaacaacatggttagtgacagaaacacaaaatatatatattgttatagctgctataacagcccaaagccctatgtgagcatggaagcagcagcagcagttaattttacatgagcttttagaaggaatagagcaaagtcttgagagatgtgggtcttgaaataacatatacattttgagcataaatgggggagaaggacattcagaaagagggaaggacataagtcaaaggatgaagtaccccggtgtacgtgtggactgacgaatggtcttatttggtcagtgggttgggtgtgtggggcttggcagtgagagaggagactagaagggaatggggttcagctgtgaagagccttcagggccaagctctggaggatagacttaatcttagaggaagccactgaaggattttaggatgacaagtgccaaaattgtttgggaagacaatattctatggctttcctaaaaagtaacaaaagcacggatcatcatctttgtcctacagwtgcctgaaataatgtcaaacaaacacccaagacaaggagttttagtatctcttggggtggacccaaatgcctcccacatggctctgctgagagagacagagagcctcatctacccaaaagcaaccaactggcaacctctcctatctggaatcaggaagaaagcaaaaagacactgagacttcaaaataaatatggctgttctcaactctgcctttgtgacacatgaaaatgtcttgattttttttaaaatgaaaaagagttgtagctccaactggggaaaattacgcataatgcagtgtatgcccacgagagtgagtcttgcatgtgtcacagtagagaatagttggaaactgctattttccccacagagaagctcccaaggccttcactcagagttttttttttttcaaacatatatttccaaaaagtttgatatcttcttttcaaacccagaaggatagaaatcacatttagaaggtgcacatgaggctgctacagacgggccctctgagcgctggacaacggtgagaactgtagctggggctaacacacattgagcattgctgactgccaggtacatgctgaagtgacttttacatggtgctttcctcacaatcactccataaagtagacttgattatttcctgattttatagatgaggccattcaggcttagagatttaaggaactgacctaaggtcccagcatggcaaggttgcaaagcaaggtttgaaccaggactgtgggactccagagcctggattcttacctgtaactttcctgcgtttctaatgagttggagcaagtaaggaaacacagtagttcttaaaagcagaagaaatattttttttaaacgatagcagtcgggaagcatttggtggagtggcaaacagctgtctagttttctattacaccagaacgcagcacagcaaccgacattcttaatggtaagtcccatcaacaaaaagaggagagatactgccgcagaggaattcaagatgaaaagaaaatgtattctcatattttatattcactaaaataaaagaaagacaccacactaatggagtaccaatgctattgtaaacatatcgaattagtaattgtgactattataccattactttccatttgccatcccttaactgagagaaacttttcaagagttcctctcacacaatttcaatgatgttcttataatgtgtttggctttgtcgcacatgatatgcatacaaagaggcattttttctgtgtctggaatttggaaaagattgtgctttgcatatgcttaatttgaatgatgcctataggaagtaagctagacttcaaagggggaagattggcatttggagaagtacagcatgcactgcatttaatgtgtatatcaggacaaaaaatattaatgagagaacacacacagttttcttcctccccgaccagccaaattctccaccctccagccccattcaaataaaggagagaagagtctttcttggtggataagaagcttgattgttttacataatacaagaatagagaaaaaagcgggaggtggggaggtgagagggaaaggagagcctgatgagctcaacaggaagtgagtatagacagagaagagaagaccaaggactaagccctgggaccctcctttggtaataggtcagagagaagaagaaaagcaaagaagcctcagagaagtaaccggtaaggtaggaggaaaaccaaagagcatggtgtcctggaagctcagtgaagaactggatcaaggaggaggagtgaccagccaggtcaaaagctactgatgcatcaaggaggatgaagaccaagaactggccgttgggatttaacaacatgaaggtcattgctggtctcaccaagcagttttggaggagtgatgggggccaaagctgattggactgggtttaagagagaaagaaaggaaaagaattagagacagtgggtgctgacaatttttttaaggatttttgctgcaaaagggagcaggtaagtgagatggaagctggagggagaaatgaggtcaagggagggatttttaaagtcagagacatacagcatttttgcatgctggtgggagagacgaatagagagaaaaatgtatcatgtaggaaagaaagagcagaattactagaacaatgcttttgatttggggagagaagatggacctggcatgctaagtggagggatgagcctggactggatgcacagaggctcgtctgagggaagaggggacggggaagatgggtgcagatgctggtaggtgaagagaggtggtggtgggagtctgtggaagttttcttctgactgtcttctcagtaagcagaatggtaagtgatagcagccacagaaggggcatttctcagaaccttatcaaaaagtgaaagagtgagtttggaagcaactaaatcataagaatgcaaaacatgttctttattccaacagaggactaccaggaactcattgaagacatagttcgagatggccggctctatgcatctgagaaccatcaggaaatacttaaggtgagtgcctggctcaggtggacatggcagttatccacagagcttcccgagtactgttggagaaggcttctcctcctgctccttgttgccacctttcagacacggagcctgtcctgggccaaggtcagttttataccttcaccagacttaatttttaaaaaaatcaggttgctgtctttagtgttgtcaagtgaagttgtatttttcaatttggaaacttgtggaggggcagggagaaatttgcttataaatccaaaccaacagcaaataatgtttttctattaattccaaatagttgaggatccttggctctttatgtatacttcaagcctaaaattcaccaaagtttaaatacttataaataattagcaataaacacttgtggtatcactaatcctacaaatactcccaaatcccagtgttgcattcatctggttgggaaaaaagaaaacaggattttacatattaaagttttatttataaaagtaattcatacttcttaaaactaattaggaaaaataaaaactggaaagaagataaaaatcagaggaaacaatttttgcaagtgtttttcagctaagcaagctacggcctaatactgggtcattatagttccatgggcaaaatgtcagcatatttaaatattttggcccagtaacaaaaattctgttctttttaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatrcaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcamgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataataatgtacatttattgccagccttcctcgttgcaagcttccaccctgcagcaaatgcactatgctgactctcgcaccttcagctgtgccctctgacactctgctggccattgcctgagggactggggagttcaggtgaaatgtaatttcctcagtggatgagaatcatcaattgtcatgaaaaggcgatttcaccaaccctgagtcggtattgccaagggttctactccccaagtgggcttcccatcacaagggatctgaggtccaggtgggtgtggtgaggcccagcctgtcatgtatgccttccttccccagtctcaaatgtgagagacggactctgctccgtggacatgagcagccccttgaagggtggtctcattctctaacagtaacagcactgccagaaacaccccctgaatgccacacgatcatctcactttgggtcaggccagcagggcctcacgatcatttcttgaacttgaattttcagtgttattgaatctttaaacatttaaatccccaagcaaaaatctcattacagtgaataaaaaggaatccaatcaaacaagccaccacttccctaatggatggactacctacaactatagtgttttgttatttcaataacaattctatgcacagccaattctccataccaaagtactaaaaaaatgtttaacaagcatttttgaagaaaacaaagagaacttcattatggttaaacttgcttttcatctcagtgttgctttttttaacctgttaataacattgattcttaaaaagtcctaatcaaacttctttatttggatgggccctaaatattcattttcagatttctcttcaaaagtttgaacatcatcattaaaaaaaaaatagcattaaaacaagcacttggactttgttatactggagcttggcctatatttctgagtctaaccataagatgaaaattcgaatgtcacataaacccgagttagtgaccgcactgatgtgaaggtgagatgagctgagctgcaccattctgtccaggcatgttagcaactttgtgctcatgactgtgtgatcctgtcttgctgatttcacaagaaggctagggatgggaatactctgggggttggaaggaggctgcataaacccggtcactatggaggagcatcctccacggggcagccccatgcaccagagctgtgttgctggtacacgcacaaaccactgacgcacaggaggtataaagaggagcttcctctctattccctcaactaccttaagagatgctgtgatcctgttgggggctggctatctggagatactatttctacctgctacatcaatatttatcaaacttctgcctggtactctaggccctggggatgcggcgataagacagacaaggtccctgccctcatgaagcttacattttagagggaagagacagacaaagaacagataaatcaacatgaaaagtagcagctagtggtaagagctatgttgaaaattaaaataggttactgtaacagatgattgtgtggctactttaggattggggattatagatggcctctatgcggaaattacatttcaattgaaaactaaatggcaagaagaaaccagtcttgggaaaattagggggaagagctttccagagagaggaaaaccaagtgcaaaggctgtcaggcaggagcaaccatttgtgtatattgtagtctagtgagaaggcaggtcgtacaagatgaggctagagaaccagacacggccagatcacatcgggctttggaatctataatgaggggtttgagttatttctaaatatgttgcaaacttttgaatggatttaagcagaggagtgagataatctgatttatgttttaaaagggtagctgtggctactgtgtgaataggaagccagcacggaggcagagagagttattcacagactactgcaacagaacaagcagccatccagttggcagatgaaggtattgtctggattagggtgttgtagtggagatgagagaagtagaaggattctggatgtgttttgggggacagtcaacagaatttgctgatggggattgtatggaagtgctgagggaaagaaggaagtcaaagatgactcctagttgcctaagaaactggtagatggaggagactaggaggagcaggttcgggatatgcagcagttttaaaacatgtttgcaaattctttgaggttccttccatggacagttggggtctgtgtcacctccccttgactctgggctctgtgactgcttgaccaatattaacatggcagaagtaatgctttacgaggcccagggcttaagacactagcagcttccacttcctctccttaggacactcacacttgaaactcagtcaccacgtcatgaggaagcaagccataacagcctgtggagaggccatgtggagaggaaccacagtccctccacccaccggccaggctgagcttccaggcgacagccagcaaaacttgccagctgcgtgagtaagccatcttggaaagggattctccagctgctccagctgacacttcatggagcagtcctcattgaaccacagaaaaattagagatttgtgtgcaaaattaatgattattatcttaaatgattgataggttttgaggtgacttcttatgcagtaatataacagtgaaaaggggagatggttaagagttccattttggccattctaggttctaggtgcctatcatatgtccaactggagggttcaaataggcaaatggttatacaaagccccaggagaggtcagggctggaatataagttttaatgtcacagagtaaaggcatgagactttaccccggttaaggtcacctgggaaacatgtaaataaaagaagaccggggaactcttaattctgggatttcctgtgtgggcacaggaaccaggactttgaggagctgcgtattaagtaaacaggaagaggtcagagctgagcttccatcttccctccaagagagctagttctatgggtgaaccctgaatgggcatggatctgtacagtccttccttctagctgtagatattgttctttagccatttactgaagtgctgcatctatggatttaacaacatctcccttgaatttccaatgctaataaaaaagtgtttgccttttcacactaacagacaattatcttcactttggaaaattgcttcctctgaatcatgccctgagctgttaagtgtgtcgtctgtaggcactcactggatttaggtttgcaggtgatattaaaatgtcatgtggcaacctggaaaaggcagtggctgcacagcacagtgcaaggacttgcttaccctccggcagatctttgcaggaagatgcaccggagctgttgcctgcagctgaccaccacagctggtgggcctatgtgctggaaaacccaggggtcattccaggcccagctgtaatcttcttagccctgaagagatgcctcttactgtcagcatctctgcttcttttcacacagcaggatacgtcttggagccttacccaagtctgcrctacttctagccagcatttgggaggcaaatggactagctgaggctggagtaaagcagttcctcaccaagttgagggaatcttgttgcatacggccctctagctaggcaagccatcagctgcctacaatttaaggtcctgggagtggccagtaggggcccatccacagaaacttagaggccttggtgaggcttcatttctgtgaccatcttccattccaggggcttgtgagcccagctcagaggtgtcctaatatttgtagtgccctgcctccttctcccttcaggcagtctcgatcagcctgcaggagaccacccttagggacctgttaacacagcaaggctgctcctgtgatccatgtcagtgatatagccatgaagatatcactactcagcagggagcactttccagagaacacagtggcatcaaaatagatttagaaaatgaaaccactctaatataggcagtttgccttagttgaataaaagcgatacaaattaaacctacctactgcaagcaatgacagtaactcagtagtgcttggttttcagagtatctcataaaggggatgcaactacagaccttagttactaataatttcttattatgtttttggtcattcattcatttatgcaacatatatttatggagagcctattaagtgctagacattgtaggagccagggatactgcagggagcaaaagaagctccctgctcttgtggaatttaggttccagtctggggagacagacaataaacaaatgaacatatactgtaaagtcaagtagtgatgagtggtataaataaggaagggctaaaggacagagaatgaggaggtggtgggagggagctgctgtcttaggatgagctcatcattagagtcatgaatccaggcccctcctagagcactggctcctcaaaccaagcctggcagcactggccctggcaagctcctttatccgcccagcaagaccttggcatttcatgtcaagccaagctgaccaaagcttcaagctgtgaacaagccatttggcagttcctcgaacaggtgccacctagtggttgcaatatggagtcgacctgtgtttctgtctcccgtcccactgcctcagaccttacatgcccataattcaagacaagatcttacccaaggggccctggggactagggctgtgatttgacaactgattggtcgcatgttgtttgacacagccctcggagtttattttgtttagatattttccttttttctctgcttggcagagaaaaactagtgaccaagtccaaactcattgatctaggtcatttcaaactatcaacaacgctctgaatctcacatacaaacaccgcatattcatgcattcactgttacggtctaggcaccagggtaggctggatatatagtcctgagtcagaagggaaaaggagttgaaggaatgatgaggacaaaatctactcctcaattataatcttgcatgttttaccactttgtagttccaggagctccctaccacactcccctgccttggattgttctctgatcctacacagtatcctaggactgaaggataattttgggccacaggttgaagttttctgtcttttccctacaaaacgcaaaaagtagaaatacaagcctacctcaaatttgagcttcggtgctggctttgccttattacatgtgtggcagttgaaaaaaattaacagctgctaagcaggaattggaaccaatgccccagagaagacagagcccagtaatgtctgaagcagcatgcacagcagaacagcatggaggtacagagtgtgagcttgtggtgaaccctggccaagcctgctaagtgcggccctctgcagccttgtgggtaacctatcctgtgtgaccacaaattggtcatcagcacacactgtcaatgcagcggtgtgtgtgtgatgcctgatcatgctataaaactgtggacagtgtagcacattggaaccccaatgttacttccaggtgacttggcttgaagaagtcagcttttagcagccacatcaggtacctaaactggagttttaagtaatgcaggtgccaagtataagaggcttgatagggccaggcacggtggctcatgcctgtagtcccagcactttgggatgtcaaggcgggtggatcatttgaggtcaggagttcaagaccaggctggccaacatggtgaaaccctgtatctactagaaatacaaaaattagccgggcggtagtggcgcatgcctgtaatcccagctactcgagaggctgaggcaggagaattgcttgagcctgggaagcagaggttgcggtgagccgagatcgtgccactgcactccagccttggcaacagagtgagatgctgtctcaaaaacaaaaaacaaaacaatttaaaaaaagaggcttgataaaccatcactaaggctccccatgaggaactgggatgactcaaacagcrtcactcacccagtaccccccgggcccagtattcctaatgtacttctctgaaaatgcattatctacatttatcacactgataggtgccttctctaagatttatgattcataatgctcatattctccaagactcccattatgtcctttacggtacctggatttgtatcccagttctgccacttattagctatgtgaccttgtggaagttatttaacttctctgtgcctcagtttcttcatgtggtaaataaagataatgatagtacctacaagatagagctgttttgagaattaaatragttaatacctggaaaactcttgaaacattgcctggcatgtagtaagggcccaataaacgttaactgtcatcctcatcgttacatttcacttcttgagactttagaagttaaacccaagaaacattctttaaaggggttcactctctgctgggtttccccatttcactgagatggaaagttctttagtcacagtttttctagtggggtatgtcctagcaacagaaaaattaaagcttgaagtaggaatgaaaggctatgatgcctgatttgggttctcacacaaggccttccaaacacccgtgtcctcctgagctgggaaggtaaaatgagctcttccaatcgcctgagcttctcttaggtcagggacggcacagacacaagtgcacatacacagcgcagcctctcaatccttcattttttctgagttccaatcctcagcccctggtatgtgaggatcacagtacatctccttgctgagcccagaagcacatgttttccagaactgcctatttctattcgatgtttccagcatggcaacatccaacttcagagtccaagaaggcagtactcaggtctctaggcaggcaaggtcaatgaagacactyactgtggcaaggtgtgaataatttgcatgaaacctgtggtcattgaaacaaagcccctttttgagayatgaggacacaggcctggccaaggtgggtctgaccactgtgcagcatgtgccagggagagtacagaactcaaagtgcaatgtgctaacggagtgtagacagactgaaaagagtgaatttcatttttttaaacatcatgaatgagataggaaaaaagccagtaattatacagcagagaaatcaggcaataccttgaccagatgatcaaaattagcatgtccaataaaggacagatggatatcatgtgcctacagatgtgatagcctgagaagaacgtaccatcacctatactgtactcaagccaaaaatgcatcacctcaatctcaatacaaggaaaatgcagacaaacacaaaatgaagaatgctctattttaaaaaggggagggaagttgaaaaacaacttgcacatcagtgaaattttaaagcttgtgtgcttcaaaagacactattaagaagtgaaaaggtagcccatggaatggtagaaaatgtttgtaaatcatatatctgacaagagactaatagctacaatatgtaaagagttcttacaagtcaataataatgagacaaatcactcaattaaaaatggacagaggaggctgggcatgttggctcacacctgtaatcccagcactttggraggccgaggcaggtggatcatgagatcaggagaccgagaccatcctggctaatacagtgaaaccctgtctctactaaaaatacaaaaaattagccaggcgtggtggtgggcacctgtggtcccagctactcgggaggttgaggcaggagaatgccgtgaacccagggggcggagcttgcagtgagccgaggtcacgccactgcactccagcctaggcgacagagcgagactctgtctcaaaaaaaaaaaaaaaaaaaaaaaagatggacagaggattttaatagacatgtttccaaagaagacaaacaaatgaccaataagcacctgaaaagatgcttaacatcattagtcatcagggaaacacaaatcagaaccataatgagataccatctcaacctcactagcatggctataataaaaaagacagatggtaaaaagtgttgaagaggatgtgaagaaattggaaccctcatacactgctggtggagatgcagaatggtgcagctgctttggagagtagtctgttaattcctcaaaggtcacacgggctaccatgtgacccagcaattctactccaggagatgaataaaaggcacaaaaagatttccacatgagatttcttagcaacattagtcgtaataccttaaaagtggaaacagcttacatatctatcaactaatgtacagctagacaaaatgtggtagatccatacaatggaatattatttggccatagttaaatactgatagatgctacagtatggatgaattttgaaaacactgtgctacgtgaaagaagccagtcacaaaagaccatgcattatatgattccagttacatgaaatgtccagaataggcaaattcatagagacaggaagtggattacaagttagttgtctagggctggagaaattggtaggcaatggggaatgattaatgggtaccaagtttctcttgggacgatgaaatgttctagaagtcattgtggtgatggttgcacagctctctgaatttatttaaaacttgaattgtacacattaagtacaattgtatgaattgggtgaattttatggtatgtgaattatatcacacacagaaaccagtaactaaaaagggttaactggtttttgtgttamccagttaaccctttttaatgacactgacagttttgaattttaacattttgaatgtcaaaaatgtctgtgtcatggaggacaaagaaagctgtggaaatgttccagattaaaggaggctaaagagacatgacaaccaaatacaatacctgctcctagcctggatcctgtactggaggaatgtgttataaatggtcaactgacaaaattggaacatgaatagtagcttagataaaagtattgtatcaatgtaaatttatcaagcttctatctgtattgtggttacataagagaaaaatctctatttttaggaaatatacaatgaagtattagtggtacaggatcataatgtatgagtaatctatcctaaaatcgttcagaaaaaagtgtgtgtgtgtgcatgtgtgtgtgtgtgtgttttgcagggaagcaaatgaaattgaacatttttatgagtcaaaggaagccatcaagaaagtgaaaaggcaactcataaaatgggagaaaaattttgcaagtcatgtgtgacaagagacttgtagctagaatatataaagaactctccatttgtttgtgtcctctcttatttccttgagcagtggcttgtagttctccttgaagaggtccttgaagaggaagaatcaatattgtgaaaatggccatactgcccaaagtaatttatagattcaatgctctccccatcaagcgactattgactttcttcacagaattggaaaaactactttaaatttcatacagaaccaaaaaagagcccacatagccaagacaatcctaagcaaaaagaacgaagctggaggcatcacactacctgacttcaaactatactacaaggctgcagtaacaaaaacagcatggtactgataccaaaacagatatatagaccaatggaacagaacagaggcctcagaaataacaccacacatccacaaccatctgatctttgacaaacctgacaaaaacaagcaatggggaaaggattccctatttaataaacggtgttgggaaaactggctagccataagtggaagtctgaaactggatcccttccttacaccttatacaaaaattaactcaagatggattaaagacttaaacataagacctaaaaccataaaaaccctagaagaaaacctaggcaataccattcaagacacaggcatgggcaaagacttcatgattaaaacaccaaaagcaatggcaacacaagcccaaattgacaattgacatctaattaaactaaagagcttctgcacagcaaaagaaactatcattacagtgaacaggcaacctatagaatgggagaaaatttttgcaatctatccatctgacaaaaggttaatattcagaatctacaaagaacttaaacaaatttacaagaaaaaaacaaccccatcaaaaagtgcgcgaagaatatgaacagacacttctcaaaagaagacatttacgcagccaataaacatatgaaaaaagctcatcatcactggtcattggagaaatgcaaatcaaaaccacaatgagctaccatttcatgccagttagaatggcaatcattaaaaagtcaggaaacaacagatgctggagaggatgtggagaaataggaatgcttttacactgttggtgggagtgtaaattagttcaaccattatggaagacagtgtagcaattcctcaaggaacaagaactagaaataccatttgacccagcaatcccattactgggtgtatacccaaaggattataaatcattctgctataaagacacatacacacgtatgtttattgtggcactgttcacaatagcaaagacttggaaccaacccaaatgcccacaatgatagactggataaagaaaatggggcacatatacactatggaatactatgcagccataaaaaaggatgagttcatgtccttttcagggacatggatgaagctggaaaccatcattctcagcaaactaacacaagaacagaaaaccaaacactgcatgttgtcactcataagtgggagttgaacaatgagaacacatagacactggagtgggggcatcacacactggggcctgttgcagggtagggggctgagggagggatagcattgggagaaatacctaatgtagatgatgggttgatgggtgcagcaaaccacyatggcaagtgtatacctatgtaacaaacctgcatgttctgtacatgtaccccagaacttaaagtattaaaaaaaaagaactctcacaattcaataataagaagacaaagaactcagttaaaaatcggcaaaggatctgaatagacatgtttccaaagaagataaacaaatggccaataagcacctgaaaaacacatggagtaaaatgttagtaacaggtaatctgtgaaaaggatatacaggtgttttttctactattcttatgtttgcaactttttgtaagtttcaaattttttttacaaattaaaagtttttaaataatcctgaatgacttttctctttgggcagtgtagatctgtgcgaaaactggtcagacggaacactatgagtgtgagcgcgtgcacatgtttgcacacctgggagtctacacatgttccacagagcacttcacctctctgctgtcactggcccccagcccctgtggcttgcccagcatgcacaccatcacatctgagcaacatgcttagttaactggggggaaggaggtagagccctcagtgctcctgaggtagacagaagttacccatcagtgtgagccacgctgcaggcattgtcccctttggctggggctgacataaagagataaggagcaggtgggttaggcctatgctttgctgtattctgagagacttgccatcttcagagttcttgtttctatactgcagagtttcccactaggctcagaagggccactctttttctgggttctctacctatgttggagaggggaaggaaagaggaacaggacatatttattgagagcccactttgtgcctttatatattatttcactcaaatgagacagaaccctgcaagatggataaactgaggctcagagagcttcagtaacttggccaaggtcccatagcaagcaaggggtggaaccagattcaaagctaagcctagactcctcacttccccacttccaccagacacacrtccttcagatactggtgtttgttttctttccattatttctcctcttttgctgtctgagttgaggtcaaagcctgttctcatcccgggaaatgaaaccaaatcactggtgactgtaatggatccaaaagacccaggcaactttggaaaacaccagcagggctgccatcagccctgtttcttgaggtcatggtgatgttggcaatcactctgaaggaagaggacagaaatatctcttatctttgctttaactgccaaagcagacacagtttttagagctgggtgccaagtcaggggtaccatgtagccagagatcctggcacacatctggatagctgttcgaagaatcttcctgccaaagggggttggggtagtggtgaggacatctgaggaggaaagggatcctacagctataaggatggggtggtgcatgatgagggtcctaggagtggccattctgacttcagggtatggccaagggcaatatgcatgggtagggagggaatggggaggaaaatttcttggcagtctcccctttatcctctgctcttctcctctactttttaggcctccaagsctcagcactcatcctgtttctcattcttaaaggcctctctgttagctgaagacccaaaagagggttgctaggagaataggttgtaagcctagagtcacaaatagccatcagacaggaagggtctgcctacaggggcatcagctcagaggaaagcagagctgaaacacagtgataatgtcatttgagtctttggatccagccatgcctgaagccctgcacttttaaattaaggggaccaaaaatttgcattttcacataagaaattttcaactgggtatctgtcacttataagaagaataacgtgaatagcattctaacactgaaacagtactggattttctagtatgattttcaagtacaggtcttctataacagccaagggaggatgcagagaactttaggatagagccattgcacatggaaagtccagaatctggagacactgaggagaggaagagagctggccagcccctgcctcagcaggcctctgctctagggatagggtaagatactcaagtctggcttcgtgtctgaagctctgtagggaagcctggagaaaggataggccagccccaattcgagggttctgcaacctacagtttttcctgaagttgttccaggtaatgatggttgctaccttctgctgagcctatgctacatgaccaatgtattacactgtctatcgttttatttctcacagcagccctgagaagtagagatattggcacaattttctagatgaagaactgaaagctcacaatggtgcagtaactaactagtcacatagctagtaagcagcagagcagggattcaaatctagtgtattagactccaaaacctgtgtttttaacaaccatattgtatgttacttcctccaagatgggtcaatgaggcaggggacgttgattggctatatggagaattaataataatcttttctgttggtacagccctagagagtttacaaagcacaattgtatatgcagtctcactacatccattttacagatatggaaactgaggctcagaggtaggaagtgatttactcaaagtcatttgggcaaacaggataaaccacccagagataactctccttaaattaagcaggcagtctgtagtctgcgaatactcataatgtgtggggggaggaaggagctggcctcaccacactgaaccttgagggcagtgatggtatcagtctgtccaaggaaggtctcagacaggtgaggggaccaacaggtattgcagccacagacccaactgcagaacacaaatcccactacaccaaagggctctgaattcacaaaaagattcccagttccagccgggcaccatttatttttcagcaacacttgayatgggcaaattccagttcaactagagagattcagcttcctggtgttcccagggggatctagctctgaaaagagcccctttcttctgtcaggacatcctcagcaaaraaggctgcaggtctgagctgagcagcctggagagtggggattccaactccccccgagagtgtctacctgcctggcttcctccctgaggaaagtcactgtcccagcccaagccctaggggccctcactgttggacctgccctgatgctttgccaaactcagaggcacctctcctagacggacaaggcaaagctgactttcactgttccctgggtgatctgcacctggaggagtgatcaggcagggatccaggtgatgggacagaaggggccagggcagccactgttgttcactgctggaagtgtgccaggggactggaaggtgaacagcaatcccacctgtctcctagagactctgtcctccgtgtgtaggggaaagtaggggatgggcacacagggaggaatccagccctggggcttccttgaagccaagtgagcagccttctgtatttgttttcccacaaacagtctttgaaactggggcaagtgttgaaggcagaacagagtaaaagaagcagcttcatgaggccaaacccagtctctccaggtctaggtagtccagcacaggttctgggagtaaatgccagctttaccacttgatttctttggtacgaccttaactttttgccatcctttcactagtatttattgagaaccctctgcatattagggcatcaatgctaagcaaaaaatgggttcagtcaccttcctggaggttccaatcagtggaggagacaaatattaatccaacaaccagtacccccctacccctacccccacagaaagtgtcaaatgcccaagagatagatagtatataattagagagacttcactctctctggaaggtcagagaaggctttcctaaagaaatgataatggagctgaggtctggaagaagcataggagtttcctgaagagggtaggagggggcactgcacacagagggaacaggacagtcaaargcaggccatttggcaacaggtgactggaaggaactggaagaaggcccatgaggctgaagtacagagtgaatatgcagggtctaggcagaccatgcaagaatgtgggtttctcctaagagcaataggaagccttttgaggtgctcttagcagggaagtgagatgatcacacttatcgtttgagaagattactctggcagcacagtgaacaacgtattggaatggaaccaaggagcattcaggaggccagacagaaggtatcaggtatttgcctgtaaaatgggggtgatgagaatactatcttacaagctgttgccaggatccaatgagatactgcattttaagtgtctagtctagtacctggcacatagtaaaggctcagtaagcgtcgatattgttacttttatcattggttctttgcagagtgcacatatttcttatccaggtctgctcctgcgtgatggggtggagggagtagttgtggtttccagagtgaaaacgtgatttgtgtcaaatcacaatgtcgagaccagaatccaggatgcctgaaggcccgattagaatggcttaaaagtatggattattcaggaagaaaaacgggttccaatcgctcctactaaggacgctggagggatggtgaacgatcctttagatggtaagccctagcacttattgagaaaaacaggtgcttctttggtcggagagcaggtgtagggctcgcagccgcgtgcgctcccgcggaggcgggggaccctcgccactcccccgccccacgcccacccgcgggcttccgactgcacctgctcccccggctcggaaacgcgggccgggtgccgggctgcaggcagagggtgcccgggggaggaggtcccgaaagcctcctccacacgcctgcaccggctgccccctccccagtcacgtggcccggtgggtggggaccgacctgaagttggagaaatccggagcgctcccaacctcggagggagtcgccagtcctccgggcccggacggtggaccctggagccccggctggcggcgtggaggtgcgtttctgagaagccgagcagcggcgcgggcggcgggactcgaggcatggcccggctgtcggtgatccccgggtcggccacggcgtggacaggtgagcaggtacccgcggccagcggcagagatggccggggctgccagggcatcgggccccagagcccacgccagtccaggggatgcggggcccccacgcaggagggggcggttgggtgaaaaggccgcggtggattctcggactgccgggtcagtccccaccagcgccgccgcctcctcgccggctttgccaccgggtgagcaggrgacgcgggacgcgggacgcgggacgcgagggagccgcgcggggcgtggactctgtgccggccccgccccccgcgcgcgcactggctgctccccgcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatggtgagcccccgccgccgttctcgccccggccccggcggcttcgcgcccgccgttttccgaggcccggccgttgcggctttcactgagtcacggcccggcccgccgctgcccttggctcgcggtcgctgcgtcgcggattcctccccttccagtacccctgctgcggtttcggtggggattccgtcgtagcttttctagcttgcgctcccctcggctgtgcctcctccctggatgtctcttctccagtagaaagaagaggtcctgccctgccctcttgccctcgggtcttctttctttttccttattcttaataccgaattttgttcacggggcttgtgcctcctatgctgtgtggctgttcctatgacccagacagaggtgattcctaatggctttccgtgagggggaaagaagtggaaagagggttttttgacagttgccggatccagaggacttttgttgaatccattgtccccctatgcaaaacccacttctctagttttggtcctaactttgaccttccatcctgagtggggagagagaaaaggggccaaatgtgaaggtttcctgaacccccaacatctcttcatcattctcctcttccagccccgcccccaaggagtgggtagagggaggaagccaggctgctgcatctcaccgaccagctaatgtgtgcatctggagctggggtgggtgcagtctttttttctagcacagttgttcctggcattaagtagaagcacctcaggacagggggcctggggtcaaagatggtactgtcctctttctatagaatgggatggatggctaagggttaccaatataaagaactgtatttgtcatccctcrgccactgtagtggtcctgggccaagtttatgtttaactttgtagttttatctggagttttcttgtagtttgattgttttcttgaatttcacaatcgctttattcatttgggtggtaatatgtgaaacactaattaaatgtcttttaacaaatgaaataggtgctctgcataatttttctagtattttttattttaagcttttgaaatatttaattttggatgtggttgtcggccctagttcactgaaattgccatttctggccccaggagggcagagcttctgcatccatttcctttttttttttttttttttttaatttaacagctctaatgatacacaggtacattatattatacacagtataatataatatacaaaaattatacacagtataatttttctcctccctgccattagttacttctgtgcagagtttgtctacttcagttatcttgctctgttttttttacaagttgtgtttttttgttttgttttgctttttgcacaacccacaggatagtttatctgatttatgctaacccagagtgataagtgattgaaatgtgctcctgcaaaagagataactctcttttcccttctttcactttaaagcaatctcgattcatttaacaaatcaggttcgagaagtattctttccttcaggccaaataatcctatcctagttcctagaatgctcagcaatcaataaagaaggaagtattatattaagagaagaattaaaatacagagtttttaaatgctggatttggttgtccctcgttgtcgaggagtttcctagccctgagagctacctgaacttccttctgcctaggatttcttatactacttcatgctgtgtaagaattccatccgcttttctgactctagtctgtctcagttgagtcacaaagggctgatagcatacagcacaggcagcaggctgcaaagaggaaggagcctcaagaagcaggatattgccttgagtatgacacatacacatgacagttgactgtaaggctctgaatcatggttcacgctttctgtgccccaccgtcatggagttgatttccctctctcactgttttcacacctataatgtacaagtgattgcacagaacagccaggttacagaaaccaaggcagaccgaggtagggctaggagagccgcaagcgctggggtgaggcagcatgcttaaactctcttggaactgttrttgcagccttagtacaatcttagaagtgaccttagaagtacattattattcttttactttataaatacatgtgggatagaccagtgttgactcaattttctctcactgcaagggaaatttggaggatgttaaaattaattgaatagttcttacttggagtagtttatagtataatctcgatagaaggagtccaagaaaagggagaggatagcatcagagggagataaggaagagagaggagaaattagttgttattgacttttgggtttgtgaagattgtaggttgtttttcctcataccagcaacctatatttgaatataccgctgggatttctgaattatctacctcttactatgctgtttctgtaatgttcactgcttgataccagcctgccagctcttttaggactggcagaaggcaaccataggaaatcaaagggggtcatgttctcttggccccaggaaagtgcctttgcctattcctgtgtatctggagttggctgatacaaagtcttctgtggaaattatatttttgtctgccccttttgcttttatccttttatcttgtattgttcattctgtattagattaagaactaaaaccagagatatgagtgagtaatattatatttgattttttttttaagagacgggttctcactctattgcccaggctggaatgcagctgcagtcacatcttactgcagcctcgacctcgcaggctcaagagatcctcccacctcaacctcctgagtagctaggattacaggtgcacaccacaacaccaatctaacttttgtattttttgtagagatgggattttgccatattgcccaggctggtcttgaactcctggtctcaagcgatctgcccactttagcctcccaaagtgctgggattacaaacatgagctaccacacccagccctgatttttttttttaactcagtgaagctggagaaaaacatctccgttcttggaaatttgcctattgtaatttatcttgttttagctaccaggttcataaaagtttttctcattgtgctaaggactttttaatttttaaaaacagtcatgttatgtggtaatatgctgtctttcctaaatgatattatacttacctgtaggcattaggccatattcttacttgtctggcaatagagtttttctttcctacatatgattgcttctgatcatagctaaatgctttttcaaaactgactagaattaggaatgatgctgggggaaagatggttgaacacagtaaagcaaacttaccataaaatacctgaacagaatctctgtctattagagcaggtctgtgtggtgtgccctatagattagctatccatatcaccacaaatcatgggctggagaatttcagaggcttagaaragaagcgtgaaataccagtataacaccaagatctggcacaaactgaagatttgcagagtcgtgattgcatcctcgtaatagcaaacattatttgaatacttgctgtgttcaggacacagtctaggggctaagacacaaataggaagacagaaaagtttctcattataaacaggtttataggttgggggcagggaaggacagatcagttaatttaatatacaaatatttattgagtacctactacacatgtcatgcaataatttaagctttggagatataatagtgaaccaaaactgagttyctgccttgacggaactttcattcttgtgggaggaaggaggcagaaagtaaaattaagtaaatgtatataaggtaataataataaatattttctatggagaaaataaatcagggtaaggggaatagggaaggcagtgactggggtggggtggagtctggctattttgtacagggttgtccggcaaggcctatctgataagattacatttgaggagatactgaagggaattaaggagcaaagtttctcagggaagagtgttctaggcagaaggaacagcaagtgcaaaggactgaggtgtcactgtgcttgatataactgaagaactgtaagaggaccagtgtagctagatcaaaatgagcaagggggagggtgatagaagataacatcagagatgtagtaggaggccattgtgcaggcatttgggtggttttttaaaattattattttttttattttccactcttttcagcgcatacctatgcatttgggttttaacctgagattggaaacgagtggaatattttgagcagaggggtgatatgatacatacaacttattttacaaaaagactactcaggctactatgtgggttacactgtaaaggggcaagagtagatgaagcaggaagactgattaggaagctattatacagtaattgaagtgagaggtgatggtacctcagagcagtgtgataagctgtgaaggagaggaggaaggatcaggttctggatatatgttgaaggcagagctgacaaatgtaattgatgcattggattaagagtgaaagagtaatcaaggaagaccatgaggtttttaacttagccattggaagaacagaattatcacttgctgaagtggataagacttgcagcggggagcaggttgaggatggcaaataagaatgaagagtttgcgggctgggcgcactggctcatgcctgtaatcccagcagtttgggaggccgaggcgggcaggtcacgaggttaggagatcaagaccatcctggcaaacacggtgaaaccccatctctactaaaaaatacaaaaaattagccaggcctggtggcgggcacctgtagtcccagctactcgggaaactcgggaggctgaggcaggagaatggtgtgaacccaggaggcggagcttgcagtgagccgagatcgtgccaatgcactccagcctggacgacagagcgagactctgtctcaaaaaaaaaaaaaaaaaaaaaaaaaaatgaagagtttgatttttgaacaagtttagggtcccaattagttacttaaatgtagatgctgaatagacaattctagaagaagataagtaacaccaccagaaagcctgtgctagttgccaagatgtaatagtcagatgtgccagaggagtccagcggaagaagtgatttctctaacctgatgtgatgataaggatggagactggcatctatttacacctttaccattccctttgagccagctgactgtgagatggtatggagagaaggctgcctctagagtgtgctttgtagaacctcagagtaggaagaattttacaggttatctggtctaattccttgcccatttgtgaatcctttctaacaaaatgcagcctccgtgagcagctgagaaaccattatctcagactaatccacaaaacagataataatgaggaataggttgtttgttgggtcatgagcaaaggcaaagaaatagaacacagaaggcctggggcagtgtaacagcctgccttatgtttttgagcaactgcaaactgaagaacaatctgtgtttccatggggtagaatgggtcacgtgttatatactcagctagtaagcaaagagaaggcacaaatattggtgaccttttggatttccaaggtcagagatagagacatgtatactgggcttgactcaggagtccatgtttatctatagactgtatatgaggactaaaatggagtagaatgatttcaggcccttttggggtaaaagaaaaagtgaatggtatccatgacccttgttctaactaagctctagttgtggctctgttgctagctagtgaccttggatttctctcttgggaataaatgctacaaagaaagcagacccctaccatttcctctgttttctagtttggttcattctgtggaccacagaaatccattagtttctgtctgggtagcttgggtaaagggattgagagagtggctttaaagttcttgctcaaattatgattctatggtatcctgcactatagtctgattcctctcacctctcttttcttcaaactctatagtttggttagaagagatgtttaagcagtgtgggtgccagattgaggaactgtagctattttcacccagaatacagcacttcccaaagcatttcctttagaagctcttgatggcgatggaggcagaatatttgaacttgcctggttagagtttagatgcctctagcagccacatttcaggaagagtagagaagcagggactgcttaggttagtagctgccttgttgaagtttagcataaagcagaatccacgtcagaaagacgacttaaaaattatgtctaaatggccaccagggtatctgcagcatccatctagcaaattagtactgtgtatccttttttctttctttctttttttttttttttttttgagacggagtctcgctctctcaccaggctggagtgcagtggtgcgatccgcctcccgggttcaagcgattctgcctcagcctccccagtagctgggattacagacacccaccaccacacctggctaatttttgtatttttagtagagacagggtttcaccacattggccaggatggtcttgatctcctgacttcgtgatccacctgcctcggcctcccaaagtgttgggattacaggcatgagccactgtgcctggcctccttttttctttttttgagacagagtctcactctgtcacccaggctaaagtgcagtgtcgtgatcatagctcactgcagccttgaactcctggcttcaagtgatcctcccacctcagctcccaaatagctgggactacaggcgtgtgccatcatgcccagctaatttttaaatttttaaaatttttaattaaaaaaaattgtttttgtagagacacaatttcactgtgttgctaggttggtctcaaagtcctggcctcaagcattcctgcctcagcctcccaaagtgctgggattataggcaagagccagtgcacctggtcagtactgtgtatcttgaaagacaggacagcccttggaaagccaatatgtcaataaacaaatgagaaccacttaaccatatttataaaacagtcatagactggggatacaaatagtagaaactctttaatatacaagtattgaagggattctgaaagaaagaattcaatgatattaatcaagaaaggctttttggctgggtgtgatggcccacacctgtaatcccagcactttgggaggccaaggcaagtggatcacctgaggtcaggagtttgagaccagcccggccaacatggtgaaacctcatctccactaaaaaggcaaaaattagctgggtatgctgctacgcacctgtagtccagctactggagaggctgaggtgagagaattgcttgaacccaggaggtggagatttcagcaagccaagattgcgccactgcactccagcctgggagacagagtgagactccatctcaaaaaaaaaaaaaaaaaaaaaaggaaaaaaaggctttttgaagaaagaaggggtagagatttctttcagtactatgtcaagagctgaggatatagctgaaatcaagacagtcatggtccctgcccttgtgcagttaacatgctggtagggcaggggtgaaatataaacaagtaaatacacaaaataatttcatattgataattactatgaaagaaatagtgagatttgttagtaactaaaaaggtgacctacctactttaagttgtatggtcaaggamggtatctctgaggaaatgacatttgaacagagacctggaagataagagggacctaactattagaaatgttaggggaagaacatttcaggcagaggggacagccrgtgcaaagggattggaatgggaaagaaattttgagcaaggaagtgagtgtggatggtgttgaatctgaatgaataaagggagagtggtttgtatatggaaggagaggcaagggccagttggtacagagctgtatagagaagggtaaaaagtttggattttttctgaagaacaatgggaagccattgaagggttttgagtaaagtactgtattacctgacttatgttttaaaaagcttactctggtttccatgcaaagaatggactggagaagggtaaaagaagaggcagaatgcaagttaggaggctgtgacagtacagataagaaattatagtggtttggattagattggaggtagtaaagatggggagaagcagatcaattccaggtgtgtttcagagtacaatatcacttttgatgggaggtcaggaaatgaaaaaatcaagaatggatgtatggtggtgccacttaccaaggttgttggaaaggaattaacccaatatgttaaaactgaacaagtctttggagctcaaacctcctttatgactgatcaagagagtaaggtttggagaaaagtaatgctcatagaggttagtgatttgcccaagctaatatgtgacaagtggtaatttgctgaaagcagaaagccttcatggagtagtaattaaaaagatgagattgggaaggaggatgaatggtagtggaaggtcttgaatgytaaattgaggatttttctttgttacaactagcaagagaaccactgtgggggaagaggaccatgaaagtaatgttaggagattgggcttagcagtaacgtaaatgaagaagaaaataagaggaggcagaatttcacccaccgagatagggaataagggagaatgcgcaagtytgatagaaaatatcagtgggataatttacatttgaagtgcctgtggaatatctaagtagagaagttgaaaaaggcagttggatctatgggtctagaattgaggtgacatctggacatgagatagagtcatcatcataaaggtagtaatttatgcaatgaaaacagataaaattgccctgggagtatatgtagagtgacaaaggaccaaagatagagcgatgaggaacactaacatttaagaaatgaacataggcaaaggaaccagtgagagagacaggaacagaataaacaggtggttttagaggccagtggaggagcgtttcaggataaatgaaatgttgagtttattgcagcattgtttctaatggcaaacatatgaaaataatctaaatgcccattagtaaatagttaaggtatgcttataccacaaacttgtctgtcaaggatgtgctgttttaaaatgcagaaagtagggcagacataagaaaatagatgctaagctggttataagataacctggcattatacctgcctaagttacattgtgtgtgtgcacatgctttagtttttgcatctggcagacactgttagttggctaaattatcacccatccttagcccttttctttatgctgaactcctctatagagattataaaagctaaattctctcccaatgtctgttagagctaggagtggccatatgagttctgaccaagaagatatgggcaaaaaactgctgaaggaacttctgggaaagcttttccttttctgataaaagcaattgatggtgttagtgtagtccctcctccttcctcatttcttgaatgtggatataatgcctggagctggggtattcatctgtgaccatgaaggaatgtccaagagaattaacagagtcaatagccctgaagttgttaagctgctgagttagtatcagcagcttctatgtctagacttcttgttatgtgagaaaaataaatctccatttaaactacggtaagttggcttttcttgtggctgaactcttttctgctacatggggtatatttttatttaaaatttttaaaaatgtaaataatttaaaacttttaaaaatttaaagctgttgcttgtgttagggatctccatatctccaagtaaatggtgatactgctatttcttaattaactgtyttcatcactatctatctagtcttactttttttttttttttttttgaggcagggtctcgctttgttgcccaggctggagtgcagtggtgtgatcttggctcactaccacctccaccttctaggctcaaattagtctcctacctcagcctcccaggtagctggggctacaggcgtgcactaccatgcctggctaatttttgtattttttgtagaggcagaatttcaccatgttgcccagtctggtcttgaactcctgggctcaagcaatccgcccrccttggcctcccaaagtgctgggattacaggtgtaagccaccgcacccagccctgattttctattataatggataaaaacttaattctcttacaccttcccatcatattcactcttctattatactaacattctgttaaataactattttgggtcaaataagcatttattgcttacattattatgactatgttcttgttatttacagctgagtcaaatgtactatttcttttctcataaaaacatttttctcaaaattaataatttccttggtgtttaaaaaaagtttccatgtaaaatttaattctccttcaagtaacttaaaactatagatggtctagcaagtccattgttttcttggaggatccttcctagagccccctatcttttcatttcattttggactggctgcttttaaggcctgtaggcaacctgtatcctggacttttccttcaacaccattcttagaactgcctttgcctctctattggattctttcattcttagatctcatgtttttctccttgttgtttgtttcccttgctttggtgaagcatgcatatctttcagtagcttcttgagaagacacaggaaataactttcttgagtcttgattgatagtttgactaggtttacaaattatgtactatcaaattttttttttttttgagacggagtctcgctgtgtcacccaggctggagtgcagtggcacaatctcagctcaatgccacctccacggtgagttccagtgattctcctgcctcagcctcctgagtagctgggataacaggcacccaccaccacgcccggctaatttttgtatttttagtagagatgggatttcaccatgttggcttggccaggctggtctcgaactcctgatctcgtgatccgcccacctcagcctcccaaagtgctgggattacagacgtgagccactgcgcccggccccagatttttgaaggcattattctattgtcttttagctttgactgttactgttgaatagtcctctactattctgattcctaatcctttgtattttgatcatctttttctctttggaatcttgtggaatctttgtcatcaatgctattccaaaatttcacagtgatgtgaaatcttgatgtggatcttttttccttcattatggtaggctccatgtgggccctttcaatctttaaactcatgtccttcagttctggcttagtatgataacccacactacccttcagctgttctcgaaatctgaaagcctagccaagctatcaactaatcagtctttttatttactcttacaagaagagtaaacttttggcattctcctcagttctccagatcaagtgagtctcatgaagactttagtctatttccaaccctaattgcatccttcaactgtagaggttctgatacctgtaactcctcagccttttaattttagtttgagtagtacaactgcttttacagctagatgcaaatatataacrgctcaaacaaaatagtttattttttcttaagtaacagtattagtggaaaagtcagcaagacagcctcttccatatagtcctttagagactcaaactaacagtagctcttctgtcttcaacatgtggcctctgagaaggtaaccatagtggtcatctccactccagccagtcagaagaggaaaagaatatagagaagtatgcacaggagatttttatgggccaggcatagaaatggtgcatgtcacttccactcacattctattctgtagaactcagtcatatggctatgcctaactacaaagagggctaggaaacagtctaggtatcttctcatgaggaagaggagaattttaaagaggattttaaagagcaactggcagcctctgctgcttcagctctctgtgaagtgaaatggtataaagcacttagctttctctagtccaggtcattaattgctgcttttctgcctgctattcagattccagaattttgtcaacatcttttttttcttctttattgttctttttgttttgtgggtttaggacttattcttttactgtcattttagtgaaattttggctgaaagcagaggtaaatatgcagctatattgttacttaagatatagtatatgtaggyataataaaatgaccagagaaaaacatctctgaggttcatatgggtttgttggctgtaaattttctattcctgaactatattatgagtactttttaattatcaaagagaatgaaaagaattatgtatattgacatagaaaatgcctttttgttttgagacggagtcttgctctgttgcctgggctggagtgcagtggcgcgatctcggctcaatgcaagctctgcctcccgggttcatgccattctcctgcctcagcctcccaagtagctgggactacaggcgcccaccaccacacctggctaattttttgtatttttagtagagacggggtttcactgtgttagccagaatggtctccatctcctgacctcgtgatccacccgccttggcctcccaaagtgctgggattacaggtgtgagccaccgcacctggacagaaaatgcttttatatattaaatgaaaatagaaaatttcagaacagttttatagtatgattagtcttttatatgtttataaatgtattaatattttttgaaagatatatttctaaatttaatggtcattatttgttgggagtgggactgagaagggcttgagagattggggaggtttttgcttttaattttatttatttatgtatttgttcatttatttattgttttgagataaagtcttgctctgttgcccaggctggagtgcagtggtgcgatctaggctcactgcaacctcggcctcctgggttcaagcaattctcctgtctcaccctctctagtagctgggattaaaggtgcatgccaccatgcctggccaatttttgtattttttcttttagtagagacagggttttgccatgttggacaggctggtctcgaactcctgagctcaagagatccgcctgcctcggccttccaaagtgttgggattacaggtgtgagccaccgtgcctggcctttgctttttattttatatatttcagtgatacttaagtattttacattgagcatgtgtttgaaccttttttggttactaaagaacaagtaaaggaatagtcagcagggccaaatgcactagaaaagtctggtaaaattaaggctgaaaatgtctattgtatttggaaatcagaggtaattattggtatgggataagaagtgatctcagtgaagaaaatatgggatatcagaaaatagatgtcatggtttagtctttttttaaaaagaccattccagataaggagggtgattaaaggaggctgtagagtaaaggcagcaggatctgacattttgtggaggagtttgctccccaatatctaggaacttttagtatgttttataacttttggaagaagaatccagtagaaagaggaaaatacagaaaagggatgaattcaagcataatgatttcagaacttccctcgtttgtctcatctgtccactaatgattaggttcctttgcaagattaagaactagataaagtgtttagcaagaccaatgtaggaagacatccccaaactttaggtaagagggctttgtttaggtggtctttgaaactccttccaatcttcacttctacaagtccagttttatctgagttggtcctggtaagcatggatgtaacagaaacaaacaccctgctttagtatggcttgagctaggaatccattcttattggtgagagagattcgaatgaaacattttcatttcttttgagaagcaaagcattatcccagtgttgcatcacaaaatctgacagagttagcacttcctctagctcctagtcaagctaagaagctctcattttctttacaagtgcctctccctccacttttcccaaagataccagtttagaatgtgctttgccaagaatcagtgtattttgggaatccatttcttcatctcactagggttacaatgagtcatggctgtgactgcattcttccttaggaatctgaaaggtggcagatacactgaagacctccagtgccagcccctccccttgaaaggttctaggctctgggcttctaagagtgacttccttccccatagaatgaaagtgtcatctggtatatgttagatagaaacttggggtgaaacactctcctttgagggattttaggttaaacactctcctttgagggattttaaatggtattgtagccgggacataagatatttgtgtatacaratttctccagtcaaaggatttcttttcaagagatatcttaaactttctggaggccactttgaatagaaacagtggagcatgrttatatctgccctaggaactctcctaagctctatcaaagtgtagacttaaactcacacttctcattctgcttcttaayattaggcatcctggcatgcatataaggtctaattaagtcccctgcttcttggtcagtgtctttccccttcatacctccactttttgggccattgaagggaagggaaatggatgacaagatagggcaggagaaaccagtgttttgaggaccaggggatgccarcatcgatgattcttgtgtgttckctcaggtttcaaagtgtgtctgctgagaggcttgctcagcaagtgtgaattcctgtcttttcaccctatccacccatgggtgactcagtccacaggacagccagccactaaggcttctgcaggctgcatctgaaagataagagagtgagacttgacacagaagtaggcagagcttctgaatacctgtgttagctaagtttcttcagcctatgaaaatgagctgccctttctataaggcagtgatttgctgtcacctaggaagatacagagattacttactctagactaagaccacttttcccttgaaatgctcttgtaaggggaagaaaggtagcaggcctaggttagtccaaatcacaagggttctcagttctcttaagccctagaatatttatcggccctctccacatttcccagtgtcatatcttgcattttcattcattcagggtggcctactgcaaattggtttatggtacctgctctgacaataccagtgaagtcctcacttgaaggaagtataaataagaakcaaagatagagctcagttatgggaggctccttcattatttttatggcacctgggggacaatgggaaagagggatgtggcctgtcactaagaagtctctgctttctatccctcaagcaacctcataatattctgcagaggcgcctcatggaaaccaacctgtctaagckccgaagcggtccccgtgtcccttgggcctctaagacgaacaaactcaatcaggctaagtctgaggggctaaagaagtctgaggaggatgacatgattttggtttcttgccaggtaatgttctgagaacagcttttccagggttttctggaaagtaggatgtggggccctctcctcctgactttatagagtgtgggtctcatggaattcataagtgagttttaaaaggggcactccatgcaacactggaagtgtatgcaacattttgtaagcatgtgcatctttatgggaagaaggaacaaagctttcatcagatttacaaatgggtatgtgatttttttaaaaaagattaagagctatttggtgtatagcatgaaacacctagagtttttgggggatcttctgtcagctctggattcagcaggaacaagagccagtcaaaggcagacttagcagtgggtaaagatgggacactataacccataattgggaggatgctctccaaccctgcctttcatatgacatctgctgcttgctgtctgcatctcctttccctttcgcttctctggctcttattgaacagtacatttcctccccacagtgtgctggaaaggatgtgaaagccttggttgacacaggctgcctatataatctcatctctttggcctgtgtggacagattggggtaagtaggcacttgtgctgagtggaacttagatgtgactgtactcttcgcttgactctattttatggttagagatggtgagggtctctacagcagctcaaagagaagtatgcagagttcagatctcagctggaaccagaatccttagtagaggggaggagtagtgggttatccggcaagtgggagaaatcagtgagcagggaaacctttggctttctgttaactccccctattaagttttgagcaaagacctctaaacttgaatgagagagcctgagacctctggctcattgtgtgccctgccctgatccactagatagcaaattaaaaggagctgtcctgttggtatactccatccagatgagtaaaagtagggatgtggtggggcttagcttactcagagtctttctggaggatgcattgcaggtccccaagaaacatccatcagaactgagaataggactgcagctgctactgggcctgggccatcataagggtaattagccagtagtttcttttgtttgttttgtgtggcggagcctcactgtgttgcccaggctggagtgcagtggtgcaatctcagctcactgcaacctccgcctcctgggctcaagtgatcctcctgcctcagcctcccgagtaactgggactacgtgtgcgccactatgcctagctaattttttgtattttttgtagagagggggttttgccatgttgcccaggatggttttcaactcctgggctcaagcaatctgcccgcttcagcctcccaaagtgctagcattacaggcgtgagccactgcacccagccctgagcttttgtgtggtaaaaatatgaagtatagtgcaacatgatggttccagaaagactaacaatgtcctggtgcataattaggcagcagactgccatgattccagaggaattaataaccatctgtaaaactgcaattatttttcttttggatgggctataacaccaaaagagaggaaatagag

SEQ ID NO: 18017 - DNA, 201 bp, Homo sapiens; identical to SEQ ID NO: 1657

SEQ ID NO: 18018 - DNA, 201 bp, Homo sapiens; identical to SEQ ID NO: 1658

SEQ ID NO: 18019 - DNA, 201 bp, Homo sapiens
gtggtgctgcagattattattctttctgtgtatttacctgcgacaactgtaattttaacaccagtttcaacacagtgggcagcagttacaatccatttttkattaacgatagagcctccacagaatgcatcaactttaccattcaaaacaacctgtgaaaacaaaattaagactcttactgcataatacatttgatctaga

SEQ ID NO: 18020 - DNA, 201 bp, Homo sapiens
ggcttccaggtcagtagttttgctctgaccctaaaatcagactcccatcccaatgagtatctacaggggaggaccgggcattctaagcagtttacgtgccrattcaatttcttaacctatctcaaagatggagatcagtgtgagtccaatccatgtttaaatggcggcagttgcaaggatgacattaattcctatgaatgt

SEQ ID NO: 18021 - DNA, 201 bp, Homo sapiens; identical to SEQ ID NO: 1660

SEQ ID NO: 18022 - DNA, 201 bp, Homo sapiens
agagctagtggtgctgcagattattattctttctgtgtatttacctgcgacaactgtaattttaacaccagtttcaacacagtgggcagcagttacaatcratttttcattaacgatagagcctccacagaatgcatcaactttaccattcaaaacaacctgtgaaaacaaaattaagactcttactgcataatacatttg

SEQ ID NO: 18023 - DNA, 201 bp, Homo sapiens
aagagctagtggtgctgcagattattattctttctgtgtatttacctgcgacaactgtaattttaacaccagtttcaacacagtgggcagcagttacaatkcatttttcattaacgatagagcctccacagaatgcatcaactttaccattcaaaacaacctgtgaaaacaaaattaagactcttactgcataatacattt

SEQ ID NO: 18024 - DNA, 201 bp, Homo sapiens
taaagagctagtggtgctgcagattattattctttctgtgtatttacctgcgacaactgtaattttaacaccagtttcaacacagtgggcagcagttacaytccatttttcattaacgatagagcctccacagaatgcatcaactttaccattcaaaacaacctgtgaaaacaaaattaagactcttactgcataatacat

SEQ ID NO: 18025 - DNA, 201 bp, Homo sapiens
atgtgaaatactgtttgtgacttaaaatgaaatttatttttaataggtgaacataatattgaggagacagaacatacagagcaaaagcgaaatgtgattckaattattcctcaccacaactacaatgcagctattaataagtacaaccatgacattgcccttctggaactggacgaacccttagtgctaaacagctacgtt

SEQ ID NO: 18026 - DNA, 201 bp, Homo sapiens
gtttgtgacttaaaatgaaatttatttttaataggtgaacataatattgaggagacagaacatacagagcaaaagcgaaatgtgattcgaattattcctcrccacaactacaatgcagctattaataagtacaaccatgacattgcccttctggaactggacgaacccttagtgctaaacagctacgttacacctatttgc

SEQ ID NO: 18027 - DNA, 201 bp, Homo sapiens
ttgtgacttaaaatgaaatttatttttaataggtgaacataatattgaggagacagaacatacagagcaaaagcgaaatgtgattcgaattattcctcacyacaactacaatgcagctattaataagtacaaccatgacattgcccttctggaactggacgaacccttagtgctaaacagctacgttacacctatttgcat

SEQ ID NO: 18028 - DNA, 201 bp, Homo sapiens
ttaaaatgaaatttatttttaataggtgaacataatattgaggagacagaacatacagagcaaaagcgaaatgtgattcgaattattcctcaccacaactrcaatgcagctattaataagtacaaccatgacattgcccttctggaactggacgaacccttagtgctaaacagctacgttacacctatttgcattgctgac

SEQ ID NO: 18029 - DNA, 201 bp, Homo sapiens
aaatgaaatttatttttaataggtgaacataatattgaggagacagaacatacagagcaaaagcgaaatgtgattcgaattattcctcaccacaactacartgcagctattaataagtacaaccatgacattgcccttctggaactggacgaacccttagtgctaaacagctacgttacacctatttgcattgctgacaag

SEQ ID NO: 18030 - DNA, 201 bp, Homo sapiens; identical to SEQ ID NO: 1669

SEQ ID NO: 18031 - DNA, 201 bp, Homo sapiens; identical to SEQ ID NO: 1670

SEQ ID NO: 18032 - DNA, 201 bp, Homo sapiens; identical to SEQ ID NO: 1671

SEQ ID NO: 18033 - DNA, 201 bp, Homo sapiens; identical to SEQ ID NO: 1672

SEQ ID NO: 18034 - DNA, 201 bp, Homo sapiens
ttaaagagctagtggtgctgcagattattattctttctgtgtatttacctgcgacaactgtaattttaacaccagtttcaacacagtgggcagcagttackatccatttttcattaacgatagagcctccacagaatgcatcaactttaccattcaaaacaacctgtgaaaacaaaattaagactcttactgcataataca

SEQ ID NO: 18035 - DNA, 201 bp, Homo sapiens; identical to SEQ ID NO: 1674

SEQ ID NO: 18036 - DNA, 201 bp, Homo sapiens
tcatattaaagagctagtggtgctgcagattattattctttctgtgtatttacctgcgacaactgtaattttaacaccagtttcaacacagtgggcagcayttacaatccatttttcattaacgatagagcctccacagaatgcatcaactttaccattcaaaacaacctgtgaaaacaaaattaagactcttactgcata

SEQ ID NO: 18037 - DNA, 201 bp, Homo sapiens; identical to SEQ ID NO: 1676

SEQ ID NO: 18038 - DNA, 201 bp, Homo sapiens; identical to SEQ ID NO: 1677
  misc_feature (1)...(201): n = A,T,C or G, or insertion/deletion polymorphism (see Tables 1-2)

SEQ ID NO: 18039 - DNA, 201 bp, Homo sapiens; identical to SEQ ID NO: 1678

SEQ ID NO: 18040 - DNA, 201 bp, Homo sapiens; identical to SEQ ID NO: 1679

SEQ ID NO: 18041 - DNA, 201 bp, Homo sapiens; identical to SEQ ID NO: 1680

SEQ ID NO: 18042 - DNA, 201 bp, Homo sapiens; identical to SEQ ID NO: 1681

SEQ ID NO: 18043 - DNA, 201 bp, Homo sapiens; identical to SEQ ID NO: 1682

SEQ ID NO: 18044 - DNA, 201 bp, Homo sapiens; identical to SEQ ID NO: 1683

SEQ ID NO: 18045 - DNA, 201 bp, Homo sapiens; identical to SEQ ID NO: 1684

SEQ ID NO: 18046 - DNA, 201 bp, Homo sapiens; identical to SEQ ID NO: 1685
  misc_feature (1)...(201): n = A,T,C or G, or insertion/deletion polymorphism (see Tables 1-2)

SEQ ID NO: 18047 - DNA, 201 bp, Homo sapiens; identical to SEQ ID NO: 1686

SEQ ID NO: 18048 - DNA, 201 bp, Homo sapiens; identical to SEQ ID NO: 1687
  misc_feature (1)...(201): n = A,T,C or G, or insertion/deletion polymorphism (see Tables 1-2)

SEQ ID NO: 18049 - DNA, 201 bp, Homo sapiens; identical to SEQ ID NO: 1688

SEQ ID NO: 18050 - DNA, 201 bp, Homo sapiens; identical to SEQ ID NO: 1689

SEQ ID NO: 18051 - DNA, 201 bp, Homo sapiens; identical to SEQ ID NO: 1690

SEQ ID NO: 18052 - DNA, 201 bp, Homo sapiens; identical to SEQ ID NO: 1691

SEQ ID NO: 18053 - DNA, 201 bp, Homo sapiens; identical to SEQ ID NO: 1692

SEQ ID NO: 18054 - DNA, 201 bp, Homo sapiens
atttgccaatgagaaatatcaggttactaatttttcttctatttttctagtgccatttccatgtggaagagtttctgtttcacaaacttctaagctcacchgtgctgagactgtttttcctgatgtggactatgtaaattctactgaagctgaaaccattttggataacatcactcaaagcacccaatcatttaatgactt

SEQ ID NO: 18055 - DNA, 201 bp, Homo sapiens; identical to SEQ ID NO: 1694
  misc_feature (1)...(201): n = A,T,C or G, or insertion/deletion polymorphism (see Tables 1-2)

SEQ ID NO: 18056 - DNA, 201 bp, Homo sapiens
  misc_feature (1)...(201): n = A,T,C or G, or insertion/deletion polymorphism (see Tables 1-2)
tttgccaatgagaaatatcaggttactaatttttcttctatttttctagtgccatttccatgtggaagagtttctgtttcacaaacttctaagctcacccntgctgagactgtttttcctgatgtggactatgtaaattctactgaagctgaaaccattttggataacatcactcaaagcacccaatcatttaatgacttc

SEQ ID NO: 18057 - DNA, 201 bp, Homo sapiens
tgccaatgagaaatatcaggttactaatttttcttctatttttctagtgccatttccatgtggaagagtttctgtttcacaaacttctaagctcacccgtsctgagactgtttttcctgatgtggactatgtaaattctactgaagctgaaaccattttggataacatcactcaaagcacccaatcatttaatgacttcac

SEQ ID NO: 18058 - DNA, 201 bp, Homo sapiens
tttcttctatttttctagtgccatttccatgtggaagagtttctgtttcacaaacttctaagctcacccgtgctgagactgtttttcctgatgtggactakgtaaattctactgaagctgaaaccattttggataacatcactcaaagcacccaatcatttaatgacttcactcgggttgttggtggagaagatgccaaac

SEQ ID NO: 18059 - DNA, 201 bp, Homo sapiens; identical to SEQ ID NO: 1698

SEQ ID NO: 18060 - DNA, 201 bp, Homo sapiens
ccgggcattctaagcagtttacgtgccaattcaatttcttaacctatctcaaagatggagatcagtgtgagtccaatccatgtttaaatggcggcagttgmaaggatgacattaattcctatgaatgttggtgtccctttggatttgaaggaaagaactgtgaattaggtaagtaactattttttgaatactcatggttca

SEQ ID NO: 18061 - DNA, 201 bp, Homo sapiens
aatcatattaaagagctagtggtgctgcagattattattctttctgtgtatttacctgcgacaactgtaattttaacaccagtttcaacacagtgggcagvagttacaatccatttttcattaacgatagagcctccacagaatgcatcaactttaccattcaaaacaacctgtgaaaacaaaattaagactcttactgca

SEQ ID NO: 18062 - DNA, 201 bp, Homo sapiens; identical to SEQ ID NO: 1701

SEQ ID NO: 18063 - DNA, 201 bp, Homo sapiens
taccaatcatattaaagagctagtggtgctgcagattattattctttctgtgtatttacctgcgacaactgtaattttaacaccagtttcaacacagtggycagcagttacaatccatttttcattaacgatagagcctccacagaatgcatcaactttaccattcaaaacaacctgtgaaaacaaaattaagactcttac

SEQ ID NO: 18064 - DNA, 201 bp, Homo sapiens
tgtaccaatcatattaaagagctagtggtgctgcagattattattctttctgtgtatttacctgcgacaactgtaattttaacaccagtttcaacacagtyggcagcagttacaatccatttttcattaacgatagagcctccacagaatgcatcaactttaccattcaaaacaacctgtgaaaacaaaattaagactctt

SEQ ID NO: 18065 - DNA, 201 bp, Homo sapiens
ccgtgctgagactgtttttcctgatgtggactatgtaaattctactgaagctgaaaccattttggataacatcactcaaagcacccaatcatttaatgacytcactcgggttgttggtggagaagatgccaaaccaggtcaattcccttggcaggtactttatactgatggtgtgtcaaaactggagctcagctggcaaga

SEQ ID NO: 18066 - DNA, 201 bp, Homo sapiens
tgagactgtttttcctgatgtggactatgtaaattctactgaagctgaaaccattttggataacatcactcaaagcacccaatcatttaatgacttcactbgggttgttggtggagaagatgccaaaccaggtcaattcccttggcaggtactttatactgatggtgtgtcaaaactggagctcagctggcaagacacagg

SEQ ID NO: 18067 - DNA, 201 bp, Homo sapiens; identical to SEQ ID NO: 1706
  misc_feature (1)...(201): n = A,T,C or G, or insertion/deletion polymorphism (see Tables 1-2)

SEQ ID NO: 18068 - DNA, 201 bp, Homo sapiens
tagaccttagtaaaatatggtgtaccaatcatattaaagagctagtggtgctgcagattattattctttctgtgtatttacctgcgacaactgtaattttyacaccagtttcaacacagtgggcagcagttacaatccatttttcattaacgatagagcctccacagaatgcatcaactttaccattcaaaacaacctgtg

SEQ ID NO: 18069 - DNA, 201 bp, Homo sapiens; identical to SEQ ID NO: 1708

SEQ ID NO: 18070 - DNA, 201 bp, Homo sapiens
  misc_feature (1)...(201): n = A,T,C or G, or insertion/deletion polymorphism (see Tables 1-2)
gagactgtttttcctgatgtggactatgtaaattctactgaagctgaaaccattttggataacatcactcaaagcacccaatcatttaatgacttcactcnggttgttggtggagaagatgccaaaccaggtcaattcccttggcaggtactttatactgatggtgtgtcaaaactggagctcagctggcaagacacaggc

SEQ ID NO: 18071 - DNA, 201 bp, Homo sapiens
aacaaaattctgaatcggccaaagaggtataattcaggtaaattggaagagtttgttcaagggaaccttgagagagaatgtatggaagaaaagtgtagttytgaagaagcacgagaagtttttgaaaacactgaaagaacagtgagtatttccacataatacccttcagatgcagagcatagaatagaaaatctttaaaaa

SEQ ID NO: 18072 - DNA, 201 bp, Homo sapiens; identical to SEQ ID NO: 1711

SEQ ID NO: 18073 - DNA, 201 bp, Homo sapiens
gactgtttttcctgatgtggactatgtaaattctactgaagctgaaaccattttggataacatcactcaaagcacccaatcatttaatgacttcactcggkttgttggtggagaagatgccaaaccaggtcaattcccttggcaggtactttatactgatggtgtgtcaaaactggagctcagctggcaagacacaggcca

SEQ ID NO: 18074 - DNA, 201 bp, Homo sapiens
atatttatgtatgttaaatgttataaaagataggaaatcaataccaaaacactttagatattaccgttaatttgtcttcttttattctttatagactgaaktttggaagcagtatgttggtaagcaattcattttatcctctagctaatatatgaaacatatgagaattatgtgggttttttctctgcataaatagataat

SEQ ID NO: 18075 - DNA, 201 bp, Homo sapiens; identical to SEQ ID NO: 1714

SEQ ID NO: 18076 - DNA, 201 bp, Homo sapiens; identical to SEQ ID NO: 1715

SEQ ID NO: 18077 - DNA, 201 bp, Homo sapiens
actgtttttcctgatgtggactatgtaaattctactgaagctgaaaccattttggataacatcactcaaagcacccaatcatttaatgacttcactcgggwtgttggtggagaagatgccaaaccaggtcaattcccttggcaggtactttatactgatggtgtgtcaaaactggagctcagctggcaagacacaggccag

SEQ ID NO: 18078 - DNA, 201 bp, Homo sapiens
ttatgtatgttaaatgttataaaagataggaaatcaataccaaaacactttagatattaccgttaatttgtcttcttttattctttatagactgaattttrgaagcagtatgttggtaagcaattcattttatcctctagctaatatatgaaacatatgagaattatgtgggttttttctctgcataaatagataatatat

SEQ ID NO: 18079 - DNA, 201 bp, Homo sapiens; identical to SEQ ID NO: 1718

SEQ ID NO: 18080 - DNA, 201 bp, Homo sapiens
atgtatgttaaatgttataaaagataggaaatcaataccaaaacactttagatattaccgttaatttgtcttcttttattctttatagactgaattttggragcagtatgttggtaagcaattcattttatcctctagctaatatatgaaacatatgagaattatgtgggttttttctctgcataaatagataatatatta

SEQ ID NO: 18081 - DNA, 201 bp, Homo sapiens; identical to SEQ ID NO: 1720

SEQ ID NO: 18082 - DNA, 201 bp, Homo sapiens
tatgttaaatgttataaaagataggaaatcaataccaaaacactttagatattaccgttaatttgtcttcttttattctttatagactgaattttggaagyagtatgttggtaagcaattcattttatcctctagctaatatatgaaacatatgagaattatgtgggttttttctctgcataaatagataatatattaaac

SEQ ID NO: 18083 - DNA, 201 bp, Homo sapiens; identical to SEQ ID NO: 1722

SEQ ID NO: 18084 - DNA, 201 bp, Homo sapiens; identical to SEQ ID NO: 1723

SEQ ID NO: 18085 - DNA, 201 bp, Homo sapiens; identical to SEQ ID NO: 1724

SEQ ID NO: 18086 - DNA, 201 bp, Homo sapiens; identical to SEQ ID NO: 1994

SEQ ID NO: 18087 - DNA, 201 bp, Homo sapiens
gttaaatgttataaaagataggaaatcaataccaaaacactttagatattaccgttaatttgtcttcttttattctttatagactgaattttggaagcagdatgttggtaagcaattcattttatcctctagctaatatatgaaacatatgagaattatgtgggttttttctctgcataaatagataatatattaaacttt

SEQ ID NO: 18088 - DNA, 201 bp, Homo sapiens; identical to SEQ ID NO: 1727

SEQ ID NO: 18089 - DNA, 201 bp, Homo sapiens
aacttctaagctcacccgtgctgagactgtttttcctgatgtggactatgtaaattctactgaagctgaaaccattttggataacatcactcaaagcaccyaatcatttaatgacttcactcgggttgttggtggagaagatgccaaaccaggtcaattcccttggcaggtactttatactgatggtgtgtcaaaactgga

SEQ ID NO: 18090 - DNA, 201 bp, Homo sapiens; identical to SEQ ID NO: 1729

SEQ ID NO: 18091 - DNA, 201 bp, Homo sapiens; identical to SEQ ID NO: 1730

SEQ ID NO: 18092 - DNA, 201 bp, Homo sapiens; identical to SEQ ID NO: 1731

SEQ ID NO: 18093 - DNA, 201 bp, Homo sapiens; identical to SEQ ID NO: 1732

SEQ ID NO: 18094 - DNA, 201 bp, Homo sapiens; identical to SEQ ID NO: 1733

SEQ ID NO: 18095 - DNA, 201 bp, Homo sapiens; identical to SEQ ID NO: 1734

SEQ ID NO: 18096 - DNA, 201 bp, Homo sapiens; identical to SEQ ID NO: 1735

SEQ ID NO: 18097 - DNA, 201 bp, Homo sapiens; identical to SEQ ID NO: 1736

SEQ ID NO: 18098 - DNA, 201 bp, Homo sapiens; identical to SEQ ID NO: 1737

SEQ ID NO: 18099 - DNA, 201 bp, Homo sapiens
gtgtccaacttccatggataacatggttacaacaaaagatcctactttatgacaattatcttccttgggtttgtgggacatagaacagtgctcagagtagkggatccaagaacccaggagaatatattagctaagaagataacttccgtttttaaaagtccaagattcaggagatcaaaaccatcctggctaacatagtga

SEQ ID NO: 18100 - DNA, 201 bp, Homo sapiens
cttgctttcactattacacctcagggccttcaaatctaaatgcagttattcattaaacaggaacctggtagtcttaaacaggaatctctcacttggtaagrtcttgtctcttgttgtatttgaccccaactgtctatggctttgcctgaacccaaagtacacacagcctagaaaccaaaggagaaccaaatgtgggataaa

SEQ ID NO: 18101 - DNA, 201 bp, Homo sapiens
tctgacatgttttctattgtcttgaaccattactgcatatgatacatcaaagttaagtgacaatacaagaaagcagattcatttgctccctgcctaggccrtcagttcctaaagtggaaacgccatatattatctagctcagtttgctctacaagacctgcaatagagccttgtgtgacatagagataatatttgttgaag

SEQ ID NO: 18102 - DNA, 201 bp, Homo sapiens; identical to SEQ ID NO: 1738

SEQ ID NO: 18103 - DNA, 201 bp, Homo sapiens
tcactcaaccacactgtacagtcagctctccttgtgagttccacagccacagattcaattaactgcagatcaaaaatattcaagaaaaaaatggatggttscatctctactgaacatgtacagactcttttatctttcattattccctaaacaatacagcataacaactatttacatagcatttacattgtattagctatt

SEQ ID NO: 18104 - DNA, 201 bp, Homo sapiens
gaatagcttgaacctgggagatggaggttgcagtgagctgagatcgcaccactgcactccagcctgggcgacagagcaagactctgtcaaaaaaaaaagarttgaagagaaaaagtctaggctaaattcaaagaaaaaaagtgagcccaaaaggaacttgcagagcaagggaaaagcagggatgtcaagggactagaacac

SEQ ID NO: 18105 - DNA, 201 bp, Homo sapiens
gctaaaactaaagaattattcttttacatttcagtttttcttgatcatgaaaacgccaacaaaattctgaatcggccaaagaggtataattcaggtaaatyggaagagtttgttcaagggaaccttgagagagaatgtatggaagaaaagtgtagttttgaagaagcacgagaagtttttgaaaacactgaaagaacagtg

SEQ ID NO: 18106 - DNA, 201 bp, Homo sapiens
ttaaatgttataaaagataggaaatcaataccaaaacactttagatattaccgttaatttgtcttcttttattctttatagactgaattttggaagcagtrtgttggtaagcaattcattttatcctctagctaatatatgaaacatatgagaattatgtgggttttttctctgcataaatagataatatattaaactttg

SEQ ID NO: 18107 - DNA, 201 bp, Homo sapiens
gtaacattaagaatggcagatgcgagcagttttgtaaaaatagtgctgataacaaggtggtttgctcctgtactgagggatatcgacttgcagaaaaccakaagtcctgtgaaccagcaggtcataatctgaataagattttttaaagaaaatctgtatctgaaacttcagcattttaacaaacctacataattttaattc

SEQ ID NO: 18108 - DNA, 201 bp, Homo sapiens; identical to SEQ ID NO: 1741

SEQ ID NO: 18109 - DNA, 201 bp, Homo sapiens
attaagaatggcagatgcgagcagttttgtaaaaatagtgctgataacaaggtggtttgctcctgtactgagggatatcgacttgcagaaaaccagaagtsctgtgaaccagcaggtcataatctgaataagattttttaaagaaaatctgtatctgaaacttcagcattttaacaaacctacataattttaattcctact

SEQ ID NO: 18110 - DNA, 201 bp, Homo sapiens; identical to SEQ ID NO: 1742

SEQ ID NO: 18111 - DNA, 201 bp, Homo sapiens
cattaagaatggcagatgcgagcagttttgtaaaaatagtgctgataacaaggtggtttgctcctgtactgagggatatcgacttgcagaaaaccagaagycctgtgaaccagcaggtcataatctgaataagattttttaaagaaaatctgtatctgaaacttcagcattttaacaaacctacataattttaattcctac

SEQ ID NO: 18112 - DNA, 201 bp, Homo sapiens; identical to SEQ ID NO: 1743

SEQ ID NO: 18113 - DNA, 201 bp, Homo sapiens
taagaatggcagatgcgagcagttttgtaaaaatagtgctgataacaaggtggtttgctcctgtactgagggatatcgacttgcagaaaaccagaagtccygtgaaccagcaggtcataatctgaataagattttttaaagaaaatctgtatctgaaacttcagcattttaacaaacctacataattttaattcctacttg

SEQ ID NO: 18114 - DNA, 201 bp, Homo sapiens; identical to SEQ ID NO: 1744

SEQ ID NO: 18115 - DNA, 201 bp, Homo sapiens
aagaatggcagatgcgagcagttttgtaaaaatagtgctgataacaaggtggtttgctcctgtactgagggatatcgacttgcagaaaaccagaagtcctdtgaaccagcaggtcataatctgaataagattttttaaagaaaatctgtatctgaaacttcagcattttaacaaacctacataattttaattcctacttga

SEQ ID NO: 18116 - DNA, 201 bp, Homo sapiens; identical to SEQ ID NO: 1745

SEQ ID NO: 18117 - DNA, 201 bp, Homo sapiens
agatgcgagcagttttgtaaaaatagtgctgataacaaggtggtttgctcctgtactgagggatatcgacttgcagaaaaccagaagtcctgtgaaccagyaggtcataatctgaataagattttttaaagaaaatctgtatctgaaacttcagcattttaacaaacctacataattttaattcctacttgaatctgcttc

SEQ ID NO: 18118 - DNA, 201 bp, Homo sapiens; identical to SEQ ID NO: 1746

SEQ ID NO: 18119 - DNA, 201 bp, Homo sapiens
atgcgagcagttttgtaaaaatagtgctgataacaaggtggtttgctcctgtactgagggatatcgacttgcagaaaaccagaagtcctgtgaaccagcargtcataatctgaataagattttttaaagaaaatctgtatctgaaacttcagcattttaacaaacctacataattttaattcctacttgaatctgcttcct

SEQ ID NO: 18120 - DNA, 201 bp, Homo sapiens; identical to SEQ ID NO: 1747

SEQ ID NO: 18121 - DNA, 201 bp, Homo sapiens; identical to SEQ ID NO: 1748

SEQ ID NO: 18122 - DNA, 201 bp, Homo sapiens
caaggatgggcctcaatctcaatttttgtaatacatgttccatttgccaatgagaaatatcaggttactaatttttcttctatttttctagtgccatttcyatgtggaagagtttctgtttcacaaacttctaagctcacccgtgctgagactgtttttcctgatgtggactatgtaaattctactgaagctgaaaccatt

SEQ ID NO: 18123 - DNA, 201 bp, Homo sapiens; identical to SEQ ID NO: 1749

SEQ ID NO: 18124 - DNA, 201 bp, Homo sapiens; identical to SEQ ID NO: 1750

SEQ ID NO: 18125 - DNA, 201 bp, Homo sapiens; identical to SEQ ID NO: 1751

SEQ ID NO: 18126 - DNA, 201 bp, Homo sapiens
acaaggatgggcctcaatctcaatttttgtaatacatgttccatttgccaatgagaaatatcaggttactaatttttcttctatttttctagtgccatttycatgtggaagagtttctgtttcacaaacttctaagctcacccgtgctgagactgtttttcctgatgtggactatgtaaattctactgaagctgaaaccat

SEQ ID NO: 18127 - DNA, 201 bp, Homo sapiens; identical to SEQ ID NO: 1752

SEQ ID NO: 18128 - DNA, 201 bp, Homo sapiens; identical to SEQ ID NO: 1753

SEQ ID NO: 18129 - DNA, 201 bp, Homo sapiens; identical to SEQ ID NO: 1754

SEQ ID NO: 18130 - DNA, 201 bp, Homo sapiens; identical to SEQ ID NO: 1755

SEQ ID NO: 18131 - DNA, 201 bp, Homo sapiens; identical to SEQ ID NO: 1756

SEQ ID NO: 18132 - DNA, 201 bp, Homo sapiens; identical to SEQ ID NO: 1757

SEQ ID NO: 18133 - DNA, 201 bp, Homo sapiens; identical to SEQ ID NO: 1758

SEQ ID NO: 18134 - DNA, 201 bp, Homo sapiens; identical to SEQ ID NO: 1759

SEQ ID NO: 18135 - DNA, 201 bp, Homo sapiens; identical to SEQ ID NO: 1760

SEQ ID NO: 18136 - DNA, 201 bp, Homo sapiens; identical to SEQ ID NO: 1761

SEQ ID NO: 18137 - DNA, 201 bp, Homo sapiens
ctaggaatatatatcctgcaaataaaatgaagaatctctaaggcttcagggcctgcccacttgttcttctgcctggttcttcacatacactgtctcaaagstagtctaccttgagaggagcatgaatatgtgtgtgggtgtgtgtctgtgtattttaaccttaaaaacctaacttccagtatagacagatggcatactagc

SEQ ID NO: 18138 - DNA, 201 bp, Homo sapiens
aggatgggcctcaatctcaatttttgtaatacatgttccatttgccaatgagaaatatcaggttactaatttttcttctatttttctagtgccatttccabgtggaagagtttctgtttcacaaacttctaagctcacccgtgctgagactgtttttcctgatgtggactatgtaaattctactgaagctgaaaccatttt

SEQ ID NO: 18139 - DNA, 201 bp, Homo sapiens
  misc_feature (1)...(201): n = A,T,C or G, or insertion/deletion polymorphism (see Tables 1-2)
ggatgggcctcaatctcaatttttgtaatacatgttccatttgccaatgagaaatatcaggttactaatttttcttctatttttctagtgccatttccatntggaagagtttctgtttcacaaacttctaagctcacccgtgctgagactgtttttcctgatgtggactatgtaaattctactgaagctgaaaccattttg

SEQ ID NO: 18140 - DNA, 201 bp, Homo sapiens
gatgggcctcaatctcaatttttgtaatacatgttccatttgccaatgagaaatatcaggttactaatttttcttctatttttctagtgccatttccatgkggaagagtttctgtttcacaaacttctaagctcacccgtgctgagactgtttttcctgatgtggactatgtaaattctactgaagctgaaaccattttgg

SEQ ID NO: 18141 - DNA, 201 bp, Homo sapiens; identical to SEQ ID NO: 1762

SEQ ID NO: 18142 - DNA, 201 bp, Homo sapiens; identical to SEQ ID NO: 1763

SEQ ID NO: 18143 - DNA, 201 bp, Homo sapiens
tctacctttccttgatcttagaaacgaatactaccataccagcttctactgaggtgccccctaaagttagtccaaataggtctttgcaatctccattcccrcagaatttagaactttgaatcacatgatttatttctaaaagtaaatccatgccgattttccccaccaaaaaattcctgactattaaactcctacaatccc

SEQ ID NO: 18144 - DNA, 201 bp, Homo sapiens
atgggcctcaatctcaatttttgtaatacatgttccatttgccaatgagaaatatcaggttactaatttttcttctatttttctagtgccatttccatgtrgaagagtttctgtttcacaaacttctaagctcacccgtgctgagactgtttttcctgatgtggactatgtaaattctactgaagctgaaaccattttgga

SEQ ID NO: 18145 - DNA, 201 bp, Homo sapiens; identical to SEQ ID NO: 1764
  misc_feature (1)...(201): n = A,T,C or G, or insertion/deletion polymorphism (see Tables 1-2)

SEQ ID NO: 18146 - DNA, 201 bp, Homo sapiens
atttccacataatacccttcagatgcagagcatagaatagaaaatctttaaaaagacacttctctttaaaattttaaagcatccatatatatttatgtatkttaaatgttataaaagataggaaatcaataccaaaacactttagatattaccgttaatttgtcttcttttattctttatagactgaattttggaagcagt

SEQ ID NO: 18147 - DNA, 201 bp, Homo sapiens
tgggcctcaatctcaatttttgtaatacatgttccatttgccaatgagaaatatcaggttactaatttttcttctatttttctagtgccatttccatgtgraagagtttctgtttcacaaacttctaagctcacccgtgctgagactgtttttcctgatgtggactatgtaaattctactgaagctgaaaccattttggat

SEQ ID NO: 18148 - DNA, 201 bp, Homo sapiens; identical to SEQ ID NO: 1766

SEQ ID NO: 18149 - DNA, 201 bp, Homo sapiens
tcaacaacaattttattagaccttagtaaaatatggtgtaccaatcatattaaagagctagtggtgctgcagattattattctttctgtgtatttacctgrgacaactgtaattttaacaccagtttcaacacagtgggcagcagttacaatccatttttcattaacgatagagcctccacagaatgcatcaactttacca

SEQ ID NO: 18150 - DNA, 201 bp, Homo sapiens
ttaacattgccaattaggtcagtggtcccaagtagtcacttagaaaatctgtgtatgtgaaatactgtttgtgacttaaaatgaaatttatttttaatagbtgaacataatattgaggagacagaacatacagagcaaaagcgaaatgtgattcgaattattcctcaccacaactacaatgcagctattaataagtacaac

SEQ ID NO: 18151 - DNA, 201 bp, Homo sapiens; identical to SEQ ID NO: 1768
  misc_feature (1)...(201): n = A,T,C or G, or insertion/deletion polymorphism (see Tables 1-2)

SEQ ID NO: 18152 - DNA, 201 bp, Homo sapiens; identical to SEQ ID NO: 1769

SEQ ID NO: 18153 - DNA, 201 bp, Homo sapiens
atattttaaagttgggcccttgccttttgggtcacataggtacactgtttgctataccacaggtatagctatctggaaaacatggagggtattattctgtwactactgcttcgtcaaccaaaaaataaaacaaaacaagaacaaaaaagaaacaaactccctgcctcttttcacttgcagtcaaggttcctaaccactaca

SEQ ID NO: 18154 - DNA, 201 bp, Homo sapiens; identical to SEQ ID NO: 1770

SEQ ID NO: 18155 - DNA, 201 bp, Homo sapiens
ttgccaattaggtcagtggtcccaagtagtcacttagaaaatctgtgtatgtgaaatactgtttgtgacttaaaatgaaatttatttttaataggtgaacrtaatattgaggagacagaacatacagagcaaaagcgaaatgtgattcgaattattcctcaccacaactacaatgcagctattaataagtacaaccatgac

SEQ ID NO: 18156 - DNA, 201 bp, Homo sapiens; identical to SEQ ID NO: 1772

SEQ ID NO: 18157 - DNA, 201 bp, Homo sapiens; identical to SEQ ID NO: 1775

SEQ ID NO: 18158 - DNA, 201 bp, Homo sapiens; identical to SEQ ID NO: 1774

SEQ ID NO: 18159 - DNA, 201 bp, Homo sapiens
gccaattaggtcagtggtcccaagtagtcacttagaaaatctgtgtatgtgaaatactgtttgtgacttaaaatgaaatttatttttaataggtgaacatratattgaggagacagaacatacagagcaaaagcgaaatgtgattcgaattattcctcaccacaactacaatgcagctattaataagtacaaccatgacat

SEQ ID NO: 18160 - DNA, 201 bp, Homo sapiens; identical to SEQ ID NO: 1778
  misc_feature (1)...(201): n = A,T,C or G, or insertion/deletion polymorphism (see Tables 1-2)

SEQ ID NO: 18161 - DNA, 201 bp, Homo sapiens
attaggtcagtggtcccaagtagtcacttagaaaatctgtgtatgtgaaatactgtttgtgacttaaaatgaaatttatttttaataggtgaacataatawtgaggagacagaacatacagagcaaaagcgaaatgtgattcgaattattcctcaccacaactacaatgcagctattaataagtacaaccatgacattgcc

SEQ ID NO: 18162 - DNA, 201 bp, Homo sapiens; identical to SEQ ID NO: 1776

SEQ ID NO: 18163 - DNA, 201 bp, Homo sapiens; identical to SEQ ID NO: 1779
  misc_feature (1)...(201): n = A,T,C or G, or insertion/deletion polymorphism (see Tables 1-2)

SEQ ID NO: 18164 - DNA, 201 bp, Homo sapiens; identical to SEQ ID NO: 1782

SEQ ID NO: 18165 - DNA, 201 bp, Homo sapiens; identical to SEQ ID NO: 1781

SEQ ID NO: 18166 - DNA, 201 bp, Homo sapiens; identical to SEQ ID NO: 1780

SEQ ID NO: 18167 - DNA, 201 bp, Homo sapiens; identical to SEQ ID NO: 1784

SEQ ID NO: 18168 - DNA, 201 bp, Homo sapiens; identical to SEQ ID NO: 1783

SEQ ID NO: 18169 - DNA, 201 bp, Homo sapiens
aatccatgtttaaatggcggcagttgcaaggatgacattaattcctatgaatgttggtgtccctttggatttgaaggaaagaactgtgaattaggtaagtractattttttgaatactcatggttcaaagtttccctctgaaacaagttgaaactggaaaatgcaatattggtgtatcataatttttcttaaaaacatacc

SEQ ID NO: 18170 - DNA, 201 bp, Homo sapiens; identical to SEQ ID NO: 1785

SEQ ID NO: 18171 - DNA, 201 bp, Homo sapiens; identical to SEQ ID NO: 1786

SEQ ID NO: 18172 - DNA, 201 bp, Homo sapiens; identical to SEQ ID NO: 1787

SEQ ID NO: 18173 - DNA, 201 bp, Homo sapiens
ctgcagattattattctttctgtgtatttacctgcgacaactgtaattttaacaccagtttcaacacagtgggcagcagttacaatccatttttcattaakgatagagcctccacagaatgcatcaactttaccattcaaaacaacctgtgaaaacaaaattaagactcttactgcataatacatttgatctagaaaaaaa

SEQ ID NO: 18174 - DNA, 201 bp, Homo sapiens; identical to SEQ ID NO: 1789

SEQ ID NO: 18175 - DNA, 201 bp, Homo sapiens
agaaaatctgtgtatgtgaaatactgtttgtgacttaaaatgaaatttatttttaataggtgaacataatattgaggagacagaacatacagagcaaaagbgaaatgtgattcgaattattcctcaccacaactacaatgcagctattaataagtacaaccatgacattgcccttctggaactggacgaacccttagtgct

SEQ ID NO: 18176 - DNA, 201 bp, Homo sapiens
gaaaatctgtgtatgtgaaatactgtttgtgacttaaaatgaaatttatttttaataggtgaacataatattgaggagacagaacatacagagcaaaagcraaatgtgattcgaattattcctcaccacaactacaatgcagctattaataagtacaaccatgacattgcccttctggaactggacgaacccttagtgcta

SEQ ID NO: 18177 - DNA, 201 bp, Homo sapiens; identical to SEQ ID NO: 1792

SEQ ID NO: 18178 - DNA, 201 bp, Homo sapiens
tctgtgtatgtgaaatactgtttgtgacttaaaatgaaatttatttttaataggtgaacataatattgaggagacagaacatacagagcaaaagcgaaatrtgattcgaattattcctcaccacaactacaatgcagctattaataagtacaaccatgacattgcccttctggaactggacgaacccttagtgctaaacag

SEQ ID NO: 18179 - DNA, 201 bp, Homo sapiens; identical to SEQ ID NO: 1794

SEQ ID NO: 18180 - DNA, 201 bp, Homo sapiens
tgtatgtgaaatactgtttgtgacttaaaatgaaatttatttttaataggtgaacataatattgaggagacagaacatacagagcaaaagcgaaatgtgawtcgaattattcctcaccacaactacaatgcagctattaataagtacaaccatgacattgcccttctggaactggacgaacccttagtgctaaacagctac

SEQ ID NO: 18181 - DNA, 201 bp, Homo sapiens
tatgtgaaatactgtttgtgacttaaaatgaaatttatttttaataggtgaacataatattgaggagacagaacatacagagcaaaagcgaaatgtgattygaattattcctcaccacaactacaatgcagctattaataagtacaaccatgacattgcccttctggaactggacgaacccttagtgctaaacagctacgt

SEQ ID NO: 18182 - DNA, 201 bp, Homo sapiens; identical to SEQ ID NO: 1797

SEQ ID NO: 18183 - DNA, 201 bp, Homo sapiens
tttcttttttgctaaaactaaagaattattcttttacatttcagtttttcttgatcatgaaaacgccaacaaaattctgaatcggccaaagaggtataatycaggtaaattggaagagtttgttcaagggaaccttgagagagaatgtatggaagaaaagtgtagttttgaagaagcacgagaagtttttgaaaacactga

SEQ ID NO: 18184 - DNA, 201 bp, Homo sapiens; identical to SEQ ID NO: 1799

SEQ ID NO: 18185 - DNA, 201 bp, Homo sapiens; identical to SEQ ID NO: 1800

SEQ ID NO: 18186 - DNA, 201 bp, Homo sapiens; identical to SEQ ID NO: 1801

SEQ ID NO: 18187 - DNA, 201 bp, Homo sapiens; identical to SEQ ID NO: 1802

SEQ ID NO: 18188 - DNA, 201 bp, Homo sapiens; identical to SEQ ID NO: 1803

SEQ ID NO: 18189 - DNA, 201 bp, Homo sapiens; identical to SEQ ID NO: 1804

SEQ ID NO: 18190 - DNA, 201 bp, Homo sapiens; identical to SEQ ID NO: 1805

SEQ ID NO: 18191 - DNA, 201 bp, Homo sapiens; identical to SEQ ID NO: 1806

SEQ ID NO: 18192 - DNA, 201 bp, Homo sapiens; identical to SEQ ID NO: 1807

SEQ ID NO: 18193 - DNA, 201 bp, Homo sapiens; identical to SEQ ID NO: 1808

SEQ ID NO: 18194 - DNA, 201 bp, Homo sapiens; identical to SEQ ID NO: 1809

SEQ ID NO: 18195 - DNA, 201 bp, Homo sapiens; identical to SEQ ID NO: 1810

SEQ ID NO: 18196 - DNA, 201 bp, Homo sapiens; identical to SEQ ID NO: 1811

SEQ ID NO: 18197 - DNA, 201 bp, Homo sapiens; identical to SEQ ID NO: 1812

SEQ ID NO: 18198 - DNA, 201 bp, Homo sapiens; identical to SEQ ID NO: 1813

SEQ ID NO: 18199 - DNA, 201 bp, Homo sapiens; identical to SEQ ID NO: 1814

SEQ ID NO: 18200 - DNA, 201 bp, Homo sapiens; identical to SEQ ID NO: 1815

SEQ ID NO: 18201 - DNA, 201 bp, Homo sapiens
atttttaataggtgaacataatattgaggagacagaacatacagagcaaaagcgaaatgtgattcgaattattcctcaccacaactacaatgcagctattwataagtacaaccatgacattgcccttctggaactggacgaacccttagtgctaaacagctacgttacacctatttgcattgctgacaaggaatacacgaa

SEQ ID NO: 18202 - DNA, 201 bp, Homo sapiens
catgatgttttcttttttgctaaaactaaagaattattcttttacatttcagtttttcttgatcatgaaaacgccaacaaaattctgaatcggccaaagasgtataattcaggtaaattggaagagtttgttcaagggaaccttgagagagaatgtatggaagaaaagtgtagttttgaagaagcacgagaagtttttgaa

SEQ ID NO: 18203 - DNA, 201 bp, Homo sapiens
tattaaagagctagtggtgctgcagattattattctttctgtgtatttacctgcgacaactgtaattttaacaccagtttcaacacagtgggcagcagttwcaatccatttttcattaacgatagagcctccacagaatgcatcaactttaccattcaaaacaacctgtgaaaacaaaattaagactcttactgcataata

SEQ ID NO: 18204 - DNA, 201 bp, Homo sapiens; identical to SEQ ID NO: 1819

SEQ ID NO: 18205 - DNA, 201 bp, Homo sapiens
cttaaaatgaaatttatttttaataggtgaacataatattgaggagacagaacatacagagcaaaagcgaaatgtgattcgaattattcctcaccacaacwacaatgcagctattaataagtacaaccatgacattgcccttctggaactggacgaacccttagtgctaaacagctacgttacacctatttgcattgctga

SEQ ID NO: 18206 - DNA, 201 bp, Homo sapiens
ccaaaaatacaaaaaattagcccggcgtggtggcaggcgcctatagtcccagctacacgggaggctgaggcaggagaatggcgtgaaccggggaggcggarctggcagtgagccgagatcccgccactgcactccagcctgggcgacagagcgagactccgtctcaaaaaaaaaaaaaaaaaaaaagtccaagattaaaaa

SEQ ID NO: 18207 - DNA, 201 bp, Homo sapiens; identical to SEQ ID NO: 1821

SEQ ID NO: 18208 - DNA, 201 bp, Homo sapiens
tgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaa

SEQ ID NO: 18209 - DNA, 201 bp, Homo sapiens
gttctggttcataccttggctttttgtggattccattgatgtgaatcagtcaccctgtatttgatgatgcatgggactactgacaaaatcactctgacccygccaagctgctgccttctcctgccccaacctcacccccagccaggcctcactcttgctagttcctttagttcttttagtcaatatatttttgtcttcgca

SEQ ID NO: 18210 - DNA, 201 bp, Homo sapiens; identical to SEQ ID NO: 1822

SEQ ID NO: 18211 - DNA, 201 bp, Homo sapiens
ggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaa

SEQ ID NO: 18212 - DNA, 201 bp, Homo sapiens; identical to SEQ ID NO: 1823

SEQ ID NO: 18213 - DNA, 201 bp, Homo sapiens; identical to SEQ ID NO: 1824

SEQ ID NO: 18214 - DNA, 201 bp, Homo sapiens
atggacattatttcccagaagtaaatacagctcagcttgtactttggtacaactaatcgaccttaccactttcacaatctgctagcaaaggttatgcagcrcgtgaacatgatcatggcagaatcaccaggcctcatcaccatctgccttttaggatatctactcagtgctgaatgtacaggtttgtttccttttttaaaa

SEQ ID NO: 18215 - DNA, 201 bp, Homo sapiens; identical to SEQ ID NO: 1826

SEQ ID NO: 18216 - DNA, 201 bp, Homo sapiens
ttcccagaagtaaatacagctcagcttgtactttggtacaactaatcgaccttaccactttcacaatctgctagcaaaggttatgcagcgcgtgaacatgwtcatggcagaatcaccaggcctcatcaccatctgccttttaggatatctactcagtgctgaatgtacaggtttgtttccttttttaaaatacattgagta

SEQ ID NO: 18217 - DNA, 201 bp, Homo sapiens; identical to SEQ ID NO: 1828

SEQ ID NO: 18218 - DNA, 201 bp, Homo sapiens; identical to SEQ ID NO: 1829

SEQ ID NO: 18219 - DNA, 201 bp, Homo sapiens; identical to SEQ ID NO: 1830

SEQ ID NO: 18220 - DNA, 201 bp, Homo sapiens; identical to SEQ ID NO: 1831

SEQ ID NO: 18221 - DNA, 201 bp, Homo sapiens; identical to SEQ ID NO: 1832

SEQ ID NO: 18222 - DNA, 201 bp, Homo sapiens; identical to SEQ ID NO: 1833

SEQ ID NO: 18223 - DNA, 201 bp, Homo sapiens; identical to SEQ ID NO: 1834

SEQ ID NO: 18224 - DNA, 201 bp, Homo sapiens; identical to SEQ ID NO: 1835

SEQ ID NO: 18225 - DNA, 201 bp, Homo sapiens; identical to SEQ ID NO: 1836

SEQ ID NO: 18226 - DNA, 201 bp, Homo sapiens; identical to SEQ ID NO: 1837

SEQ ID NO: 18227 - DNA, 201 bp, Homo sapiens; identical to SEQ ID NO: 1838

SEQ ID NO: 18228 - DNA, 201 bp, Homo sapiens
taaaactaaagaattattcttttacatttcagtttttcttgatcatgaaaacgccaacaaaattctgaatcggccaaagaggtataattcaggtaaattgraagagtttgttcaagggaaccttgagagagaatgtatggaagaaaagtgtagttttgaagaagcacgagaagtttttgaaaacactgaaagaacagtgag

SEQ ID NO: 18229 - DNA, 201 bp, Homo sapiens; identical to SEQ ID NO: 1840

SEQ ID NO: 18230 - DNA, 201 bp, Homo sapiens; identical to SEQ ID NO: 1841

SEQ ID NO: 18231 - DNA, 201 bp, Homo sapiens; identical to SEQ ID NO: 1842

SEQ ID NO: 18232 - DNA, 201 bp, Homo sapiens; identical to SEQ ID NO: 1843

SEQ ID NO: 18233 - DNA, 201 bp, Homo sapiens; identical to SEQ ID NO: 1844

SEQ ID NO: 18234 - DNA, 201 bp, Homo sapiens; identical to SEQ ID NO: 1845

SEQ ID NO: 18235 - DNA, 201 bp, Homo sapiens; identical to SEQ ID NO: 1846

SEQ ID NO: 18236 - DNA, 201 bp, Homo sapiens; identical to SEQ ID NO: 1847

SEQ ID NO: 18237 - DNA, 201 bp, Homo sapiens; identical to SEQ ID NO: 1848

SEQ ID NO: 18238 - DNA, 201 bp, Homo sapiens
ttctatataagtggtgagatgatgaaggttgtaagagggcttctgcccccttgaagacttcagatgctggggaaaggatagataagaataaggatgaaccwggcttttggagcctgggaaataatgactagcgataaacctgaagggaagttaagtatacgatccccagataatactaaggagaaaggcaatgtgattctg

SEQ ID NO: 18239 - DNA, 201 bp, Homo sapiens
tggaattttgaaattaaaacagttctgtaaaaccagtttagttttgtaaagtgtatgcatcaaagatgtccttcattcagacattactgagttacaactayggtgccaggtactgtgtcagggtactaggggtatggggataaaccagactccctctttgatctaaagcagcatgaggccaggtgagaggtttcaatataa

SEQ ID NO: 18240 - DNA, 201 bp, Homo sapiens; identical to SEQ ID NO: 1849

SEQ ID NO: 18241 - DNA, 201 bp, Homo sapiens; identical to SEQ ID NO: 1850

SEQ ID NO: 18242 - DNA, 201 bp, Homo sapiens
ttttcatctgggtcttaaaagatgagtaggcgttctctctctttaaatgtctgatataagggcattttatgcaaagaggatcactcgtgcaaagactcagmtttgcaagaacgtgaggtatttcaggagttttgtatggttccatatggactatgacaagtgagacaggtaaactaggcagagctggtcatcagataatga

SEQ ID NO: 18243 - DNA, 201 bp, Homo sapiens; identical to SEQ ID NO: 1851

SEQ ID NO: 18244 - DNA, 201 bp, Homo sapiens; identical to SEQ ID NO: 1852

SEQ ID NO: 18245 - DNA, 201 bp, Homo sapiens; identical to SEQ ID NO: 1853

SEQ ID NO: 18246 - DNA, 201 bp, Homo sapiens
ctgctctagaaacagaaataggctcaagagcagagcctgtttttcttaattcagcaggtctaagctaacaagtcctgaaacatggtacttcctgttattgrtattgcataggagaaacaaagggaaagcacagtaattagaaaatacaaaacaagatggcaggaataagccaaaaatatcaggaaacacaattattgtgaa

SEQ ID NO: 18247 - DNA, 201 bp, Homo sapiens
taaagtgaacagctgcaatgaaaataagggaagaaagtttagttcatctccgtttctttcctttcctttttactttcctttctcttcctttttggagttartcaggaagtagtcccaaataccccagaaagttcatcttataagcccttggtcctcttgagatggtatcagatatattgctagacccttgaagaaaggaac

SEQ ID NO: 18248 - DNA, 201 bp, Homo sapiens; identical to SEQ ID NO: 1854

SEQ ID NO: 18249 - DNA, 201 bp, Homo sapiens
tctagacacctgtacagaactccactctactttttaacagagcttttcaccatctaatgtatcatataatttcttactcatactatttatcatttattttytcctactccactaaaatgcaagtttcatgttggcagggatattcaattgttttgtttattgatatattcctagcacctagaacagtatctggaaaagagg

SEQ ID NO: 18250 - DNA, 201 bp, Homo sapiens; identical to SEQ ID NO: 1855

SEQ ID NO: 18251 - DNA, 201 bp, Homo sapiens; identical to SEQ ID NO: 1856

SEQ ID NO: 18252 - DNA, 201 bp, Homo sapiens; identical to SEQ ID NO: 1857

SEQ ID NO: 18253 - DNA, 201 bp, Homo sapiens; identical to SEQ ID NO: 1858

SEQ ID NO: 18254 - DNA, 201 bp, Homo sapiens; identical to SEQ ID NO: 1859

SEQ ID NO: 18255 - DNA, 201 bp, Homo sapiens; identical to SEQ ID NO: 1860

SEQ ID NO: 18256 - DNA, 201 bp, Homo sapiens; identical to SEQ ID NO: 1861

SEQ ID NO: 18257 - DNA, 201 bp, Homo sapiens; identical to SEQ ID NO: 1862

SEQ ID NO: 18258 - DNA, 201 bp, Homo sapiens; identical to SEQ ID NO: 1863

SEQ ID NO: 18259 - DNA, 201 bp, Homo sapiens
caattcaatttcttaacctatctcaaagatggagatcagtgtgagtccaatccatgtttaaatggcggcagttgcaaggatgacattaattcctatgaatvttggtgtccctttggatttgaaggaaagaactgtgaattaggtaagtaactattttttgaatactcatggttcaaagtttccctctgaaacaagttgaaa

SEQ ID NO: 18260 - DNA, 201 bp, Homo sapiens
agtttacgtgccaattcaatttcttaacctatctcaaagatggagatcagtgtgagtccaatccatgtttaaatggcggcagttgcaaggatgacattaawtcctatgaatgttggtgtccctttggatttgaaggaaagaactgtgaattaggtaagtaactattttttgaatactcatggttcaaagtttccctctgaa

SEQ ID NO: 18261 - DNA, 201 bp, Homo sapiens; identical to SEQ ID NO: 1866

SEQ ID NO: 18262 - DNA, 201 bp, Homo sapiens; identical to SEQ ID NO: 1867

SEQ ID NO: 18263 - DNA, 201 bp, Homo sapiens; identical to SEQ ID NO: 1868

SEQ ID NO: 18264 - DNA, 201 bp, Homo sapiens
gtgtaccaatcatattaaagagctagtggtgctgcagattattattctttctgtgtatttacctgcgacaactgtaattttaacaccagtttcaacacagrgggcagcagttacaatccatttttcattaacgatagagcctccacagaatgcatcaactttaccattcaaaacaacctgtgaaaacaaaattaagactct

SEQ ID NO: 18265 - DNA, 201 bp, Homo sapiens
ttttcatgatgttttcttttttgctaaaactaaagaattattcttttacatttcagtttttcttgatcatgaaaacgccaacaaaattctgaatcggccawagaggtataattcaggtaaattggaagagtttgttcaagggaaccttgagagagaatgtatggaagaaaagtgtagttttgaagaagcacgagaagtttt

SEQ ID NO: 18266 - DNA, 201 bp, Homo sapiens; identical to SEQ ID NO: 1871

SEQ ID NO: 18267 - DNA, 201 bp, Homo sapiens
ttcttttttgctaaaactaaagaattattcttttacatttcagtttttcttgatcatgaaaacgccaacaaaattctgaatcggccaaagaggtataattsaggtaaattggaagagtttgttcaagggaaccttgagagagaatgtatggaagaaaagtgtagttttgaagaagcacgagaagtttttgaaaacactgaa

SEQ ID NO: 18268 - DNA, 201 bp, Homo sapiens
tatgagaattatgtgggttttttctctgcataaatagataatatattaaactttgtcaaaaggactcagaaagatcagtccaaccctctaacccatattgratggtgatatactacagggttatgccagtgtgggaactatcgctggtaaataagtttaatcctccctagggcttcacaaagaacattgttccaccccagg

SEQ ID NO: 18269 - DNA, 201 bp, Homo sapiens
cttagaacctaatgaaagtttgcattcctcagtaaaatcagagactgctgattgacttaaatgtttatagcttcaaagtcctcctcattatcatggcccasaagcccttccatgattgtccttccccaccctccccattacccttcttgcctcctctgctacttctctcctcgcacactgggctccagccaccctggcctt

SEQ ID NO: 18270 - DNA, 201 bp, Homo sapiens
ttctcagtttcccccttttccctcattctttgattcttattgttatctttatctcttactcctttgtttctcatatattgagtcttacagatcaagctccyatttttttcttcaggggtatttttctagttcaaagtgcctaccatctcccttctggttctattcatccttctctcccaaagctcctttagaagtgtggat

SEQ ID NO: 18271 - DNA, 201 bp, Homo sapiens
catataatgggaattctccacatgtacaaaccacttcatatgctaaacttgttgacaacattcaaagctcatccctgaatttgactatattgattacatcraaaatgttacatagcaaccttagaatccttgtgtaccttttcttctcaaagcctagattatttctttttccgacgtttcagtaattggagcagtaaaccc

SEQ ID NO: 18272 - DNA, 201 bp, Homo sapiens
gcctccagctccattcatattcccacaaaagacataatctccttcttttctatggctgcataatattccatggtatatatgaaccacattttctttatccrgtctgtcattgatgggcatttaggttgattccatgtctgctattctaacactgtaatttctaaagacttccagattctacttttataggtaacctgttaa

SEQ ID NO: 18273 - DNA, 201 bp, Homo sapiens
agaactggcaagaactgtttactgtgttagaagtccaggtaatggtaacctataaaaaggaaaaagggtggaatgattgggagggggcatcttctggggtmttgataatgtgctatgtattggtcagtttagtgtttaaacaggctcatttactttgtgaaaacttacactaaaattgtgtgtattttttgaatatatgtt

SEQ ID NO: 18274 - DNA, 201 bp, Homo sapiens
cttggtgtcagaatgattccggcaatgaactgttttatgttctgctaggctgatcagcacaatctatatggctgtgaacaaaacaatgtttcccagtcatrccaaccatgccaccattttaacagctgattagtgtattcagaacatctccactccatgttcgtatggctgttatctaaagatgaaagcagtagacacttt

SEQ ID NO: 18275 - DNA, 201 bp, Homo sapiens
tctcataactcataactcctccacttttgtttttaaatcatgagagaaaaagagttgactctgttatattgttttatctacctttccttgatcttagaaaygaatactaccataccagcttctactgaggtgccccctaaagttagtccaaataggtctttgcaatctccattcccgcagaatttagaactttgaatcaca

SEQ ID NO: 18276 - DNA, 201 bp, Homo sapiens; identical to SEQ ID NO: 1873

SEQ ID NO: 18277 - DNA, 201 bp, Homo sapiens
ctaaagaattattcttttacatttcagtttttcttgatcatgaaaacgccaacaaaattctgaatcggccaaagaggtataattcaggtaaattggaagastttgttcaagggaaccttgagagagaatgtatggaagaaaagtgtagttttgaagaagcacgagaagtttttgaaaacactgaaagaacagtgagtattt

SEQ ID NO: 18278 - DNA, 201 bp, Homo sapiens
gtttttcttgatcatgaaaacgccaacaaaattctgaatcggccaaagaggtataattcaggtaaattggaagagtttgttcaagggaaccttgagagagmatgtatggaagaaaagtgtagttttgaagaagcacgagaagtttttgaaaacactgaaagaacagtgagtatttccacataatacccttcagatgcagag

SEQ ID NO: 18279 - DNA, 201 bp, Homo sapiens
gatcatgaaaacgccaacaaaattctgaatcggccaaagaggtataattcaggtaaattggaagagtttgttcaagggaaccttgagagagaatgtatggwagaaaagtgtagttttgaagaagcacgagaagtttttgaaaacactgaaagaacagtgagtatttccacataatacccttcagatgcagagcatagaata

SEQ ID NO: 18280 - DNA, 201 bp, Homo sapiens
tcatgaaaacgccaacaaaattctgaatcggccaaagaggtataattcaggtaaattggaagagtttgttcaagggaaccttgagagagaatgtatggaaraaaagtgtagttttgaagaagcacgagaagtttttgaaaacactgaaagaacagtgagtatttccacataatacccttcagatgcagagcatagaataga

SEQ ID NO: 18281 - DNA, 201 bp, Homo sapiens
aaacgccaacaaaattctgaatcggccaaagaggtataattcaggtaaattggaagagtttgttcaagggaaccttgagagagaatgtatggaagaaaagygtagttttgaagaagcacgagaagtttttgaaaacactgaaagaacagtgagtatttccacataatacccttcagatgcagagcatagaatagaaaatct

SEQ ID NO: 18282 - DNA, 201 bp, Homo sapiens
aacgccaacaaaattctgaatcggccaaagaggtataattcaggtaaattggaagagtttgttcaagggaaccttgagagagaatgtatggaagaaaagtrtagttttgaagaagcacgagaagtttttgaaaacactgaaagaacagtgagtatttccacataatacccttcagatgcagagcatagaatagaaaatctt

SEQ ID NO: 18283 - DNA, 201 bp, Homo sapiens
ctagaaggccttttagtctgcaaaagaaaccttcttaatcataagcagcagaagtcccatttaccaaattggaaagttaaagttacaaagcatcaatcatmagacttccattcagggatggcaattgggagtaagactttttagtaaagaaactaaacacaaagtcattagactctgtaaaagtcttaccaaatttgattc

SEQ ID NO: 18284 - DNA, 201 bp, Homo sapiens
tgagaaatatcaggttactaatttttcttctatttttctagtgccatttccatgtggaagagtttctgtttcacaaacttctaagctcacccgtgctgagrctgtttttcctgatgtggactatgtaaattctactgaagctgaaaccattttggataacatcactcaaagcacccaatcatttaatgacttcactcgggt

SEQ ID NO: 18285 - DNA, 201 bp, Homo sapiens
tttctgggactagctgtgtatctatccaggattcttgagaatgcctgccatttttcaacataatggatgtaaggtattacacatatacctggggatggggwggtaggtataattgcacaagcattgtggagaatggtatcaaagagtggcagaacatcacaatcaaggttttccctttcttttacctttgctttttaaaaa

SEQ ID NO: 18286 - DNA, 201 bp, Homo sapiens
attcattatgtgtccaacttccatggataacatggttacaacaaaagatcctactttatgacaattatcttccttgggtttgtgggacatagaacagtgcwcagagtaggggatccaagaacccaggagaatatattagctaagaagataacttccgtttttaaaagtccaagattcaggagatcaaaaccatcctggcta

SEQ ID NO: 18287 - DNA, 201 bp, Homo sapiens
gccagagatcagagcaggctaagggactgctgggatcctgtccagctttgagaccctacagagccatgttcacctagcacgtatcccgtctgcggtcacgstcatttcttaccttattccagggctttcacctcagcttgccaggctggagccaagggccaacgcagccgcgccttgttcgcgatggtagcttcccaggag

SEQ ID NO: 18288 - DNA, 201 bp, Homo sapiens
tacagaaaatgtccagggaaatggtctatttcttattctatttttgacctaaagaaaatctttaaaatgtcttagcattttccccagtctccatccacttycctcagctttggcctgaagctatctttaaaggtaccctgtacagctcttgccctgtacagctagctacagagattcaatcctttctgttcgattaggaca

SEQ ID NO: 18289 - DNA, 201 bp, Homo sapiens
gccacagtaggccagtgacaagggaagattgacacatcatcccctgctggggcccagtgtcctgtggctggcaggcaggggatcctaaggacatgtgggtsttaaattgtagggtgcacttcctgggcacctttgagggtctgcactgccccagcaaatatccccatgctagaaggagcaaaatattaaatggcaaatttt

SEQ ID NO: 18290 - DNA, 201 bp, Homo sapiens
atggttaagagagagtggaaagaatgaatgagccctgctattcctcactgcctggatggctataagcacagcccttatggaggccttaggtcttgcttcayaatattccagtttgaaaagggtttgaaaagacctcctagaaaaatcagtagtttttctcttttgagtaacatgtagcaaaaaaaatttcatcatgtaggt

SEQ ID NO: 18291 - DNA, 201 bp, Homo sapiens
tgtttttcctgatgtggactatgtaaattctactgaagctgaaaccattttggataacatcactcaaagcacccaatcatttaatgacttcactcgggttbttggtggagaagatgccaaaccaggtcaattcccttggcaggtactttatactgatggtgtgtcaaaactggagctcagctggcaagacacaggccaggt

SEQ ID NO: 18292 - DNA, 201 bp, Homo sapiens
gtttttcctgatgtggactatgtaaattctactgaagctgaaaccattttggataacatcactcaaagcacccaatcatttaatgacttcactcgggttgbtggtggagaagatgccaaaccaggtcaattcccttggcaggtactttatactgatggtgtgtcaaaactggagctcagctggcaagacacaggccaggtg

SEQ ID NO: 18293 - DNA, 201 bp, Homo sapiens; identical to SEQ ID NO: 1884

SEQ ID NO: 18294 - DNA, 201 bp, Homo sapiens
tgtactttttagaaatgcatgttaaatgatgctgttactgtctattttgcttcttttagatgtaacatgtaacattaagaatggcagatgcgagcagtttygtaaaaatagtgctgataacaaggtggtttgctcctgtactgagggatatcgacttgcagaaaaccagaagtcctgtgaaccagcaggtcataatctgaa

SEQ ID NO: 18295 - DNA, 201 bp, Homo sapiens; identical to SEQ ID NO: 1885

SEQ ID NO: 18296 - DNA, 201 bp, Homo sapiens
gcattctaagcagtttacgtgccaattcaatttcttaacctatctcaaagatggagatcagtgtgagtccaatccatgtttaaatggcggcagttgcaagdatgacattaattcctatgaatgttggtgtccctttggatttgaaggaaagaactgtgaattaggtaagtaactattttttgaatactcatggttcaaagt

SEQ ID NO: 18297 - DNA, 201 bp, Homo sapiens
aaagggtttgaaaagacctcctagaaaaatcagtagtttttctcttttgagtaacatgtagcaaaaaaaatttcatcatgtaggtacagggaacaccctartaactattaatctcaaggagtcaagccagtgtgtttcctaatgtatctgctgtatccccatgaagcaaattttgccatcagagaaactgactcatgggga

SEQ ID NO: 18298 - DNA, 201 bp, Homo sapiens
cattctaagcagtttacgtgccaattcaatttcttaacctatctcaaagatggagatcagtgtgagtccaatccatgtttaaatggcggcagttgcaaggrtgacattaattcctatgaatgttggtgtccctttggatttgaaggaaagaactgtgaattaggtaagtaactattttttgaatactcatggttcaaagtt

SEQ ID NO: 18299 - DNA, 201 bp, Homo sapiens
gtaaaattttcatgatgttttcttttttgctaaaactaaagaattattcttttacatttcagtttttcttgatcatgaaaacgccaacaaaattctgaatyggccaaagaggtataattcaggtaaattggaagagtttgttcaagggaaccttgagagagaatgtatggaagaaaagtgtagttttgaagaagcacgaga

SEQ ID NO: 18300 - DNA, 201 bp, Homo sapiens
atatctactcagtgctgaatgtacaggtttgtttccttttttaaaatacattgagtatgcttgccttttagatatagaaatatctgatgctgtcttcttcrctaaattttgattacatgatttgacagcaatattgaagagtctaacagccagcacgcaggttggtaagtactggttctttgttagctaggttttcttctt

SEQ ID NO: 18301 - DNA, 201 bp, Homo sapiens
aacactgaaagaacagtgagtatttccacataatacccttcagatgcagagcatagaatagaaaatctttaaaaagacacttctctttaaaattttaaagsatccatatatatttatgtatgttaaatgttataaaagataggaaatcaataccaaaacactttagatattaccgttaatttgtcttcttttattctttat

SEQ ID NO: 18302 - DNA, 201 bp, Homo sapiens
ttcattttatcctctagctaatatatgaaacatatgagaattatgtgggttttttctctgcataaatagataatatattaaactttgtcaaaaggactcaraaagatcagtccaaccctctaacccatattgaatggtgatatactacagggttatgccagtgtgggaactatcgctggtaaataagtttaatcctcccta

SEQ ID NO: 18303 - DNA, 201 bp, Homo sapiens
gtactttttagaaatgcatgttaaatgatgctgttactgtctattttgcttcttttagatgtaacatgtaacattaagaatggcagatgcgagcagttttrtaaaaatagtgctgataacaaggtggtttgctcctgtactgagggatatcgacttgcagaaaaccagaagtcctgtgaaccagcaggtcataatctgaat

SEQ ID NO: 18304 - DNA, 201 bp, Homo sapiens
  misc_feature (1)...(201): n = A,T,C or G, or insertion/deletion polymorphism (see Tables 1-2)
ctgttactgtctattttgcttcttttagatgtaacatgtaacattaagaatggcagatgcgagcagttttgtaaaaatagtgctgataacaaggtggtttnctcctgtactgagggatatcgacttgcagaaaaccagaagtcctgtgaaccagcaggtcataatctgaataagattttttaaagaaaatctgtatctgaa

SEQ ID NO: 18305 - DNA, 201 bp, Homo sapiens
gttactgtctattttgcttcttttagatgtaacatgtaacattaagaatggcagatgcgagcagttttgtaaaaatagtgctgataacaaggtggtttgcycctgtactgagggatatcgacttgcagaaaaccagaagtcctgtgaaccagcaggtcataatctgaataagattttttaaagaaaatctgtatctgaaac

SEQ ID NO: 18306 - DNA, 201 bp, Homo sapiens
taaaattttcatgatgttttcttttttgctaaaactaaagaattattcttttacatttcagtttttcttgatcatgaaaacgccaacaaaattctgaatcdgccaaagaggtataattcaggtaaattggaagagtttgttcaagggaaccttgagagagaatgtatggaagaaaagtgtagttttgaagaagcacgagaa

SEQ ID NO: 18307 - DNA, 201 bp, Homo sapiens
ttcatgatgttttcttttttgctaaaactaaagaattattcttttacatttcagtttttcttgatcatgaaaacgccaacaaaattctgaatcggccaaakaggtataattcaggtaaattggaagagtttgttcaagggaaccttgagagagaatgtatggaagaaaagtgtagttttgaagaagcacgagaagtttttg

SEQ ID NO: 18308 - DNA, 201 bp, Homo sapiens
atgatgttttcttttttgctaaaactaaagaattattcttttacatttcagtttttcttgatcatgaaaacgccaacaaaattctgaatcggccaaagagstataattcaggtaaattggaagagtttgttcaagggaaccttgagagagaatgtatggaagaaaagtgtagttttgaagaagcacgagaagtttttgaaa

SEQ ID NO: 18309 - DNA, 201 bp, Homo sapiens
tgttttcttttttgctaaaactaaagaattattcttttacatttcagtttttcttgatcatgaaaacgccaacaaaattctgaatcggccaaagaggtatdattcaggtaaattggaagagtttgttcaagggaaccttgagagagaatgtatggaagaaaagtgtagttttgaagaagcacgagaagtttttgaaaacac

SEQ ID NO: 18310 - DNA, 201 bp, Homo sapiens
gttttcttttttgctaaaactaaagaattattcttttacatttcagtttttcttgatcatgaaaacgccaacaaaattctgaatcggccaaagaggtatawttcaggtaaattggaagagtttgttcaagggaaccttgagagagaatgtatggaagaaaagtgtagttttgaagaagcacgagaagtttttgaaaacact

SEQ ID NO: 18311 - DNA, 201 bp, Homo sapiens
cttttttgctaaaactaaagaattattcttttacatttcagtttttcttgatcatgaaaacgccaacaaaattctgaatcggccaaagaggtataattcargtaaattggaagagtttgttcaagggaaccttgagagagaatgtatggaagaaaagtgtagttttgaagaagcacgagaagtttttgaaaacactgaaag

SEQ ID NO: 18312 - DNA, 201 bp, Homo sapiens
ttttttgctaaaactaaagaattattcttttacatttcagtttttcttgatcatgaaaacgccaacaaaattctgaatcggccaaagaggtataattcagrtaaattggaagagtttgttcaagggaaccttgagagagaatgtatggaagaaaagtgtagttttgaagaagcacgagaagtttttgaaaacactgaaaga

SEQ ID NO: 18313 - DNA, 201 bp, Homo sapiens
ttttgctaaaactaaagaattattcttttacatttcagtttttcttgatcatgaaaacgccaacaaaattctgaatcggccaaagaggtataattcaggtraattggaagagtttgttcaagggaaccttgagagagaatgtatggaagaaaagtgtagttttgaagaagcacgagaagtttttgaaaacactgaaagaac

SEQ ID NO: 18314 - DNA, 201 bp, Homo sapiens
ctcgggttgttggtggagaagatgccaaaccaggtcaattcccttggcaggtactttatactgatggtgtgtcaaaactggagctcagctggcaagacacrggccaggtgggagactgaggctattttactagacagacctattgggatgtgagaagtatttaggcaagtttcagcactaaccaatgtgagaaggcctcca

SEQ ID NO: 18315 - DNA, 201 bp, Homo sapiens
aaataaaaagaaattaatccagacaacaaattcaccaacttccatcaattggaaatccaattctattttctacagtttatgttctggagacactactggayactcttttactctcataactcataactcctccacttttgtttttaaatcatgagagaaaaagagttgactctgttatattgttttatctacctttccttg

SEQ ID NO: 18316 - DNA, 201 bp, Homo sapiens
tcgttaatgaaaaatggattgtaactgctgcccactgtgttgaaactggtgttaaaattacagttgtcgcaggtaaatacacagaaagaataataatctgyagcaccactagctctttaatatgattggtacaccatattttactaaggtctaataaaattgttgttgaataaattgggctaaaggcagaagggtcataat

SEQ ID NO: 18317 - DNA, 201 bp, Homo sapiens; identical to SEQ ID NO: 1900

SEQ ID NO: 18318 - DNA, 201 bp, Homo sapiens
ctgaaaacagcccagccagggtgatggatcactttgcaaagatcctcaatgagctattttcaagtgatgacaaagtgtgaagttaaccgctcatttgagawctttctttttcatccaaagtaaattcaaatatgattagaaatctgaccttttattactggaattctcttgactaaaagtaaaattgaattttaattccta

SEQ ID NO: 18319 - DNA, 201 bp, Homo sapiens
actgtctattttgcttcttttagatgtaacatgtaacattaagaatggcagatgcgagcagttttgtaaaaatagtgctgataacaaggtggtttgctccygtactgagggatatcgacttgcagaaaaccagaagtcctgtgaaccagcaggtcataatctgaataagattttttaaagaaaatctgtatctgaaacttc

SEQ ID NO: 18320 - DNA, 201 bp, Homo sapiens
tttgcttcttttagatgtaacatgtaacattaagaatggcagatgcgagcagttttgtaaaaatagtgctgataacaaggtggtttgctcctgtactgagrgatatcgacttgcagaaaaccagaagtcctgtgaaccagcaggtcataatctgaataagattttttaaagaaaatctgtatctgaaacttcagcatttta

SEQ ID NO: 18321 - DNA, 201 bp, Homo sapiens
ctgtctattttgcttcttttagatgtaacatgtaacattaagaatggcagatgcgagcagttttgtaaaaatagtgctgataacaaggtggtttgctcctvtactgagggatatcgacttgcagaaaaccagaagtcctgtgaaccagcaggtcataatctgaataagattttttaaagaaaatctgtatctgaaacttca

SEQ ID NO: 18322 - DNA, 201 bp, Homo sapiens
tctgaaaacagcccagccagggtgatggatcactttgcaaagatcctcaatgagctattttcaagtgatgacaaagtgtgaagttaaccgctcatttgagwactttctttttcatccaaagtaaattcaaatatgattagaaatctgaccttttattactggaattctcttgactaaaagtaaaattgaattttaattcct

SEQ ID NO: 18323 - DNA, 201 bp, Homo sapiens
ctttgaatattagtgaaaaaagggaaactgcaacgcctgtattactagatagctttcatcaacagctcaaaaccgacagatttaaagaagcaacaccgcaktttggctttctaaagctttaatttggtttggatcccatgcccatgaccctgccagctgacaattctaagcatgcgcaaactggccccaaaaattcctccc

SEQ ID NO: 18324 - DNA, 201 bp, Homo sapiens
aaggatgaaggcagatggctgctccaatttaggggctaggattgcagggtgggcacagcattgcaaacgagtgaaggaaattgagaaatatggccaatgargagttgaagagaggcctggcatggtggctcacacctataatcccagcactttcagaggcccaggcaggcagatcacttgaggtcaggagttcgacaccag

SEQ ID NO: 18325 - DNA, 201 bp, Homo sapiens
ttgcttcttttagatgtaacatgtaacattaagaatggcagatgcgagcagttttgtaaaaatagtgctgataacaaggtggtttgctcctgtactgaggvatatcgacttgcagaaaaccagaagtcctgtgaaccagcaggtcataatctgaataagattttttaaagaaaatctgtatctgaaacttcagcattttaa

SEQ ID NO: 18326 - DNA, 201 bp, Homo sapiens
gagctagtggtgctgcagattattattctttctgtgtatttacctgcgacaactgtaattttaacaccagtttcaacacagtgggcagcagttacaatccbtttttcattaacgatagagcctccacagaatgcatcaactttaccattcaaaacaacctgtgaaaacaaaattaagactcttactgcataatacatttga

SEQ ID NO: 18327 - DNA, 201 bp, Homo sapiens
agattatttctttttccgacgtttcagtaattggagcagtaaaccccagtgtcccttacctacttgtttattacctccagatgcaatattactggtactgwgattgagaaacgcacacagtgctaatgaggaattcactttctactctgacactctggaagaatagagatgcaatcctaaggaagaatttaacaccacagg

SEQ ID NO: 18328 - DNA, 201 bp, Homo sapiens
aaaactaaagaattattcttttacatttcagtttttcttgatcatgaaaacgccaacaaaattctgaatcggccaaagaggtataattcaggtaaattgghagagtttgttcaagggaaccttgagagagaatgtatggaagaaaagtgtagttttgaagaagcacgagaagtttttgaaaacactgaaagaacagtgagt

SEQ ID NO: 18329 - DNA, 201 bp, Homo sapiens
actaaagaattattcttttacatttcagtttttcttgatcatgaaaacgccaacaaaattctgaatcggccaaagaggtataattcaggtaaattggaagvgtttgttcaagggaaccttgagagagaatgtatggaagaaaagtgtagttttgaagaagcacgagaagtttttgaaaacactgaaagaacagtgagtatt

SEQ ID NO: 18330 - DNA, 201 bp, Homo sapiens
taaagaattattcttttacatttcagtttttcttgatcatgaaaacgccaacaaaattctgaatcggccaaagaggtataattcaggtaaattggaagagwttgttcaagggaaccttgagagagaatgtatggaagaaaagtgtagttttgaagaagcacgagaagtttttgaaaacactgaaagaacagtgagtatttc

SEQ ID NO: 18331 - DNA, 201 bp, Homo sapiens
aaagaattattcttttacatttcagtttttcttgatcatgaaaacgccaacaaaattctgaatcggccaaagaggtataattcaggtaaattggaagagtktgttcaagggaaccttgagagagaatgtatggaagaaaagtgtagttttgaagaagcacgagaagtttttgaaaacactgaaagaacagtgagtatttcc

SEQ ID NO: 18332 - DNA, 201 bp, Homo sapiens
ccactctagacacctgtacagaactccactctactttttaacagagcttttcaccatctaatgtatcatataatttcttactcatactatttatcatttaytttctcctactccactaaaatgcaagtttcatgttggcagggatattcaattgttttgtttattgatatattcctagcacctagaacagtatctggaaaa

SEQ ID NO: 18333 - DNA, 201 bp, Homo sapiens
attattcttttacatttcagtttttcttgatcatgaaaacgccaacaaaattctgaatcggccaaagaggtataattcaggtaaattggaagagtttgttyaagggaaccttgagagagaatgtatggaagaaaagtgtagttttgaagaagcacgagaagtttttgaaaacactgaaagaacagtgagtatttccacata

SEQ ID NO: 18334 - DNA, 201 bp, Homo sapiens
atactaccataccagcttctactgaggtgccccctaaagttagtccaaataggtctttgcaatctccattcccgcagaatttagaactttgaatcacatgwtttatttctaaaagtaaatccatgccgattttccccaccaaaaaattcctgactattaaactcctacaatcccttcattgctcactccccacccccagga

SEQ ID NO: 18335 - DNA, 201 bp, Homo sapiens
attcttttacatttcagtttttcttgatcatgaaaacgccaacaaaattctgaatcggccaaagaggtataattcaggtaaattggaagagtttgttcaarggaaccttgagagagaatgtatggaagaaaagtgtagttttgaagaagcacgagaagtttttgaaaacactgaaagaacagtgagtatttccacataata

SEQ ID NO: 18336 - DNA, 201 bp, Homo sapiens
tagtcttaaacaggaatctctcacttggtaagatcttgtctcttgttgtatttgaccccaactgtctatggctttgcctgaacccaaagtacacacagccwagaaaccaaaggagaaccaaatgtgggataaaatgacactcattttaacgacatgtctcagcaaatgagttcctgtgtagctggctgaaagcccagaccc

SEQ ID NO: 18337 - DNA, 201 bp, Homo sapiens
ttcttttacatttcagtttttcttgatcatgaaaacgccaacaaaattctgaatcggccaaagaggtataattcaggtaaattggaagagtttgttcaagvgaaccttgagagagaatgtatggaagaaaagtgtagttttgaagaagcacgagaagtttttgaaaacactgaaagaacagtgagtatttccacataatac

SEQ ID NO: 18338 - DNA, 201 bp, Homo sapiens
tttagtgtttaaacaggctcatttactttgtgaaaacttacactaaaattgtgtgtattttttgaatatatgttatacattaataaatagggtttttaaamctgtagttcataatttagtgaaagtagaatatccaaacatttagttttaaaccaatcaattatagtgctaccatcatttttatgcattattgagaagttt

SEQ ID NO: 18339 - DNA, 201 bp, Homo sapiens
agtttttcttgatcatgaaaacgccaacaaaattctgaatcggccaaagaggtataattcaggtaaattggaagagtttgttcaagggaaccttgagagavaatgtatggaagaaaagtgtagttttgaagaagcacgagaagtttttgaaaacactgaaagaacagtgagtatttccacataatacccttcagatgcaga

SEQ ID NO: 18340 - DNA, 201 bp, Homo sapiens
tatgaccggcgtacttacgcagggctttgcactgagacaggtcgtgcatctgaggtttactgctttgcatttttgttttgtaactgaagtctgatgagacmgccagagcatgtgctacctagggacttgaatccctgcagccccatttcacttctcaccaccttccggggtggtttctcgacctcccactcccctaccacc

SEQ ID NO: 18341 - DNA, 201 bp, Homo sapiens
ttttcttgatcatgaaaacgccaacaaaattctgaatcggccaaagaggtataattcaggtaaattggaagagtttgttcaagggaaccttgagagagaaygtatggaagaaaagtgtagttttgaagaagcacgagaagtttttgaaaacactgaaagaacagtgagtatttccacataatacccttcagatgcagagca

SEQ ID NO: 18342 - DNA, 201 bp, Homo sapiens
taaaatagaactcttgccaagtgaaggaaagtgtgctaatataatgcagtcattttaacttgctgtttaagtgtgattgtttttagttcttttgaatattrtttgttttatactgacaggaacgaagtactgtccaattttctctgccaaggaaaaaagaaaaggtgttcttccttacttacctgaaccaaaacagaccag

SEQ ID NO: 18343 - DNA, 201 bp, Homo sapiens; identical to SEQ ID NO: 1915

SEQ ID NO: 18344 - DNA, 201 bp, Homo sapiens
ataggtgaacataatattgaggagacagaacatacagagcaaaagcgaaatgtgattcgaattattcctcaccacaactacaatgcagctattaataagtrcaaccatgacattgcccttctggaactggacgaacccttagtgctaaacagctacgttacacctatttgcattgctgacaaggaatacacgaacatcttc

SEQ ID NO: 18345 - DNA, 201 bp, Homo sapiens
taggtgaacataatattgaggagacagaacatacagagcaaaagcgaaatgtgattcgaattattcctcaccacaactacaatgcagctattaataagtamaaccatgacattgcccttctggaactggacgaacccttagtgctaaacagctacgttacacctatttgcattgctgacaaggaatacacgaacatcttcc

SEQ ID NO: 18346 - DNA, 201 bp, Homo sapiens
gctgcagattattattctttctgtgtatttacctgcgacaactgtaattttaacaccagtttcaacacagtgggcagcagttacaatccatttttcattawcgatagagcctccacagaatgcatcaactttaccattcaaaacaacctgtgaaaacaaaattaagactcttactgcataatacatttgatctagaaaaaa

SEQ ID NO: 18347 - DNA, 201 bp, Homo sapiens
attctaagcagtttacgtgccaattcaatttcttaacctatctcaaagatggagatcagtgtgagtccaatccatgtttaaatggcggcagttgcaaggakgacattaattcctatgaatgttggtgtccctttggatttgaaggaaagaactgtgaattaggtaagtaactattttttgaatactcatggttcaaagttt

SEQ ID NO: 18348 - DNA, 201 bp, Homo sapiens
aagcagtttacgtgccaattcaatttcttaacctatctcaaagatggagatcagtgtgagtccaatccatgtttaaatggcggcagttgcaaggatgacabtaattcctatgaatgttggtgtccctttggatttgaaggaaagaactgtgaattaggtaagtaactattttttgaatactcatggttcaaagtttccctc

SEQ ID NO: 18349 - DNA, 201 bp, Homo sapiens
tggtgctgcagattattattctttctgtgtatttacctgcgacaactgtaattttaacaccagtttcaacacagtgggcagcagttacaatccatttttckttaacgatagagcctccacagaatgcatcaactttaccattcaaaacaacctgtgaaaacaaaattaagactcttactgcataatacatttgatctagaa

SEQ ID NO: 18350 - DNA, 201 bp, Homo sapiens
accgggcattctaagcagtttacgtgccaattcaatttcttaacctatctcaaagatggagatcagtgtgagtccaatccatgtttaaatggcggcagttvcaaggatgacattaattcctatgaatgttggtgtccctttggatttgaaggaaagaactgtgaattaggtaagtaactattttttgaatactcatggttc

SEQ ID NO: 18351 - DNA, 201 bp, Homo sapiens
aactggctctttagtctgactgccagagtctgaatcctgaatgttttagtatgttaccttgggcaaagcccttagcctctatgaatctatcttcctcattyataaaaataagatgacagtgcctatctcgtgggacttttgtgaggatgaagtgagataatggatgcaaagttactgagcacagtgtccaacacagcagaa

SEQ ID NO: 18352 - DNA, 201 bp, Homo sapiens
acgtgccaattcaatttcttaacctatctcaaagatggagatcagtgtgagtccaatccatgtttaaatggcggcagttgcaaggatgacattaattcctrtgaatgttggtgtccctttggatttgaaggaaagaactgtgaattaggtaagtaactattttttgaatactcatggttcaaagtttccctctgaaacaag

SEQ ID NO: 18353 - DNA, 201 bp, Homo sapiens
atacttgattcaaacctatttctgtctgatctgattctaaagtctgttttttcactcaaccacactgtacagtcagctctccttgtgagttccacagccamagattcaattaactgcagatcaaaaatattcaagaaaaaaatggatggttgcatctctactgaacatgtacagactcttttatctttcattattccctaa

SEQ ID NO: 18354 - DNA, 201 bp, Homo sapiens
ccaattcaatttcttaacctatctcaaagatggagatcagtgtgagtccaatccatgtttaaatggcggcagttgcaaggatgacattaattcctatgaawgttggtgtccctttggatttgaaggaaagaactgtgaattaggtaagtaactattttttgaatactcatggttcaaagtttccctctgaaacaagttgaa

SEQ ID NO: 18355 - DNA, 201 bp, Homo sapiens
tcaaacctatttctgtctgatctgattctaaagtctgttttttcactcaaccacactgtacagtcagctctccttgtgagttccacagccacagattcaaytaactgcagatcaaaaatattcaagaaaaaaatggatggttgcatctctactgaacatgtacagactcttttatctttcattattccctaaacaatacag

SEQ ID NO: 18356 - DNA, 201 bp, Homo sapiens
ttccatgtactttttagaaatgcatgttaaatgatgctgttactgtctattttgcttcttttagatgtaacatgtaacattaagaatggcagatgcgagcmgttttgtaaaaatagtgctgataacaaggtggtttgctcctgtactgagggatatcgacttgcagaaaaccagaagtcctgtgaaccagcaggtcataat

SEQ ID NO: 18357 - DNA, 201 bp, Homo sapiens
tctccttgtgagttccacagccacagattcaattaactgcagatcaaaaatattcaagaaaaaaatggatggttgcatctctactgaacatgtacagactyttttatctttcattattccctaaacaatacagcataacaactatttacatagcatttacattgtattagctattaagagaaacctagagatgatttaaag

SEQ ID NO: 18358 - DNA, 201 bp, Homo sapiens; identical to SEQ ID NO: 1926

SEQ ID NO: 18359 - DNA, 201 bp, Homo sapiens
actgaacatgtacagactcttttatctttcattattccctaaacaatacagcataacaactatttacatagcatttacattgtattagctattaagagaawcctagagatgatttaaagtacaaaggaggatgtgtttaggttatatgcaaatagtaagccatttttatatcggagacttgagcatccacagatcttgata

SEQ ID NO: 18360 - DNA, 201 bp, Homo sapiens
tttcttgatcatgaaaacgccaacaaaattctgaatcggccaaagaggtataattcaggtaaattggaagagtttgttcaagggaaccttgagagagaatrtatggaagaaaagtgtagttttgaagaagcacgagaagtttttgaaaacactgaaagaacagtgagtatttccacataatacccttcagatgcagagcat

SEQ ID NO: 18361 - DNA, 201 bp, Homo sapiens
atgctgttactgtctattttgcttcttttagatgtaacatgtaacattaagaatggcagatgcgagcagttttgtaaaaatagtgctgataacaaggtggyttgctcctgtactgagggatatcgacttgcagaaaaccagaagtcctgtgaaccagcaggtcataatctgaataagattttttaaagaaaatctgtatct

SEQ ID NO: 18362 - DNA, 201 bp, Homo sapiens; identical to SEQ ID NO: 1929

SEQ ID NO: 18363 - DNA, 201 bp, Homo sapiens
tcacaatctggatgtttggtatcatgagacaatctccctgccctggcttggggggccacccatgggttaaggcataagtaacaattcctgacaagagtggrgtcattaatgtctggagcaggaagctgaggggagttgtgtttttctcttgcctcaacattgtaggaggagagagaatcctttctaggcatcagggtcatc

SEQ ID NO: 18364 - DNA, 201 bp, Homo sapiens
cattctgggcttgttgcagaatgtgcctgcccgaagggaaacccaggagtcccccaagccctccctgtcttgattgcccagcccctgccaggggatagccmtggcaagcaatgcccccactgccaatgctactcactcctcaagtggacataaaatgtactccaaaagccacagatccctgcccagcaggctgtgctagct

SEQ ID NO: 18365 - DNA, 201 bp, Homo sapiens
acaaagacgctggacagaataagtgcataactacatggtacagagggttataaggagggaaaaggggagctggatgagagagttgagagtgcccggtgtgrtggggaaagctgcagggtgaaatactgcatcagggaaacctcagggaaggtgaggactatggtgaggtcagaggggttgatatgagaacagtgccctgca

SEQ ID NO: 18366 - DNA, 201 bp, Homo sapiens
aagacggcagccactctcatgtcaaatcccagcgtcttttgggaggcagcttcccttttttagtttagtttgttggaagaaaagaattgtccctttccccsctctaaactaaaagccttgccagcccaggtgggcagcaccgaggtccctgcagggaacgtgcaaggggaaccctgcagtttcccgctcacatgcccttcc

SEQ ID NO: 18367 - DNA, 201 bp, Homo sapiens
gcagaaggcaaaggcaagaaagccagtggcatctgaaatgggtctcccttcgaaagagagcacatccacctgacccagaccgcagagccaggccaggaggmagaggaggaagaataaaaaagccaaccacatcgggactcaaaggaagcccaggatcctcgccggcctccaccgcatgctgccctgaccctgccccacttc

SEQ ID NO: 18368 - DNA, 201 bp, Homo sapiens
tgtcctactggctctggttgggagcctttcctagcagtcctaccatgactggcctcttggatccactctgaattcttctacttctctttgcagtagaaagrcattaactgatatttctctttccaaatttctttgcaatgttttctgtagaagaactgaacattaaataaatattatttctagaactcagttttcgcaaaa

SEQ ID NO: 18369 - DNA, 201 bp, Homo sapiens
gcctacctacccaggaaattgcggcagcccccagccgtggagccgcgaacccagcttccctgatggaccgtcacctcccatttgtggatcgcgtcttcctycagggcatcgggagtgaggttgcagatctccactttatcaaagtgggccttgaagtcctgaaatgccatcctgcagcaaagcggagagacacgatgcaca

SEQ ID NO: 18370 - DNA, 201 bp, Homo sapiens
catggctgtgttgcaataaaacttgtttacacaaacagatggtggtccagcccagatttggcccatgggctgtagtttgccaatccttggaacagataaaygttcatgctattatttgtttagtaagagtattctttagttgccaggttgaccatgaactaccataaatagagagctcctggaatgtacattggaaaagtt

SEQ ID NO: 18371 - DNA, 201 bp, Homo sapiens
acattggaaaagtttttctttttgtccagtttttcaggatcacagctgttatacaaagctctgtgtaccaacaatgcatatatcaccaggctcatatacarttttcttagaggagctcaataccctgtggacttaaattaagaaccataaaactgcttgagagtggacaaagagaagataaccatttttcctatcttactg

SEQ ID NO: 18372 - DNA, 201 bp, Homo sapiens
cttagtaggaaagtgagtgtttcattttctcaatttatctgtggatgtggacaaaggggaaaggggtagggaatagggggttgtagtcagcctccaacagrttattaccactgaaattgtgccctaaaggattaaagaagtcagtaactaacagaaattcttgagtttgcaaggtaagaaacaacttgctcaaatgctgaa

SEQ ID NO: 18373 - DNA, 201 bp, Homo sapiens
aactcactctcatgagaatagcataggggaaatcgtccccatgatccagtcacctccctctcttgacacatggggattacaggtgcctcccttgacaggtkgggattacaattcgagatgaaatttgggtggggacacagagctaaaccgtatcattctccaccggcccttcccaaatctcatgccttttcagatttcaaa

SEQ ID NO: 18374 - DNA, 201 bp, Homo sapiens
tatcccaatagcacctgcctgactaatacatcatgctctgctgactccatatgtggctggtttcctggatccgattctgactgatggtatctgttctcacrctgctaataaagacataccagagactgggtaatttataaagaaaaagaggtttaatggacttatgtgttccacgtggctggggaggcctcacaatcatgg

SEQ ID NO: 18375 - DNA, 201 bp, Homo sapiens
atgactggcagaacaagaacatgaaatggtctccacgcagaagacagccacgtggaagtggctgactggtagaccagctgagatgaagactactccagtcytcacagcggtgctcaaatggccccatcaaatcaaatgtaatgaccaggcagagactagggtgaaaacagttgtggaaatccatttgtatgtctcctgtaa

SEQ ID NO: 18376 - DNA, 201 bp, Homo sapiens
ccaaaccatatcagatggcttatttggtttctatgtagaacctctgcttttcattcaacagtcttcatttagccacagataagctctgtccctaacttccrctgatggaatgtacacataagaaacttccactgatggaatgaacacagaaggtgcctactgggaagaaaactggcctgaatctgagctgggtcaaatgtc

SEQ ID NO: 18377 - DNA, 201 bp, Homo sapiens
gagtccaaaggtttgagaacgaggagctccaatgtccaagagcaggggaatatggatgtcccagttcaagtagggaaagggaattcacccttcctttgtcrttttcttttatttggatctttagcaaactgaataatgctcgtccacattggtggcagcaatcctctttactcagtctactgattcaaaagctattttctc

SEQ ID NO: 18378 - DNA, 201 bp, Homo sapiens
tgcagtcagtttgaatggctgctccttatgggaataatttacattctcaataaaattctctagcaattttctgattgattttaatgagctttaaagccttmcgtagaagatcccccagctgatagtcagccttgggcatggattaagggcttttaaccaatcttgcaacaagtttaagcagatattctttattgggtccaa

SEQ ID NO: 18379 - DNA, 201 bp, Homo sapiens
ggtcctgaaattttattttcttttacaccactttccagcatgttacctgatcagttgtttattatctttgctgttgaatggagtgatcattccaagggccygaggcaggaggcccaggcacagtggaaactctcccaaagaccaggatctttgttttgttccctgacatatgctgagcaccaggaatagtgaatgaatgaa

SEQ ID NO: 18380 - DNA, 201 bp, Homo sapiens
caagggcccgaggcaggaggcccaggcacagtggaaactctcccaaagaccaggatctttgttttgttccctgacatatgctgagcaccaggaatagtgartgaatgaaacaaattgtgaggctttaaagagccgaaatatttaaacactgggcacaaggttgttgcttaatcagtgctagatccttacctcccccttgtg

SEQ ID NO: 18381 - DNA, 201 bp, Homo sapiens
aacaaattgtgaggctttaaagagccgaaatatttaaacactgggcacaaggttgttgcttaatcagtgctagatccttacctcccccttgtgtccaggtsgacttgttactgcagttaaaccacttgctgatcctcaaacaactagttagtggcacagccaggcctaggaccccagtctctactgttccaactaacccat

SEQ ID NO: 18382 - DNA, 201 bp, Homo sapiens
gggtttagacaaatctgcagacaggaggaagaatgagatgaatggcacttaagtgttattcctctccagatcatgattctcccagtttgaattaagactcktctctgagttttggaggagagatgcttggaaaggatgattgaagagattcattcacccattagactccctactattgattaaggatgtaatgaagtgata

SEQ ID NO: 18383 - DNA, 201 bp, Homo sapiens
tctctctcagatgtaactgagctgtgggctaggaggaaaaggccgggaggaggcacggtgatgactgaaaaacctctcccctctcataagaccagtcatcyggacgcgggctttcccccactcggtgcccacctggggtcttacaggaggagctgctcctcctcagcaataggacaagatggtcaggtcttcctgcttccg

SEQ ID NO: 18384 - DNA, 201 bp, Homo sapiens
atcagggaaacctcagggaaggtgaggactatggtgaggtcagaggggttgatatgagaacagtgccctgcaaatggcaggcaccacaggagcatgagccrtcatcttcacctttagcattcagcccgggagaagtagggagacatagaaggggcaggtgctggccaagaggcaggggcaggagaggagaaggcggagggg

SEQ ID NO: 18385 - DNA, 201 bp, Homo sapiens
aactcagaaactctccaagtaaacacaaattagccatcgggtataaattggggaggtgtctggatgtgtgaccgactcctctgtgggtcagtgtttctggkaattggtgtgcacacgtgccagtcacagggggttctgcggacgcatgtgtggaaggggcagctaggcggtgggcctgggttagatgcctgggagtggtgt

SEQ ID NO: 18386 - DNA, 201 bp, Homo sapiens
tgtggtcccccgcaatccagcacgtcaagggctcctgatggatcaagataatctgatcgagcaaagtgagagtcggtggcgtccctggcaagatcagggtkagtggggtggtggggcacactcatagctgagtggagtcgagagagtaagggagaagaggaactggcgggcttgctgtagaggacaggagagagctgggtt

SEQ ID NO: 18387 - DNA, 201 bp, Homo sapiens
ggggcagggcaatggatcactcacatggacgctcttctttgtggagcttcctgctgtgaatttccgagtttcctctgcccggcttctcccaccgtctgcaycagaccttctttccactagcctgacctcaggtagcctctcaaactctggtttctacctcctgctcatatgcagcaattactgtgatggtactaattccag

SEQ ID NO: 18388 - DNA, 201 bp, Homo sapiens; identical to SEQ ID NO: 2780

SEQ ID NO: 18389 - DNA, 201 bp, Homo sapiens
ctcccacgctctctggacttcacagaactggatgttgctgctgagaagattgacaggttcatgcaggctgtgacaggatggaagactggctgctccctgaygggagccagtgtggacagcaccctggctttcaacacctacgtccacttccaaggtaaggcaaacctctctgctggctctggccctaggacttagtatcca

SEQ ID NO: 18390 - DNA, 201 bp, Homo sapiens
tcctcccacctctgccttccaaagtgttgggattaaaggtgtgagccactgcacccagccacagattgcttaaagcattcatttaacaaatacttgttgargatttgctacttgtaagactttaagcctggcatctcagaggaggccagaggagggctgtataggccctgcctccaggcttttaaaggtcaatgggcaaat

SEQ ID NO: 18391 - DNA, 201 bp, Homo sapiens
atagggacagaatttcagttttgcaagatgaaaaagtgctggagatagatcgtggtgatagctgcacaacaacatggatgtacttaatgctactcaactgmacacttaaaaatggtaaaatttatgtcatatacattttatcatatacgattatttatcgatatgtcatatacgactttttaaaaataaaaaagaagcatc

SEQ ID NO: 18392 - DNA, 201 bp, Homo sapiens
agggaaacgtgctccacaaggtaactcagggaagcctcggggctctcagaggacagaggtcactggggagcggagagcaggccttgcctggcagtgagggmaacagggctggtgaagctaggagcaagcatgatgagcccagcctgcagagtttggggcaaggaacgaggatggggcggttggcttggcatgagtgttgaa

SEQ ID NO: 18393 - DNA, 201 bp, Homo sapiens
caagatgttaacctcgtgagggacagagagccaggcgggaggtgaaagacaagactgtggagaaagaggttcagtggcgcatagtgatttttcttaccacracaacctccttgaggtctttcccttcgggttcagggggaggtgatagatggggggattgctcagccctggcactgactggtcacaggggcagaggccagc

SEQ ID NO: 18394 - DNA, 201 bp, Homo sapiens
ggaggtgaaagacaagactgtggagaaagaggttcagtggcgcatagtgatttttcttaccacgacaacctccttgaggtctttcccttcgggttcagggrgaggtgatagatggggggattgctcagccctggcactgactggtcacaggggcagaggccagcccgagggttgcccggttgagggtggcagcacactgtg

SEQ ID NO: 18395 - DNA, 201 bp, Homo sapiens
gcacagctgtgtttgacaagaaggtggtgctgaggaggagggccgtccagccccacggtcccacgggctgctgagacgtgcaccgtgtaatgctgagtccyactgcaaatgatgcccaagccacagaggtctgcagggaacctggcaatgcttgtgatttccctatggcccgctaccccccggctccctgcgactctatgc

SEQ ID NO: 18396 - DNA, 201 bp, Homo sapiens
ggtctttcccttcgggttcagggggaggtgatagatggggggattgctcagccctggcactgactggtcacaggggcagaggccagcccgagggttgcccsgttgagggtggcagcacactgtgcagggcagagcagggacacatggacttagcctgctgtccctaggagaagtgctgggaggagcgctcactgagaagga

SEQ ID NO: 18397 - DNA, 201 bp, Homo sapiens
gcagaggccagcccgagggttgcccggttgagggtggcagcacactgtgcagggcagagcagggacacatggacttagcctgctgtccctaggagaagtgytgggaggagcgctcactgagaaggagggtcctgcagaaggcaaaggcaagaaagccagtggcatctgaaatgggtctcccttcgaaagagagcacatcca

SEQ ID NO: 18398 - DNA, 201 bp, Homo sapiens
cctgccccacttcctaactttgctggcctcagtttccgtcaaaggaggcagccacttcctgcccacatggtctgtccagtgaggagatcgggggctgtctmgggacctctaggtttccctttagcaatgatgttctatttacatgacctcagcaggcagctagatgtgtcccactagagaggacctgaggatctggggcct

SEQ ID NO: 18399 - DNA, 201 bp, Homo sapiens
tgaagcagcccagcagggagcctctcttcaaagccttctctagaatctcatagaagttctcgggggcctctttagtttggaaggtctctgccacacccccrgtgaagtcttccatggcctcgatggcgctgcctcccttcagagcttcatagctcccatttagcctgcaagggtggcaagagagagaggagagagtcaggg

SEQ ID NO: 18400 - DNA, 201 bp, Homo sapiens
cccttggcccaatcaagttgacacataaaactaaccataacaccatctatacagtttttttttggtgagctgttctgccaaccatttttggcctttttaartgaccccaataaatcttttttatgtttagaaactagatggcacacagtttctgttgccttgcttgcatcctgatgtggggggcactcaccaaggggcaga

SEQ ID NO: 18401 - DNA, 201 bp, Homo sapiens; identical to SEQ ID NO: 2800

SEQ ID NO: 18402 - DNA, 201 bp, Homo sapiens
aggaaaaaactcagaaactctccaagtaaacacaaattagccatcgggtataaattggggaggtgtctggatgtgtgaccgactcctctgtgggtcagtgyttctgggaattggtgtgcacacgtgccagtcacagggggttctgcggacgcatgtgtggaaggggcagctaggcggtgggcctgggttagatgcctggga

SEQ ID NO: 18403 - DNA, 201 bp, Homo sapiens
cgtaccaactgtgcctgcagctgccaccgcctcccagctcctatcttgcaattggttgttttgttcaggagaggtctgtttttgtttttgttttaaaccaratcgcacccaatgaggagaaaaatacaaaaggaaaaaactcagaaactctccaagtaaacacaaattagccatcgggtataaattggggaggtgtctgga

SEQ ID NO: 18404 - DNA, 201 bp, Homo sapiens
acagtttttttttggtgagctgttctgccaaccatttttggcctttttaagtgaccccaataaatcttttttatgtttagaaactagatggcacacagttkctgttgccttgcttgcatcctgatgtggggggcactcaccaaggggcagaggtgggcttgggtcccacccactggacttggaaacagtgccctttgtccc

SEQ ID NO: 18405 - DNA, 201 bp, Homo sapiens
catggagtgggcaaggcaggctgctgggctttgctgagcttgagtctggcagagtgatacctttggcttcttgtcctcctctttcattcaattctttcttwctcttccccttgtgcccctcaaggatctctcctcctaaccaacagctcccttgaagtcagggtggtgctgtgtggagtctgggtgtcccccaggatcagt

SEQ ID NO: 18406 - DNA, 201 bp, Homo sapiens
aagctttccacggtagactgggatgatgcacctcagttgcactgagcgtagccggcccctccccagcacccctgtttccacttcctgcgggggctgctgarcctcggcctcatctatgctccttcccctgctcgccccactcacccctggtcgtttccacacaaaggggatctgcggcctctcactgtagaacagggagga

SEQ ID NO: 18407 - DNA, 201 bp, Homo sapiens
aaggaggacaaaggagccaacacaaatagctaacattctaaagaatcccaaagagtccaacggcgtctcacaccttggctccagtgaggaggaagggcagrgtctcccttcagtgttctttactccccacgcattcagaggatgtcactcaaaaggtgggtggctacagaagaccaggtgcatctgcaccttctaagtact

SEQ ID NO: 18408 - DNA, 201 bp, Homo sapiens
cctgtaattccagcactttgggaggccaaggtgggtggtttctctgaggtcaggggttcgagactagcctggccaacacggtgaaaccccatctctactamagatacaaaatgagtcgggcgtggtggcgcatgcctgtactctcagctgcttgggaggctgaggcaggagtatcacttgaacctgggaggcagaggttgc

SEQ ID NO: 18409 - DNA, 201 bp, Homo sapiens
ccaccgtctgcaccagaccttctttccactagcctgacctcaggtagcctctcaaactctggtttctacctcctgctcatatgcagcaattactgtgatgktactaattccagaactcagctttcttcctgcagtttttgctcctctcttgtaaccccctaactcaaagtcccctgtacttcaaaattcaaagtttatctg

SEQ ID NO: 18410 - DNA, 201 bp, Homo sapiens
ctgagcatggggcgctggccctggtggtttccatgacaccaggtcctgacttgacctcgacagatttacctagcctccggatgagaatggtgagctgtgcrtgtcagacgagcagagggaagacggcagccactctcatgtcaaatcccagcgtcttttgggaggcagcttcccttttttagtttagtttgttggaagaaa

SEQ ID NO: 18411 - DNA, 201 bp, Homo sapiens
ccctggaatgtgggagccacactgtcctgcccaggctgggggcggggtggggagtagacacacctgagctgagccttgggtgcagagcagggcagggccgyggtggcacggggctgggcaggcggcctgtgtgtctgtctaccagtcctccatccagccagcacccagctctccagttagtgtctgtctttcaagtgcagg

SEQ ID NO: 18412 - DNA, 201 bp, Homo sapiens
cctttgctaggaagcaggtccaggccctcagcctggtggggagatggaagtggggcatgtcctacctcaccagcgacttgttcaaacagagcccgaaaccrctgctcctcctctgtctcctggtcaggtggagttggctttggaggctaaaaaacagccaaagaaacttgcacaaaatgatccacaaaaaagaaacatgac

SEQ ID NO: 18413 - DNA, 201 bp, Homo sapiens
ggagtagacacacctgagctgagccttgggtgcagagcagggcagggccgcggtggcacggggctgggcaggcggcctgtgtgtctgtctaccagtcctcyatccagccagcacccagctctccagttagtgtctgtctttcaagtgcaggcaaggtaaaggaggagaggaagaatgctttttctacacttacacttgcct

SEQ ID NO: 18414 - DNA, 201 bp, Homo sapiens
ctggaaatctgctcccagaggcaggcattgagtgacacgatggcttgacatcaactctgggtgttttttatgttttaaaaattgtgatggtaaaatatacrtaacaaaatttgccatcgtaaccattttcgagtgcacagttcagtggtactaggcccattcacactgttgtgcagccatcacccccgtccatctccattt

SEQ ID NO: 18415 - DNA, 201 bp, Homo sapiens
tgttttttatgttttaaaaattgtgatggtaaaatatacgtaacaaaatttgccatcgtaaccattttcgagtgcacagttcagtggtactaggcccattyacactgttgtgcagccatcacccccgtccatctccatttatcttctcaacttcccaaactgaagctctgtcctgctgaaacactaactctccatttcccc

SEQ ID NO: 18416 - DNA, 201 bp, Homo sapiens
gcctcgatggcgctgcctcccttcagagcttcatagctcccatttagcctgcaagggtggcaagagagagaggagagagtcagggacctagggaggccacyggggcaccctgctttcagagcttttctaactaagcctgaagcatctcccagggcttgccctggctgggtggtgtggaaggaagacgggaagcaagttatc

SEQ ID NO: 18417 - DNA, 201 bp, Homo sapiens
ctgcagcacttctggtctaaaacatggaaagagcagagtcacacccaccgtctaagtcaagcctcccctgctggatcagacccagctacatgcctggcccrgtcacaacctccagccccttctgctgccccaggtgcaggccatgtgcgtgggctatgcacggggctcccctaggatgtttagcagtgacatgaagcaagt

SEQ ID NO: 18418 - DNA, 201 bp, Homo sapiens
gcaggaataaacactgcccccaagagttatgcccctccttgggtgtggctggggtacctggtacagccccagcatagtgcctggaatgcactatgcagccycagcatagtgcctggaatgggagcccatgagcaacttacatcaatgaagcagcccagcagggagcctctcttcaaagccttctctagaatctcatagaag

SEQ ID NO: 18419 - DNA, 201 bp, Homo sapiens
gtggctggggtacctggtacagccccagcatagtgcctggaatgcactatgcagccccagcatagtgcctggaatgggagcccatgagcaacttacatcartgaagcagcccagcagggagcctctcttcaaagccttctctagaatctcatagaagttctcgggggcctctttagtttggaaggtctctgccacaccccc

SEQ ID NO: 18420 - DNA, 201 bp, Homo sapiens
aatgttgatcctgttgcttttttcccctctgaccaagctacccatagacagctttgaaaatcacacacgggttccaaggtagggcacctgggctttgtccwccaagttacaagctgagtattccacccagcactaaccattgacatcagctgaaagactcagggtcaacccatcaaagccgcaggcgatgcagggggcagg

SEQ ID NO: 18421 - DNA, 201 bp, Homo sapiens
cggtctcccttttgtcttccttttcgtcttgggtggaagcacggtggtactcccgtaagcatcggaatagcatgatgctgttttcccttctcccctgtccraatacaattcctctagcctatagcctgcagcctgctgcaccattttaaatcccctctgctctaggttcactgggtcccccagaggccaagccctgctcca

SEQ ID NO: 18422 - DNA, 201 bp, Homo sapiens
gactgggatgatgcacctcagttgcactgagcgtagccggcccctccccagcacccctgtttccacttcctgcgggggctgctgaacctcggcctcatctrtgctccttcccctgctcgccccactcacccctggtcgtttccacacaaaggggatctgcggcctctcactgtagaacagggaggaattgctggctgggaa

SEQ ID NO: 18423 - DNA, 201 bp, Homo sapiens
cagttgcactgagcgtagccggcccctccccagcacccctgtttccacttcctgcgggggctgctgaacctcggcctcatctatgctccttcccctgctcrccccactcacccctggtcgtttccacacaaaggggatctgcggcctctcactgtagaacagggaggaattgctggctgggaagtctgcatcctcaaacag

SEQ ID NO: 18424 - DNA, 201 bp, Homo sapiens
agacatggtgccggacttgtcagcatcaaaccgaaggaaaaggttctaaagggtggagagcagaagccttgagaaggagcgtgcctgaaaggcatcgctgrtggcagtaaatgggtgacagccagcccgggggagctaccctctaggggccgcagaggccacagttggactgggccttccaaaagaagtcggtctcccttt

SEQ ID NO: 18425 - DNA, 201 bp, Homo sapiens
gaaggatttttcccacctcttcccacttttccaggcaccaggactgaggaggggcctgggctggaggtggaaggttccagcagtgtctgggcggacgccaygtggggagctcaagctgcgccgccttccccgagagacctctgctttgaattgtcttcctcaggcttctcagcaccctgcttctcctctcatcttgtgtcc

SEQ ID NO: 18426 - DNA, 201 bp, Homo sapiens
ttcaggagagttttgcaaattgcatttgaggaagagacaaaccataaaccaggagagaaaagagcgaggatggagagggaaggggtgggatggggcaaggstagctacagcagtcagcaggggaggcgtctctgggggaagcagaggagcacagacctaaacaaagggagggagggagggagggagggaggaagccgggcc

SEQ ID NO: 18427 - DNA, 201 bp, Homo sapiens
atgccagaggagataatactaaggaagacagccccttggagcagagatctgggactctagagtcgctgggcaggccttggtggccctggtcccaggagggragacttctgaagggggagacaaagatgccctccatgctggtttgtgcgtccagcttttatcttggagaattctaactttgacaaaaagtaagtgagttgt

SEQ ID NO: 18428 - DNA, 201 bp, Homo sapiens
ccagcctgtggtctggccaagtgatgtaaccctcctctccagcctgtgcacaggcagcctgggaacagctccatccccacccctcagctataaatagggcmtcgtgacccggccaggggaagaagctgccgttgttctgggtactacagcagaaggtaagccgggggccccctcagctccttctcggccttgtctctctca

SEQ ID NO: 18429 - DNA, 201 bp, Homo sapiens
gtggatcgcgtcttcctccagggcatcgggagtgaggttgcagatctccactttatcaaagtgggccttgaagtcctgaaatgccatcctgcagcaaagckgagagacacgatgcacaggagggcaagagtgagggcatcatccattcactcattcattaaatcattcacttattcattaaatcatcttgttcctgtccgc

SEQ ID NO: 18430 - DNA, 201 bp, Homo sapiens
gaccacttaggagaaaaggagaagggagaacttccagtattttatccaaattctttattcgtcactcagctagcccagacgtcttcttaggaagcattggragatatgagagagtggtgtggggtgggaagcaaatggttggggagacatagcatctggcttttttgggaagccctgctgggtttagacaaatctgcagac

SEQ ID NO: 18431 - DNA, 201 bp, Homo sapiens
ctgtcttgctgggtctgacccagcatgctccagatagcacctggagcagggaggtcaccactgccttcccccctcaccatgctctgtcccgcccagggctrcgctcagccaccttcctgctgtgctttaagcagtcacatgagcccccattttctccatccgatcctgtggtcccctaatctccctgccttgcctgtttat

SEQ ID NO: 18432 - DNA, 201 bp, Homo sapiens
gctgagaagattgacaggttcatgcaggctgtgacaggatggaagactggctgctccctgatgggagccagtgtggacagcaccctggctttcaacacctrcgtccacttccaaggtaaggcaaacctctctgctggctctggccctaggacttagtatccaatgtgtagctgagatcagccagtcaggccttggagatgg

SEQ ID NO: 18433 - DNA, 201 bp, Homo sapiens
ccggaaagttcacaaaaacagaactctgttcccttggatgggatcccaaagtggcaagaagacccccaagtcccttcaaaagctccccacccccaccactrggcagtcttgtgcatcttgattctgatccaatttcagcatgggggtcccccagctttgggttattttctgtgaagaagactattctgctggctaaggatg

SEQ ID NO: 18434 - DNA, 201 bp, Homo sapiens
ggatgaaggcctcacccagcgtttggggcaatgccagaggagataatactaaggaagacagccccttggagcagagatctgggactctagagtcgctgggsaggccttggtggccctggtcccaggaggggagacttctgaagggggagacaaagatgccctccatgctggtttgtgcgtccagcttttatcttggagaat

SEQ ID NO: 18435 - DNA, 201 bp, Homo sapiens
catgctcatcctcagcccttttgttcctgattttacagaaatctgtaagatatgatgtaaagctcctaactcccctaaataagaaacagataggggtacgrgaatgaggaccagaccaaagggacaatcttcagttgcagacaaaggaaaaggcagaacagattctgaaaatgagtctgtgggaacgacagcaacacagta

SEQ ID NO: 18436 - DNA, 201 bp, Homo sapiens
cctcgatggcgctgcctcccttcagagcttcatagctcccatttagcctgcaagggtggcaagagagagaggagagagtcagggacctagggaggccactrgggcaccctgctttcagagcttttctaactaagcctgaagcatctcccagggcttgccctggctgggtggtgtggaaggaagacgggaagcaagttatca

SEQ ID NO: 18437 - DNA, 201 bp, Homo sapiens
ccaagcggtccctgaaggtgggcaggcggtcatcgatcaccacgtccagccactcactgtgctgccagaactgttgcccaggaaaaagacagaaatgatgygagtcagctacatgggagctccaggccctgtttgtaaatgttgatcctgttgcttttttcccctctgaccaagctacccatagacagctttgaaaatcac

SEQ ID NO: 18438 - DNA, 201 bp, Homo sapiens
ccgcttgagccctgagagggttgggtcctgccgagcctcacctgcaaacccagagccctgattttttcccagcccttagatgctcactacaaagactagtrtagagactcctgtcgggaggctgcctgagctggggaagctgtcactcacttggcgtaggctttttccagcaaggcgctccagaactcgttgtggtcggca

SEQ ID NO: 18439 - DNA, 201 bp, Homo sapiens
cactctcatgtcaaatcccagcgtcttttgggaggcagcttcccttttttagtttagtttgttggaagaaaagaattgtccctttcccccctctaaactawaagccttgccagcccaggtgggcagcaccgaggtccctgcagggaacgtgcaaggggaaccctgcagtttcccgctcacatgcccttccgagactgagtg

SEQ ID NO: 18440 - DNA, 201 bp, Homo sapiens
ggaggtgttcacaggattgttcagaaatccacccagggtctttctgcttcttcctaattccagcagaggagcaggcaggtcagacacagagcacagagtcyctggagcctgcacggcagtgctggctgccagccttggccagaatcctgatgtttggggctagaggagggggatgaggggcgattctccccacaccacgtc

SEQ ID NO: 18441 - DNA, 201 bp, Homo sapiens
gtcccactagagaggacctgaggatctggggcctgatgggctccagggtaccgtctgcccagtgcttgctgtgctcctgagcatggggcgctggccctggyggtttccatgacaccaggtcctgacttgacctcgacagatttacctagcctccggatgagaatggtgagctgtgcgtgtcagacgagcagagggaagacg

SEQ ID NO: 18442 - DNA, 201 bp, Homo sapiens
gaaacttgcacaaaatgatccacaaaaaagaaacatgacaaaaatagcaggaaagaagccaggagcctgtgtgcccagccccatgtcaccctcctgaggcrgtgtgcacaagctgcgtcctgtagcgtgaggaacattttctcatgaaggctcttttagaaggtgagactagaaggactttattagctggacctgtggagc

SEQ ID NO: 18443 - DNA, 201 bp, Homo sapiens
agcagctcggcaaatccatgggtggggtggggctgaggggtgtgtctaagagacactgaggaggctctgtcaagatgttaacctcgtgagggacagagagycaggcgggaggtgaaagacaagactgtggagaaagaggttcagtggcgcatagtgatttttcttaccacgacaacctccttgaggtctttcccttcgggt

SEQ ID NO: 18444 - DNA, 201 bp, Homo sapiens
cccaaaagccctcaacagatttctgtttgtctcattggtcagaactatcttacttgaccactaatggttacagaggagagcagtgatgcaggatttttctyggtccctttgccagtcagggacctcttgctggtgatgctggaggccttgcttggggcacactacctgtccctggaggtgcctcacccaatcggcccccct

SEQ ID NO: 18445 - DNA, 201 bp, Homo sapiens
tggacacatcaccactcccaacctgcctcacccactgcgtcacttgtgatcactggcttctggcgactctcaccaaggtctctgtcatgccctgttataaygactacaaaagcaagtcttacctataggaaaataagaattataacccttttactggtcatgtgaaacttaccatttgcaatttgtacagcataaacacag

SEQ ID NO: 18446 - DNA, 201 bp, Homo sapiens
attttaaaaaatatcattagacttctatctgctatttttttcatagtacatgaaatgaaaaaaaaaaaacaaatttcagaaaactagataggaagatcccrtttcagtaaaatcaaaccaactgaccttgatgtttgtgtgtggaagtgtgtgcctgtttgtacgagcagatagagagctgggaaggatacaggccaggtg

SEQ ID NO: 18447 - DNA, 201 bp, Homo sapiens
atagagaaaattttaaaaaatatcattagacttctatctgctatttttttcatagtacatgaaatgaaaaaaaaaaaacaaatttcagaaaactagatagraagatcccgtttcagtaaaatcaaaccaactgaccttgatgtttgtgtgtggaagtgtgtgcctgtttgtacgagcagatagagagctgggaaggataca

SEQ ID NO: 18448 - DNA, 201 bp, Homo sapiens
tataagtgtgtgtgtttgtatgcatagagaaaattttaaaaaatatcattagacttctatctgctatttttttcatagtacatgaaatgaaaaaaaaaaaacaaatttcagaaaactagataggaagatcccgtttcagtaaaatcaaaccaactgaccttgatgtttgtgtgtggaagtgtgtgcctgtttgtacgagca

SEQ ID NO: 18449 - DNA, 201 bp, Homo sapiens
gggccgggctcggtcagtctccagctgggatccccagagtggtcaccctacccctccctcgagacagactgcctgactgtgtgtcatcaggctggtcaccrtctccctgaacctcgatttgctcacctataaaatggaactaataacgatgcctgggctccctgtctcaggggctctggtatagctgaagagaactaatat

SEQ ID NO: 18450 - DNA, 201 bp, Homo sapiens
gacctcgacagatttacctagcctccggatgagaatggtgagctgtgcgtgtcagacgagcagagggaagacggcagccactctcatgtcaaatcccagcrtcttttgggaggcagcttcccttttttagtttagtttgttggaagaaaagaattgtccctttcccccctctaaactaaaagccttgccagcccaggtggg

SEQ ID NO: 18451 - DNA, 201 bp, Homo sapiens
acacacaaatttgtgtccttctcccacaacgggctctcccgagttctctgtcatctgcacggccctgtgagcaggaggggaaacagagggctcacccctgyccccaaggcccagtgtgcaaatccattcatcacaacgaggttgtgtgagtctccccagtagcaagggctgctgaggaatggagccctcgtttccggggcc

SEQ ID NO: 18452 - DNA, 201 bp, Homo sapiens
aagaaatgttatcaagaaaatcatagggaagaggaaatacatttactatttattaagtggaactgggtcattgtaaaggtcttcatccttattatcttcaygttgagtaggctgagaaggaggaggaggagttggtcttgctgtctcaggggtggtagagatggaagaaaatccccatataagttcaagcctgtgttgctc

SEQ ID NO: 18453 - DNA, 201 bp, Homo sapiens
ttgtgctctgcccaccctccccaagcacagctgtgtttgacaagaaggtggtgctgaggaggagggccgtccagccccacggtcccacgggctgctgagaygtgcaccgtgtaatgctgagtcccactgcaaatgatgcccaagccacagaggtctgcagggaacctggcaatgcttgtgatttccctatggcccgctacc

SEQ ID NO: 18454 - DNA, 201 bp, Homo sapiens
ggccaagtgatgtaaccctcctctccagcctgtgcacaggcagcctgggaacagctccatccccacccctcagctataaatagggcatcgtgacccggccrggggaagaagctgccgttgttctgggtactacagcagaaggtaagccgggggccccctcagctccttctcggccttgtctctctcagatgtaactgagct

SEQ ID NO: 18455 - DNA, 201 bp, Homo sapiens
ctgagatcacatcatggcactccagtcttggtgacaaaagtgaaactccatctcaaaataataataataataataaacaatttctaagtattattcttagyagtcacctacgcatggcactttgtgcagatgactcctgcatgtgtcagggtttttcttgcgggcaatgcagtctgatcagtataaactaggcagagaggt

SEQ ID NO: 18456 - DNA, 201 bp, Homo sapiens
cgggagaagtagggagacatagaaggggcaggtgctggccaagaggcaggggcaggagaggagaaggcggaggggcactcagggcgagggtgtcaggcccrccaccccagagcaccattactcccaggacgcggctgcgtgcagacctggaaccagcctagggagcagccgcagatcacaactgagaacaaacgacagtct

SEQ ID NO: 18457 - DNA, 201 bp, Homo sapiens
tactgtattcttacaataaataagccagagaaaagaaatgttatcaagaaaatcatagggaagaggaaatacatttactatttattaagtggaactgggtmattgtaaaggtcttcatccttattatcttcatgttgagtaggctgagaaggaggaggaggagttggtcttgctgtctcaggggtggtagagatggaagaa

SEQ ID NO: 18458 - DNA, 201 bp, Homo sapiens
tacagcagtcagcaggggaggcgtctctgggggaagcagaggagcacagacctaaacaaagggagggagggagggagggagggaggaagccgggccggtcycgggagaggtaacagccaatcctgtggcagcgaggcacgttctggctcaccctgcaggggtggtgagttaactgggccggggcctgcagaggagtgaagg

SEQ ID NO: 18459 - DNA, 201 bp, Homo sapiens
cccttcaatcaagaagagtcagatgaaatgaattagcagggccagcccaagaacctcttctgggggtctcagggtagctttcatttgtagcagctgaggckgaagcccagctgcaaggcctttgagagaacgtggtgctggacccgtgtctagggcaggggttctaaaccctgcttacatatcagagtcacctgagaattt

SEQ ID NO: 18460 - DNA, 201 bp, Homo sapiens
atcgggggctgtctcgggacctctaggtttccctttagcaatgatgttctatttacatgacctcagcaggcagctagatgtgtcccactagagaggacctraggatctggggcctgatgggctccagggtaccgtctgcccagtgcttgctgtgctcctgagcatggggcgctggccctggtggtttccatgacaccaggt

SEQ ID NO: 18461 - DNA, 201 bp, Homo sapiens
aatgtggctttagcatggtttaggaccatatgtcacacagatctgatgacatttttttctagggttaccaggcagtgtggaaatgcacctgccctcatgcygggccccagagaggtaaacccactggcccagggctccctcttacctggaaatggaatatcccggcataaccagggccaaagctttggtcctgggggatga

SEQ ID NO: 18462 - DNA, 201 bp, Homo sapiens
tagggtcctcaggaacggagcagactggtacaggaacagagtcatcatggccaagagtccaccgggtcctcttgccatcaggaggaatagcagggcttgtrcaggaattggggctggagggaagggccgggctcggtcagtctccagctgggatccccagagtggtcaccctacccctccctcgagacagactgcctgact

SEQ ID NO: 18463 - DNA, 201 bp, Homo sapiens
tatgtcacacagatctgatgacatttttttctagggttaccaggcagtgtggaaatgcacctgccctcatgccgggccccagagaggtaaacccactggcycagggctccctcttacctggaaatggaatatcccggcataaccagggccaaagctttggtcctgggggatgactctggccagtgctttttgattaagcgt

SEQ ID NO: 18464 - DNA, 201 bp, Homo sapiens
gtgagccccacatcacaggcatgtctgactctagaggaacggaggtgcaggggcttgaggccactggactccattcagagggagtgaggaagcagaggccraagcagtgttgttcccccagccccgtgcctcttgggtcctcagggaccccatgctgcagttgcttgcctgtcccagtgactcaacctccctctcgccatg

SEQ ID NO: 18465 - DNA, 201 bp, Homo sapiens; identical to SEQ ID NO: 2798

SEQ ID NO: 18466 - DNA, 201 bp, Homo sapiens
cagaggccgaagcagtgttgttcccccagccccgtgcctcttgggtcctcagggaccccatgctgcagttgcttgcctgtcccagtgactcaacctccctytcgccatgctccatccacttacactcacccagctctccctggcagatatcagtcctggtggcccctccaagaatgaattctgggtttttcacgatttcct

SEQ ID NO: 18467 - DNA, 201 bp, Homo sapiens; identical to SEQ ID NO: 2802

SEQ ID NO: 18468 - DNA, 201 bp, Homo sapiens
gaggccgaagcagtgttgttcccccagccccgtgcctcttgggtcctcagggaccccatgctgcagttgcttgcctgtcccagtgactcaacctccctctygccatgctccatccacttacactcacccagctctccctggcagatatcagtcctggtggcccctccaagaatgaattctgggtttttcacgatttcctgg

SEQ ID NO: 18469 - DNA, 201 bp, Homo sapiens
gcgcctgcctgctgctgatccagcctcactatgcctctgacctggacaaggtggagggtctcactttccagcaaaactccctcaactggatgaagaaactrtctccccggtaggagcctcccggtctcccctggaatgtgggagccacactgtcctgcccaggctgggggcggggtggggagtagacacacctgagctgag

SEQ ID NO: 18470 - DNA, 201 bp, Homo sapiens
aaccagatgccccgggtccccaccgcagagcatcccaggcctgtacattattttctgcctccaaactgcaaagctttccacggtagactgggatgatgcamctcagttgcactgagcgtagccggcccctccccagcacccctgtttccacttcctgcgggggctgctgaacctcggcctcatctatgctccttcccctgc

SEQ ID NO: 18471 - DNA, 201 bp, Homo sapiens
gcctactcaacctgaagatgataagaatgaaggccttgatgatgatccacttccatttaatggagagtaaatatgttttctctttgttacgattttcttartaacattttattttctgtagcttactttgtgcacagtatataatatacacagtatttaatacctacgacataaaaatatgtgttaatcaacattagatta

SEQ ID NO: 18472 - DNA, 201 bp, Homo sapiens
tcaagacggacagtaactgttaccaactgagtcagcttttcccctaaagatggtatcgtgaagccaatacatgaaacccaaagcgagcctcaagcagtgcrgactttattcaatggccaaagaatggagaagcaggagcatggccgcaagtcaacttcttgtctagtgagaggtgagggggttaaaatatagggtatcctg

SEQ ID NO: 18473 - DNA, 201 bp, Homo sapiens
accaatgcacccactctgatccagctgtttcccttctagaaatttatctttatcctgatgatagagccgcaccccgaaaagtgaaaggtataccagcttgytcatttcatggtggcattgtttacattaaaaaaggttggaaagcacttagtgccctctgttgggggaatggtaaagaaaattatggtccagctaatcatg

SEQ ID NO: 18474 - DNA, 201 bp, Homo sapiens
ttctctgggggtcatcagacgggtgaaatttgagctgagatatgagtgatgaggagccgctgcacaaagatgctggatagagggaacagcaagatttgtgycttaggaagctttgagtttctgtgggttttgttgttgttgttgttgttattattttttttgagatggagtctcactctgtcacccagtttagagtgcagt

SEQ ID NO: 18475 - DNA, 201 bp, Homo sapiens
acaaataaacaaacaaacaacaaaaaataatgctttctgtacataaaccagcacataagtaatataatttcatgggatgatagtcactatagagaagatargggtggtgcagtggaataaggtgagatagggttggtgggcagggctcttctctgggggtcatcagacgggtgaaatttgagctgagatatgagtgatgag

SEQ ID NO: 18476 - DNA, 201 bp, Homo sapiens
cagccctaccctgctcttggtgggcacagagagttgtgagacctacctctggccagacactgttctatgtgtggaaatattgcaatgaagaagatcaaccmtccaaatgctcactgtggccaggctcggtggctcatgcgtatcattccaactctttgggaggccatggtggaatgattgcttgaggcccagaatttgaga

SEQ ID NO: 18477 - DNA, 201 bp, Homo sapiens
cgggtttgtggaagcaaagccacttgcaaagtctggcacatggaggggatcaggagctgctgattcctccctttcccctatcctctctgcaccccctgccmctcccacagatgctgctgaatttcatggtctccttctgagcctgacttgcctcaacttgcaaggcatctcttttgtctctttgtttgcacaatgaaggac

SEQ ID NO: 18478 - DNA, 201 bp, Homo sapiens
gaaacactgagtttcagagctgatagtaatgctgtatcatttcaatcagaaaggaattttgcaaaaaggaactgacttttttgtttgtttgtttttgagayggagtttagatcttgttgcccacgctggagtgcaatggcgcaatctcggctcactgcaacctctgcctcccaggtttaagtgattctcctgcctcagcct

SEQ ID NO: 18479 - DNA, 201 bp, Homo sapiens
accctgtctccaaaaaaaagtaaataataataaaaaaaagagtggggctattggttagtggaaggaagaccggagaggtaaagctcccctctcatctcatsatatcaagagtacctgccgtccacatgccttaccacagctgatgctggccttgatcacctggctaaggtagtgttagtcaggtgtctccactggaaagtt

SEQ ID NO: 18480 - DNA, 201 bp, Homo sapiens
tcttcacaaaaatgttatatacatttgaaagagaggagaaagtgcttataattacaagttttctaaggtaaatgctctgagaataagagagggagggaaayctcttcccccattttcaaccgggagaattaagcctcttgtttttaagttgcatttgtccttacagtggctactaggtgttgggaacactgcccgggagct

SEQ ID NO: 18481 - DNA, 201 bp, Homo sapiens
actattctaagaacctcgtaaaagtggaatcatatagcatttgtcttgttgtgactggtttatgttacttagcataatgtcttcaaggtccatccatgatrtagcatatgtcagaatgtcctttctattttgcttgaataatattccatcgtatggatatgtcatattttgtctttctatttatctgttggtggacacttg

SEQ ID NO: 18482 - DNA, 201 bp, Homo sapiens
aaaaaaaccagccagttatatttaccagctattaattaaatttttcactggaagcagtcttgccttgtacatagggatgaaacacacacacacacacacamatacacacaccatatatatatttataaatgcatatataaaaattatggtaaaatacatgtaacataaaatttacaaccttaaccatttctaagtgctcag

SEQ ID NO: 18483 - DNA, 201 bp, Homo sapiens
tgggactatagtcatacccagctaattaaaaaaaaaaaaaaacctgtagaggagggagtctcagtatgttgcccacactggtcttgaactcctagcttcawatgattctcctgccttggcctcccaaagtgctggggttacagatgtgagccactgcacctggccttattatgtttaattggagggaacattgataaagtc

SEQ ID NO: 18484 - DNA, 201 bp, Homo sapiens
agttgagcagcccatactgctgctctacctacggagtggccattctttctttacgtctttataaacttgctttcgatctatagactcgtcctgaattcttycttgcgtgaggtccaagaaccctctcctggggtctggatcaggacccctttccagtaacaggtccacttttccccaaataagtgatcttcctcctccttc

SEQ ID NO: 18485 - DNA, 201 bp, Homo sapiens
aatgataaatatacctgtctgccttctgctaactctctgggatttctttccctggagtttgacctcagcccaagacgatttcctttctccttctcatctasgagctggaggttgatgctatgcacagatcttaggatgacttgaatcacaggtgcagcaggataggaatttactctccgcagtttagggcccaaaaaaatc

SEQ ID NO: 18486 - DNA, 201 bp, Homo sapiens
agaggagcacagacctaaacaaagggagggagggagggagggagggaggaagccgggccggtctcgggagaggtaacagccaatcctgtggcagcgaggcmcgttctggctcaccctgcaggggtggtgagttaactgggccggggcctgcagaggagtgaaggatttttcccacctcttcccacttttccaggcaccagg

SEQ ID NO: 18487 - DNA, 201 bp, Homo sapiens
aattgaacctttcctcaaacacaaggcacaaacctgccccagcccatcatcctcccacagaggcactgtgaatgtataaagaaaggcgatgctaagaaacrtgctgcaggggaggctggcacattctgctccttagctaaccgcacaggcccatgggtccacacacatcagaccatggctctctgtggtctatctttgcca

SEQ ID NO: 18488 - DNA, 201 bp, Homo sapiens
taaaaagtttctaccaatgttcacagtggtttaaaatgagggccctggtgtcaggaagtgagtcctgggtctgaaccctggtgccaccactccaagggccrtgaccttaagaatcaccaactgggctcagaggcccacctcctgggcagcagagagaagacctgccatctgctcaggttgcccacaggcagtacctggcat

SEQ ID NO: 18489 - DNA, 201 bp, Homo sapiens
caggttgcccacaggcagtacctggcatgcagtcagccacctgtactccagtcttttctttacctgcagctttcagtgcagtccgtagttcataggtagayatggtgccggacttgtcagcatcaaaccgaaggaaaaggttctaaagggtggagagcagaagccttgagaaggagcgtgcctgaaaggcatcgctgatgg

SEQ ID NO: 18490 - DNA, 201 bp, Homo sapiens
tgtccctcacatagtattgcaaatgacatgaaggatttttattgtaggttttgctgaaattttccccaagggggaggatgacttagttgggtgatgggggkagcaaacatccctgtcgtcagggttgggtgcaaggagcataagcctgcctggcctctgggagagccctcactgtgtggcctggagccttcctaactgtgc

SEQ ID NO: 18491 - DNA, 201 bp, Homo sapiens
ttggagccattatcctaagtggctcacacccagataattggcctgacaggctggccatgcggtgccttcaaccctactcacatgtcaccagcagcacagcraagtcagggagtcgggatggcgcctgcccctcccatcacccatggaggctgcatgagtggaagacaaattttattccagccttggctctcagtcactttc

SEQ ID NO: 18492 - DNA, 201 bp, Homo sapiens
gccgcagaggccacagttggactgggccttccaaaagaagtcggtctcccttttgtcttccttttcgtcttgggtggaagcacggtggtactcccgtaagyatcggaatagcatgatgctgttttcccttctcccctgtccgaatacaattcctctagcctatagcctgcagcctgctgcaccattttaaatcccctctgc

SEQ ID NO: 18493 - DNA, 201 bp, Homo sapiens
caggtataaatattgaaacctccttagcgaaaattataacggtgagcaaattatgacagcggaggagatctgacctaaccatctccttcttgccttttaayctctaaactgtcctgggtcattttggggcatgggtcaagctaactttaggagaaatttagtttatagtttaaatgatgatagaccttcccaaaactaagt

SEQ ID NO: 18494 - DNA, 201 bp, Homo sapiens
cctacaaatcagccctgggaagcagatctgcggctcggaggagcagggaggggacccaggcagtgtggtcgcttgtccctccataggtgccccaggacccygatggggttggcacttactcttttgcagcacagcatttaaaacatactcaagttcctctgctgtcacctccatgtcctgttgaagtggagacaattgttt

SEQ ID NO: 18495 - DNA, 201 bp, Homo sapiens
gtcaggcgtggtgggggtgcctgtaatcccagctacttgggaggctgaggcaggagaattgcttgaacccgggagtcagaggctgcagtgagccgagatcsagccacggcactccagcctgggcgaggagcgagactccatctcaaaaagaaaaagtaaaacacccccctacttgctgaagggagtgtaaattggtgtctc

SEQ ID NO: 18496 - DNA, 201 bp, Homo sapiens
caaactcctggcctcaagtgatcctcccgccttggattcccaaggtattgaggttacagacacatgccaccctgctcagtgtttctttttacagagatgcrcttaggtaaaatttcatgtatctataccatataaagagagatatgcacacatctctcatattgtttcaccgaagtgcattatatatatatattattctat

SEQ ID NO: 18497 - DNA, 201 bp, Homo sapiens
tttctcttcttcttgttcatcttgaagggcagcaggaggtgaacatagtgcctgggtggctctgggatgccatggggcaaaaccccaaggacaaatgctcrgaagcttcacatgggtgcagggagatgacctctaggaccccacccggtccaggccttacagcagggcctgggttttgagggatatgccaaacagcctgga

SEQ ID NO: 18498 - DNA, 201 bp, Homo sapiens
tgcctcaagaaagcagatggcattcttgggtgtcttcatttagttttccaaaccttcacttctcaggatgaacaatagttacagaaactgcagccatgcartctaaggtctaccaggccttgcacacttcctcacccacactgggaaatgccctgagtggctcagagggaaagggctctgagcttgggcagagaatcatgt

SEQ ID NO: 18499 - DNA, 201 bp, Homo sapiens
ctgctgattcctccctttcccctatcctctctgcaccccctgcccctcccacagatgctgctgaatttcatggtctccttctgagcctgacttgcctcaamttgcaaggcatctcttttgtctctttgtttgcacaatgaaggactttggaactggggtcctctggctgggaccagagtgcagttctggccagtccaaatg

SEQ ID NO: 18500 - DNA, 201 bp, Homo sapiens
ggtgatcttgggcgagttatccatgctgtctgtccctgcttccaagctgtgaatcaggataatcggtgctgcctgctagaggcatggcgggtttgtggaarcaaagccacttgcaaagtctggcacatggaggggatcaggagctgctgattcctccctttcccctatcctctctgcaccccctgcccctcccacagatgc

SEQ ID NO: 18501 - DNA, 201 bp, Homo sapiens
gaaatgataaatactggaggggatagatagcctaaataccccaactcgatatcacacattctgcacatgtaacaaaatagcacatgtaccccatcaatacrtacaaatattatgtatcaataaaaataagtcaataaaagtattagtcaccacgtgaaaactctgatgttctaagcactttataatgatttctgtgtgatt

SEQ ID NO: 18502 - DNA, 201 bp, Homo sapiens
tgaacctgggaggtggaggttgcagtgaactgaggtcgtgccactgccctctagcctgggtgacagagagagactctgtcaaaaaaaaaaaaaaaaaaaargaaaaaagagagagagagagaaagaaaagagagagagagaaggaaagaagaaaagaaatgataaatactggaggggatagatagcctaaataccccaact

SEQ ID NO: 18503 - DNA, 201 bp, Homo sapiens
ccatagagtctcgctgactttacaggaagctttgtttgggggaacttaacactgggtggtgtctgagccccaagttcattcctacaccagcctcccctcgygttctatgtctcaggtcacttccagctgtggccctagaaagtttcttggaggggatgctgctgcccacggagaatgatactctgccagggcccattccta

SEQ ID NO: 18504 - DNA, 201 bp, Homo sapiens
gataaatgtgtttgcccatagaaatgattatacaggctgggtgtggtggctcacacctgtaatcccagcactttgggaggccgaggagggttgatcacccraggtcaggagatcaagaccagtctggccaacatcatgaaaccctgtctctactaaaaatacaaaaaattagcccggtgtggtggcggatgcttgtaatcc

SEQ ID NO: 18505 - DNA, 201 bp, Homo sapiens
caaaggcaggtgggggttagatttcatccaacctgacccctgatagaggagaactcacagaggacatcggctcttcctctagggcacatgtgcctctttcrttctctagacatcatattaataaagttccttgttgttatagtcctacaaataggatctcacgtctgagaaaaaacaaatgttagaggatggaggtggttt

SEQ ID NO: 18506 - DNA, 201 bp, Homo sapiens
tctcatgtcaaatcccagcgtcttttgggaggcagcttcccttttttagtttagtttgttggaagaaaagaattgtccctttcccccctctaaactaaaarccttgccagcccaggtgggcagcaccgaggtccctgcagggaacgtgcaaggggaaccctgcagtttcccgctcacatgcccttccgagactgagtgctc

SEQ ID NO: 18507 - DNA, 201 bp, Homo sapiens
ttcagcactggggtcagcaaaccttttctgtaaaggcccagaccatgaatattttcagctttgtgggccacgcaaagtctgtgctgcaactactcaacttwgctgttgtagtgacaaagcagccgtagatgtgacacagatgaatgggtgtggctgtgttccaataaaactttatttacaaaggcaggtgggggttagatt

SEQ ID NO: 18508 - DNA, 201 bp, Homo sapiens
gcagagggaagacggcagccactctcatgtcaaatcccagcgtcttttgggaggcagcttcccttttttagtttagtttgttggaagaaaagaattgtccytttcccccctctaaactaaaagccttgccagcccaggtgggcagcaccgaggtccctgcagggaacgtgcaaggggaaccctgcagtttcccgctcacat

SEQ ID NO: 18509 - DNA, 201 bp, Homo sapiens
ctccctcacataggacccgagatggtcctggctgtgtatacttcatccttttatcaggcctgagcctggacatgtttccagattttgctttccctgggagrgaaccactttaaaaggttcaggaggcccctatctgtgaggtgtgcttggtgagaagcgcaggcagcccggcaggcgggaggtctgcagagcgctcgtgga

SEQ ID NO: 18510 - DNA, 201 bp, Homo sapiens
agcaaacatccctgtcgtcagggttgggtgcaaggagcataagcctgcctggcctctgggagagccctcactgtgtggcctggagccttcctaactgtgcrtcatctccccaggaccatccacctgaccatgccccaactggtgctgcaaggatcttatgacctgcaggacctgctcgcccaggctgagctgcccgccatt

SEQ ID NO: 18511 - DNA, 201 bp, Homo sapiens; identical to SEQ ID NO: 2796

SEQ ID NO: 18512 - DNA, 201 bp, Homo sapiens
gatggggttggcacttactcttttgcagcacagcatttaaaacatactcaagttcctctgctgtcacctccatgtcctgttgaagtggagacaattgtttkttatagcccttggcaccttcttttatagtttatttttgttttaaatcagttctgagcttcatttggctccagtgacagaccagccttcaggaccctgctg

SEQ ID NO: 18513 - DNA, 201 bp, Homo sapiens; identical to SEQ ID NO: 2797

SEQ ID NO: 18514 - DNA, 201 bp, Homo sapiens; identical to SEQ ID NO: 2801

SEQ ID NO: 18515 - DNA, 201 bp, Homo sapiens; identical to SEQ ID NO: 2803

SEQ ID NO: 18516 - DNA, 201 bp, Homo sapiens; identical to SEQ ID NO: 2807

SEQ ID NO: 18517 - DNA, 201 bp, Homo sapiens
gctccagtgacagaccagccttcaggaccctgctgtgggcagatgtacctatctcctgtgtagctgcagctatgtgtctcatatgtcacatgttttagggrcatgccagcccaactaggagagagcctaacttgagagacatcccaacccaggaaagcgcatgaaaagctgggcagggcaaggcagtggtttcccagcttc

SEQ ID NO: 18518 - DNA, 201 bp, Homo sapiens
tggtcttactttgcaacaagctccatcatgcctcaggatgacgttgctgaccaaccccacgactgcaaccctttgctaggaagcaggtccaggccctcagsctggtggggagatggaagtggggcatgtcctacctcaccagcgacttgttcaaacagagcccgaaaccgctgctcctcctctgtctcctggtcaggtgga

SEQ ID NO: 18519 - DNA, 201 bp, Homo sapiens
ggaagctgttcctctgactcaccgggtaatggcttttttctctgaaaagattctcagacagaaatcagcttcctggtggggctcaaaagtgctgggaatcmggatgtactccccagggggcagcttgaaccggtcggagacttctctcaggttgatgaacgtcttgcttctggcccgagaagcgtggtatctgaagaagtc

SEQ ID NO: 18520 - DNA, 201 bp, Homo sapiens
gcctatcacctgctgacaagacccactctgactccaggtcctcagcctcggtgggagtcagacagcttggagccggggagcgggtacaaccagatgccccsggtccccaccgcagagcatcccaggcctgtacattattttctgcctccaaactgcaaagctttccacggtagactgggatgatgcacctcagttgcactg

SEQ ID NO: 18521 - DNA, 201 bp, Homo sapiens
ccacacacagggtgggggcctgtccttgtggataaggttttgattcgtgcctatcacctgctgacaagacccactctgactccaggtcctcagcctcggtrggagtcagacagcttggagccggggagcgggtacaaccagatgccccgggtccccaccgcagagcatcccaggcctgtacattattttctgcctccaaac

SEQ ID NO: 18522 - DNA, 201 bp, Homo sapiens
acccagtgaccagctggtgcctcttgggacgacacctccagactgtcagaggtggggcactgttcaccctgatctctgggaatggggggtgcatggttctygggagaagattcctgcttcccttgtattccatctgtcacccggttgctgagaccttgctgagccaaacatccatccacactgagcaccctcagctctggg

SEQ ID NO: 18523 - DNA, 201 bp, Homo sapiens
cgggcactcaggatctcacttgtaggaccagcatcccttgtactgcccctccttgcccaaaagcaaccggaccccacaggagccactcccaggcccgtacmcacctggagggaatggaagccagcccagctggcgccgggtcagaggtagagccctgactaatccagcaccgcaaatattgacatggcgtcccaggcacaa

SEQ ID NO: 18524 - DNA, 201 bp, Homo sapiens
cattagccattattgttcccattttacaggtgaggagactgaggctcagggaaatgaagtgatatgactatatgcatgagacaaattgtcaggataagacrggcactcaggatctcacttgtaggaccagcatcccttgtactgcccctccttgcccaaaagcaaccggaccccacaggagccactcccaggcccgtaccc

SEQ ID NO: 18525 - DNA, 201 bp, Homo sapiens
taatcattgtaatgatgataataatagtatcagtaatagtaataatgtgacaatagctgtaatgtactggaaaccttctgtgtgctagacattggcctgcrttagccattattgttcccattttacaggtgaggagactgaggctcagggaaatgaagtgatatgactatatgcatgagacaaattgtcaggataagacgg

SEQ ID NO: 18526 - DNA, 201 bp, Homo sapiens; identical to SEQ ID NO: 2788

SEQ ID NO: 18527 - DNA, 201 bp, Homo sapiens
cggctccctgcgactctatgctgcaaaaagagtctccatgctcatcctcagcccttttgttcctgattttacagaaatctgtaagatatgatgtaaagctyctaactcccctaaataagaaacagataggggtacgagaatgaggaccagaccaaagggacaatcttcagttgcagacaaaggaaaaggcagaacagattc

SEQ ID NO: 18528 - DNA, 201 bp, Homo sapiens
tggggcaaggctagctacagcagtcagcaggggaggcgtctctgggggaagcagaggagcacagacctaaacaaagggagggagggagggagggagggagraagccgggccggtctcgggagaggtaacagccaatcctgtggcagcgaggcacgttctggctcaccctgcaggggtggtgagttaactgggccggggcct

SEQ ID NO: 18529 - DNA, 201 bp, Homo sapiens
aggagggagattaaatttccctctaatctgggtgtatatgaggagtctgagacagatgaatttgatttgccaaaaatggagagagaaggctgggcgtggtrgctcatacctgtaattccagcactttgggaggccaaggtgggtggtttctctgaggtcaggggttcgagactagcctggccaacacggtgaaaccccatc

SEQ ID NO: 18530 - DNA, 201 bp, Homo sapiens
ataggtttagagacagaatcttgctgtgtcacccaggctggagtgcagtgacatgatcatagctcactacagccttgaccttctgggctcaagcaatcctyccacctcagcctcccaagtaactgggactacagacgtgagtcaccacgcccagccactttttaatttttttttttttttttgtggagatgggggtctcgc

SEQ ID NO: 18531 - DNA, 201 bp, Homo sapiens
acctttcagaaggaaaattggctaaatgtgaaaaaagcaataaaagtgggaatacgccttcatccatttattctagttctaagaaccccgagcaaagaatwacatatgaagatttttgtcatcatattatttatagtggcaaaaatttggaagtgaaataatgaccaatagagaggcatggtcaataccttaggctatgtc

SEQ ID NO: 18532 - DNA, 201 bp, Homo sapiens; identical to SEQ ID NO: 2799

SEQ ID NO: 18533 - DNA, 201 bp, Homo sapiens
gggagggaaccactttaaaaggttcaggaggcccctatctgtgaggtgtgcttggtgagaagcgcaggcagcccggcaggcgggaggtctgcagagcgctygtggaaactacggttgtgtgtgcaggacatgggaccacagagatgccgacagccatccagcaccggacaagagtgggaaatgccacctggagcccagcct

SEQ ID NO: 18534 - DNA, 201 bp, Homo sapiens
agtcctccctttcctcctcatcccctgggcatccataacataaccctttcagaacttctgtttgtttaatcaggagtctgtctgagagctaaaccaatgcraacacagctcagtgtgaatttttgttaccaagctacagagctgattcttatactcaatatcatagcagattaaagaatcttgttcagagcaagattgagt

SEQ ID NO: 18535 - DNA, 201 bp, Homo sapiens
cgcgaacccagcttccctgatggaccgtcacctcccatttgtggatcgcgtcttcctccagggcatcgggagtgaggttgcagatctccactttatcaaaktgggccttgaagtcctgaaatgccatcctgcagcaaagcggagagacacgatgcacaggagggcaagagtgagggcatcatccattcactcattcattaa

SEQ ID NO: 18536 - DNA, 201 bp, Homo sapiens
gcagctaggcggtgggcctgggttagatgcctgggagtggtgtgtatgctgacggcccacatgcccacatgtgcaaggtgcctgtgacttgccttgttgtrtgtgcccaggtgtggtacacgtgtgtgcttgtgcatgctccacatgtatgctggttgcatgtgcacttgggagcattgtctacgtgtgagtgtcctgcat

SEQ ID NO: 18537 - DNA, 201 bp, Homo sapiens
cctcccttgacaggtggggattacaattcgagatgaaatttgggtggggacacagagctaaaccgtatcattctccaccggcccttcccaaatctcatgcyttttcagatttcaaaaccaatcatgccttcccaacagtcccccagaggcttaattcattccagcattaacccaaaagtccaagtccaaagtctcatctga

SEQ ID NO: 18538 - DNA, 201 bp, Homo sapiens
tccgtggtggctggaaagggagtgaaggtggggggcagctgctcagttctggggtcctggcttggcttgcctgtgcggacccctctcatctgtaggaagcrcactgctcttcttcctcctccaccttggctagcgcaggagtttgcaggtggctctgagctgagcccagaaggacaatgcaaaccaggaccatgtcagtgg

SEQ ID NO: 18539 - DNA, 201 bp, Homo sapiens
gtcaggagaaggtgacactgtctggggtggaaggtcaaggaatgcctactcggtgcctggctctgtgccggctcctgtgtgtgatgccatttagctctacrggaagcctgcagggaactgtcagtctctccttttttcagacgagtgtagaaaggtttaatgtcactaagaaaattgtctgaggtcacccacctaagtaag

SEQ ID NO: 18540 - DNA, 201 bp, Homo sapiens
aaacgggctggccctgagtggtggcctgtgagtcaggagaaggtgacactgtctggggtggaaggtcaaggaatgcctactcggtgcctggctctgtgccrgctcctgtgtgtgatgccatttagctctacgggaagcctgcagggaactgtcagtctctccttttttcagacgagtgtagaaaggtttaatgtcactaag

SEQ ID NO: 18541 - DNA, 201 bp, Homo sapiens
cctgagctacatgtgacctgctcactctctttgcctttgaaacacttctgtgctattggtgacagggcttgagagtacctctgcttatcagattgcaggcytcagggacagaagaaacgggctggccctgagtggtggcctgtgagtcaggagaaggtgacactgtctggggtggaaggtcaaggaatgcctactcggtgc

SEQ ID NO: 18542 - DNA, 201 bp, Homo sapiens
acaaagactagtgtagagactcctgtcgggaggctgcctgagctggggaagctgtcactcacttggcgtaggctttttccagcaaggcgctccagaactcrttgtggtcggcagagtggaggaaaaccaagcggtccctgaaggtgggcaggcggtcatcgatcaccacgtccagccactcactgtgctgccagaactgtt

SEQ ID NO: 18543 - DNA, 201 bp, Homo sapiens
tcctgccgagcctcacctgcaaacccagagccctgattttttcccagcccttagatgctcactacaaagactagtgtagagactcctgtcgggaggctgcytgagctggggaagctgtcactcacttggcgtaggctttttccagcaaggcgctccagaactcgttgtggtcggcagagtggaggaaaaccaagcggtccc

SEQ ID NO: 18544 - DNA, 201 bp, Homo sapiens
aaagttagagtgctgttgtaaaagtctttcttgagaatcaaccttgatgcaaggtgggcctgagggctgaaaggggaggaagaaggggcacctcagaatcrggacaggatcctgagtcagagcccgggaggatagtagacaggccactccttcacatgtctgcacaagccagctctggccccacacgccccgggaaccagc

SEQ ID NO: 18545 - DNA, 201 bp, Homo sapiens
ggaggaagaaggggcacctcagaatcgggacaggatcctgagtcagagcccgggaggatagtagacaggccactccttcacatgtctgcacaagccagctytggccccacacgccccgggaaccagccagagaggcaggatagggtgactgacctgtcgctccacgacccgttccactcaacctggccccaagggttccgg

SEQ ID NO: 18546 - DNA, 201 bp, Homo sapiens
ggggtttcaccatgttgaccaggctggtcttgaactcctgacctaggtgatccgcctgtctcggcctcccaaagtgctgggattacaggcgtgagccaccrcacccggcctatgattccttttatataaaatattcagaatatgtaaatagaatctatagagaaagtagatgagtggttgcctggggctgggggaaatggg

SEQ ID NO: 18547 - DNA, 201 bp, Homo sapiens
tgcatactcaagtcccacagtaagccctgtggaatctgcctataccaagtcagccctctgtatatgcgggtttcaaatcctggaatagtatattttctccyttccttccttccttccttccttccttccttccttccttccttccttccttccttccatcctccctccctcccttcctccctctctcccttccttctttcc

SEQ ID NO: 18548 - DNA, 201 bp, Homo sapiens
agcacgggctgggcgagcagacatttcatagctgccacccaagtggttcggcagtacttgggagggtggttagaaatctccctgcagccccaacccagacwcagcttaattacagataatggtatctccgtggtggctccatttgctttaaattatcttgcattttcaagatttattgactgacctactgaacttcccagc

SEQ ID NO: 18549 - DNA, 201 bp, Homo sapiens
ttgccaaaacatcacttatagttttaaatgtatgctccataaggattcaccgtgcaatgccgttaatgttcttctgaggcatttagctgttattccatgataaaatgtggctttagcatggtttaggaccatatgtcacacagatctgatgacatttttttctagggttaccaggcagtgtggaaatgcacctgccctcat

SEQ ID NO: 18550 - DNA, 201 bp, Homo sapiens
catgacaggtatgtgcactgtttgtggtttatttatacattgcatgtgtgaaagcatgtgtttgctcacatgtgtgcatgtgtgtgcatgtatgtgtgcaygcatgtgtttgcaagtgcttctacacacgtgtgtgtttgagcacatgtatgcatgtgtatgagcttgtgtgtggtctgctgggaacaggaagggaggttg

SEQ ID NO: 18551 - DNA, 201 bp, Homo sapiens
tggttaaaacttgtgttttatttatttatttttattttattttattttattttttatttatttatttatttatttatttatttatttatttatttattatwctttaagttttagggtacatgtgcacaacgtgcaggtttgttacatatgtatacctgtgccatgttggtgtgctgcacccattaactagtcatttagcac

SEQ ID NO: 18552 - DNA, 201 bp, Homo sapiens
cccgcccagggctgcgctcagccaccttcctgctgtgctttaagcagtcacatgagcccccattttctccatccgatcctgtggtcccctaatctccctgycttgcctgtttattgcagtgcctaatatactaccatcagacagcccctaggtttagatatcacccctccaggtgacccctttcataattcaggaacccca

SEQ ID NO: 18553 - DNA, 201 bp, Homo sapiens
ttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcatttagca

SEQ ID NO: 18554 - DNA, 201 bp, Homo sapiens
aagcatgatggcatgtgcctatagtcccggctactcaggaagctgaggtgataggatctcttgagcccatgagtttgaggctgcagtgagctaggcttatrccactgcactccagccagggtaaaagagtgagactctgtctaaagcaaaacagaactaaaaaacaaagcgtctgggcctattccaagcttctttgggctc

SEQ ID NO: 18555 - DNA, 201 bp, Homo sapiens
gcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcatttag

SEQ ID NO: 18556 - DNA, 201 bp, Homo sapiens
agtatctcagggcctcttgcgagtcctccagcccttggacgagggtaaagccacccccatgtcaccccttccacaccacataacataggggagatgtaatrtgttcccctgagtccacagtaaaaaacatctccctgcctctctggttttcttttcattgattagatttcttaaaatacaattaaaagtctacccacttca

SEQ ID NO: 18557 - DNA, 201 bp, Homo sapiens
catgcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcatt

SEQ ID NO: 18558 - DNA, 201 bp, Homo sapiens
tcccattgcagtgctttatccctaaataaatagcttttcttttagagagtgtctctgtgtttgttatttcagttgacagtagcacagaggaagatgacatsgaacagaactttataccaagcacccacctcactcccatgccaggtccttgtggactagaagagcacagactagaacacacacatcttggtctccaggagg

SEQ ID NO: 18559 - DNA, 201 bp, Homo sapiens
ccatgcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagtcat

SEQ ID NO: 18560 - DNA, 201 bp, Homo sapiens
actttggctgctgtcatgggttgttgagtacctgtggcttttccaggctcaaggtgcaagctgccagtggatccaccattcttgggtctggaggatgatgrccgccttcccacagttccactaggcagtaccccagtggggactctgtgcgagaccttgaacctcacatttccccatctgcatagccctagtagaagttct

SEQ ID NO: 18561 - DNA, 201 bp, Homo sapiens
gcgtctctgggggaagcagaggagcacagacctaaacaaagggagggagggagggagggagggaggaagccgggccggtctcgggagaggtaacagccaawcctgtggcagcgaggcacgttctggctcaccctgcaggggtggtgagttaactgggccggggcctgcagaggagtgaaggatttttcccacctcttccca

SEQ ID NO: 18562 - DNA, 201 bp, Homo sapiens; identical to SEQ ID NO: 2805

SEQ ID NO: 18563 - DNA, 201 bp, Homo sapiens
tgcacacggcaaggattcaggagtttcctctcattgcaatgggcagccttggggagttttcctctgggaggaaatctcatggatttatactgaagaaatarctggctatgtgctgtgtgataacagatggaagggggctggaggggaagcagagaatcgggttgggaggcctgtgggaccgctagaagccacccctgcact

SEQ ID NO: 18564 - DNA, 201 bp, Homo sapiens
acaggccactccttcacatgtctgcacaagccagctctggccccacacgccccgggaaccagccagagaggcaggatagggtgactgacctgtcgctccaygacccgttccactcaacctggccccaagggttccggattcggatgagctcgattctctggcctcggaagcttacctagaagggaaaagcatgagggaagt

SEQ ID NO: 18565 - DNA, 201 bp, Homo sapiens
agcacagctggaaggcagaggacaaggaggtgcatggtccaaggctgtagagagaagggcagcagccaggtcgtgtaagtgactgcacacggcaaggattyaggagtttcctctcattgcaatgggcagccttggggagttttcctctgggaggaaatctcatggatttatactgaagaaataactggctatgtgctgtgt

SEQ ID NO: 18566 - DNA, 201 bp, Homo sapiens
ctgcagttggagttcaagtcgcctacctggtcaattcccgttacactgtaggcatgacccttaataagaccaaacggcgtccgggcctcagattctgcagyacttctggtctaaaacatggaaagagcagagtcacacccaccgtctaagtcaagcctcccctgctggatcagacccagctacatgcctggcccggtcaca

SEQ ID NO: 18567 - DNA, 201 bp, Homo sapiens
cccagctgtgagctctgtgacctctgtgggcttcaaggagctgagtaatgcatgtaccacaggctggggccttggactaaacatactccctacccacccakcttctccatttctttctttatataatccttcccccacaaagtggattccaaatatatataggtttagagacagaatcttgctgtgtcacccaggctggag

SEQ ID NO: 18568 - DNA, 201 bp, Homo sapiens
ggggcagcttgaaccggtcggagacttctctcaggttgatgaacgtcttgcttctggcccgagaagcgtggtatctgaagaagtctttgttcaggtgttcrtctttgtcagggcactgcaatgggcaagaaagggaggggtttcctagggaagttcctcttggcttttcggacacaattcatggactcttggttgagtctc

SEQ ID NO: 18569 - DNA, 201 bp, Homo sapiens
cctacctggtcaattcccgttacactgtaggcatgacccttaataagaccaaacggcgtccgggcctcagattctgcagcacttctggtctaaaacatggraagagcagagtcacacccaccgtctaagtcaagcctcccctgctggatcagacccagctacatgcctggcccggtcacaacctccagccccttctgctgc

SEQ ID NO: 18570 - DNA, 201 bp, Homo sapiens
tcaattcccgttacactgtaggcatgacccttaataagaccaaacggcgtccgggcctcagattctgcagcacttctggtctaaaacatggaaagagcagmgtcacacccaccgtctaagtcaagcctcccctgctggatcagacccagctacatgcctggcccggtcacaacctccagccccttctgctgccccaggtgc

SEQ ID NO: 18571 - DNA, 201 bp, Homo sapiens
ccaccatgcttggttaaaacttgtgttttatttatttatttttattttattttattttattttttatttatttatttatttatttatttatttatttatttatttattatactttaagttttagggtacatgtgcacaacgtgcaggtttgttacatatgtatacctgtgccatgttggtgtgctgcacccattaactagt

SEQ ID NO: 18572 - DNA, 201 bp, Homo sapiens
ctgtatccgagccccgaggtgagtctgcacctttgagggagctcccaggcagctgaggagagggctcagaagaggaagccactgtttcactcctcaaagckggggtccccagacccagtgggactgctgcccttggtgtgaatgcagcgtgagagtgtgaatctgtggtgcaggggcgagtgtgcgggggactctcaggcg

SEQ ID NO: 18573 - DNA, 201 bp, Homo sapiens
ggcagcgtagattggtgcttcagctcgtggatgacagagtcagggggcctggttctgagtcctagttctgtctcttcccagctgtgtgacgttgaacaagycactggacctctctgttcctctgcaaaacagcatgaaccaattcattaactacttctccaggatgcagtaggtcccagggactatcctaggaatgtgggc

SEQ ID NO: 18574 - DNA, 201 bp, Homo sapiens
gttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaaagaaaggaaatt

SEQ ID NO: 18575 - DNA, 201 bp, Homo sapiens
tgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaaagaaaggaaat

SEQ ID NO: 18576 - DNA, 201 bp, Homo sapiens
gttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaa

SEQ ID NO: 18577 - DNA, 201 bp, Homo sapiens; identical to SEQ ID NO: 2790

SEQ ID NO: 18578 - DNA, 201 bp, Homo sapiens
agttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattggga

SEQ ID NO: 18579 - DNA, 201 bp, Homo sapiens; identical to SEQ ID NO: 2791

SEQ ID NO: 18580 - DNA, 201 bp, Homo sapiens
taagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgg

SEQ ID NO: 18581 - DNA, 201 bp, Homo sapiens; identical to SEQ ID NO: 2792

SEQ ID NO: 18582 - DNA, 201 bp, Homo sapiens
tataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaatt

SEQ ID NO: 18583 - DNA, 201 bp, Homo sapiens
atcctaagtggctcacacccagataattggcctgacaggctggccatgcggtgccttcaaccctactcacatgtcaccagcagcacagcgaagtcagggartcgggatggcgcctgcccctcccatcacccatggaggctgcatgagtggaagacaaattttattccagccttggctctcagtcactttcttgatttctac

SEQ ID NO: 18584 - DNA, 201 bp, Homo sapiens
gaaatgatagtgttggagtgctaaggggaatgattcagaagaaggggggaattcatacgtaaggggagagaagagagttgcaggaggtacatcctagagcyggtgaagaatggaaagaggctacacagggcttcagagtcaggattccaggaggaagggctccacgcacagagtgcatgatttaacaccacccatcacctt

SEQ ID NO: 18585 - DNA, 201 bp, Homo sapiens
acagggaatattgagacaatgaaagatctggttagatggcacttaaaggtcagttaataaccacctttcaccctttgcaaaatgatatttcagggtatgcrgaagcgagcaccccagtctgagatggctcctgccggtgtgagcctgagggccaccatcctctgcctcctggcctgggctggcctggctgcaggtgaccgg

SEQ ID NO: 18586 - DNA, 201 bp, Homo sapiens
atataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaat

SEQ ID NO: 18587 - DNA, 201 bp, Homo sapiens
gtggctcacacccagataattggcctgacaggctggccatgcggtgccttcaaccctactcacatgtcaccagcagcacagcgaagtcagggagtcgggayggcgcctgcccctcccatcacccatggaggctgcatgagtggaagacaaattttattccagccttggctctcagtcactttcttgatttctacctctgtg

SEQ ID NO: 18588 - DNA, 201 bp, Homo sapiens
gaggctacacagggcttcagagtcaggattccaggaggaagggctccacgcacagagtgcatgatttaacaccacccatcaccttgggcaggctcagcccwggtgttggggctgctccttcaagaggggcagggcaatggatcactcacatggacgctcttctttgtggagcttcctgctgtgaatttccgagtttcctct

SEQ ID NO: 18589 - DNA, 201 bp, Homo sapiens; identical to SEQ ID NO: 2794

SEQ ID NO: 18590 - DNA, 201 bp, Homo sapiens
catataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaa

SEQ ID NO: 18591 - DNA, 201 bp, Homo sapiens
caacccatctcagctcatctctgccaatgcttcttggttctcagaaggcggcagccaaggccagagcagaggatggtgggacgagagcctccatggggacmatgacagcctggaaagcacaggcctgtgtgccctgccctcacgctggggtctggctaatacagcagcggctgcaccatgtctggtgacctggtagctgtg

SEQ ID NO: 18592 - DNA, 201 bp, Homo sapiens; identical to SEQ ID NO: 2795

SEQ ID NO: 18593 - DNA, 201 bp, Homo sapiens
gtgtcagcacgggctgggcgagcagacatttcatagctgccacccaagtggttcggcagtacttgggagggtggttagaaatctccctgcagccccaaccyagactcagcttaattacagataatggtatctccgtggtggctccatttgctttaaattatcttgcattttcaagatttattgactgacctactgaacttc

SEQ ID NO: 18594 - DNA, 201 bp, Homo sapiens
caagggtgcttctgggtgacatgaaatttaagttgattgagtaaaacagattgccctccccagtgtaggtgggcctcatctcatctgtgaagacctgaccwgaacaaaaaggcagaggaagggggaattcactctctcttcctgggtgcctgagctgggacatccgtctctcctgccctcagactgggacttttaccattg

SEQ ID NO: 18595 - DNA, 201 bp, Homo sapiens
caagttctagactagcttcagatttccccagaagctcaggggccatggatgtggcaggaaagggcttcaggagcccaacaagcagcggacgagcaacagcytcaggcaggccctgccacgcacccacacaaacatccctggttcttagtcacctggtccacttcccaagggaccagagctggaggagctgtggggacacac

SEQ ID NO: 18596 - DNA, 201 bp, Homo sapiens
gtgccggtcaagaaggaacagctcagagggccactgggctgagtggccctcacctccacctattttctgggcacctccctgttagactgagatgggacacrccctgatggaaaacagcagagagagccctctgcccactctgcactcctgcagactcagaggcagctctggggcctggcacattccactcagaggcggcac

SEQ ID NO: 18597 - DNA, 201 bp, Homo sapiens
gcagaaataagcaattggcttgcttaaatccctttcatgttaggaggggcattactgaaaaccctctactacaaagattgttgatttttttttttttttttattgagacagggtcttgttctgtcacccaggctgcagtgtagtggtgccatcattgctcactgtagccttgaactcctggcctcaagcgatcctcccacc

SEQ ID NO: 18598 - DNA, 201 bp, Homo sapiens
ctgactaatacatcatgctctgctgactccatatgtggctggtttcctggatccgattctgactgatggtatctgttctcacactgctaataaagacataycagagactgggtaatttataaagaaaaagaggtttaatggacttatgtgttccacgtggctggggaggcctcacaatcatggtggaaggtgaaggaggag

SEQ ID NO: 18599 - DNA, 201 bp, Homo sapiens
catggtagtttctctgtgtatcctgcagtgacccacctcctacccgttccttctggttcagttggcctgagagcgatcctaaggtaacctctaagagtaaraagaaaagggttgaaagaggagggtaggcacagtggttttgggagccatttatttacagctttgctgtgtcatcctgagcatcttgctgcatcagtgatt

SEQ ID NO: 18600 - DNA, 201 bp, Homo sapiens
ccatttgcaatttgtacagcataaacacagaacagcacatctttcaatgcctgcatcctgaaggcattttgtttgtgtctttcaatctggctgtgctattsttggtgtttaacagtctccccagctacactggaaacttccagaaggcacttttcacttgcttgtgtgttttccccagtgtctattagaggcctttgcaca

SEQ ID NO: 18601 - DNA, 201 bp, Homo sapiens
ttgtgtctttcaatctggctgtgctattgttggtgtttaacagtctccccagctacactggaaacttccagaaggcacttttcacttgcttgtgtgttttycccagtgtctattagaggcctttgcacagggtaggctctttggagcagctgaaggtcacacatcccatgagcgggcagcagggtcagaagtggcccccgt

SEQ ID NO: 18602 - DNA, 201 bp, Homo sapiens
gacctgggtgggacagagggcaagcgtgggcatctttggttcttatttgatggctttaattctgtcctgctgatttcaggattaatttaaccacagtatgmctcccctctattttgccacttttatgtcccacttggaggtagaagcaagaccatccttgcttctgtctctggggatagtattctcatggcttgaagatcc

SEQ ID NO: 18603 - DNA, 201 bp, Homo sapiens
tggtacaggaacagagtcatcatggccaagagtccaccgggtcctcttgccatcaggaggaatagcagggcttgtgcaggaattggggctggagggaaggrccgggctcggtcagtctccagctgggatccccagagtggtcaccctacccctccctcgagacagactgcctgactgtgtgtcatcaggctggtcaccatc

SEQ ID NO: 18604 - DNA, 201 bp, Homo sapiens
tttacttctgagtcaagatttttagaaagtgagagtgtctttttcaatgttttattttattcttctcttctgctggctatgtgcagatgatgacgtgaccytagaagatggcagagccacacaatagaaggcgtttgggttcctgaatcactgtatgaacagagccacccacagaatatgaacatcctccctggactgtca

SEQ ID NO: 18605 - DNA, 201 bp, Homo sapiens
gcctgcctggcctctgggagagccctcactgtgtggcctggagccttcctaactgtgcatcatctccccaggaccatccacctgaccatgccccaactggygctgcaaggatcttatgacctgcaggacctgctcgcccaggctgagctgcccgccattctgcacaccgagctgaacctgcaaaaattgagcaatgaccgc

SEQ ID NO: 18606 - DNA, 201 bp, Homo sapiens
tggtcagtgaccatcagagagaatcctatagttacatgctaggtaatatttcagggattccgacactccaaatacacacacacacacaaacacacacgcayttatgcatatgcacactgcttactggagttactcacaactacagataaagcttttcaccatatcactgggttataaacatcaccatgggaggtaacacat

SEQ ID NO: 18607 - DNA, 201 bp, Homo sapiens
aagaaattagtccatatgaatctaaaaatgggtttctctctagacttggatctccctagaggcaggagccaagtcttaggcatcttcagcatctagcagartgaatggtaaagagtagtcctcaaaggtgctcatggaactattactgaactttcttcatcctagcatcccatgcacagatgaatgataagaaaataagca

SEQ ID NO: 18608 - DNA, 201 bp, Homo sapiens
ctagcctggccaacacggtgaaaccccatctctactaaagatacaaaatgagtcgggcgtggtggcgcatgcctgtactctcagctgcttgggaggctgargcaggagtatcacttgaacctgggaggcagaggttgcagtgagacgagatcgcaccactgcactccagcctgggcaataagaacaaaactccgtctcaaa

SEQ ID NO: 18609 - DNA, 201 bp, Homo sapiens
ctgaactttcttcatcctagcatcccatgcacagatgaatgataagaaaataagcacatgttggggatttaaacacaacaataaacaaaaacagcttttaygtcttctagacccaatattctccttatttcaggtgtctgtgaggattcctgctgttcacctcaatcacccttgagcctgtgtgccctcaggctctgcctg

SEQ ID NO: 18610 - DNA, 201 bp, Homo sapiens
gccaggctggtctcaaactcctgacttcaggtgatcctcctgcctcggcctcccaaagtgctgggattacaggcatgagccaccgtgcctggcctaaagaycaccttttgaagctgcatccctaactcctgcctctcatcacagatgtaaattcctgattccactggtggggttggggagggatgggtgtctctgtgctta

SEQ ID NO: 18611 - DNA, 201 bp, Homo sapiens
caaggaaaacttggaacttcaaggatccatcatgggatgcaggacagtaggctccacccctcttcctgctttccagtaaatgatgttcagggctcacatgyctcttccaaggcatgatgtggggttgcagttctgatcccagcagagaacaaggctcctgtgaaacaattagttttggctcagaggcaaaaaatggaaacc

SEQ ID NO: 18612 - DNA, 201 bp, Homo sapiens
tgtgtgccctcaggctctgcctgggagcagggacaagggccaatgcatttgagaagggttttagaggagagagagtgaaagtaaaagacttctagttatcractaaccagaaactgtagcagtcagaatgttttatcctcatgcatttggcataaattatattttggatgtgtaaaaattcaagtaacatcaactcttcgg

SEQ ID NO: 18613 - DNA, 201 bp, Homo sapiens
catatctgttggagaccattcagcctattgagtggtaggcactggggagggggtgcattttaaaagattacaaagttgaatcagaaccaaaaaaaccaccwttttttttagacggagtctcactctgtggcacaggctggagtgcaatggcatgatctcggctcactgcaacctctgcctcctgggttttaagtgattctc

SEQ ID NO: 18614 - DNA, 201 bp, Homo sapiens
aaaaaagaaagaacaggctgagaatggtggcttatgcctgtaatcccaacactttgggaagttgaggtaggaggatcacttgagaccagtagttcaagatmagcctgggcaacatagcaagaccctatctctacaaaaaataaaaataaaaaaattagccagatatggtagcatgcacctgtagtcctagttactctggag

SEQ ID NO: 18615 - DNA, 201 bp, Homo sapiens
cgactaaccagaaactgtagcagtcagaatgttttatcctcatgcatttggcataaattatattttggatgtgtaaaaattcaagtaacatcaactcttcrgagtccaagatgtggcttgtggctcaccattaaaggggctcatttaatttgaaaggttcagggcaggtgagttccttgtaggggggagaggaagcaaaat

SEQ ID NO: 18616 - DNA, 201 bp, Homo sapiens
tcacttccacattttcagttatctttataacaatgccccactcttctgtaccaattttctgtattaggctgttcttgtactgctataaagaaatacctaasactaatttacaaagaaaagaggttcaattggctttacaaagaagcatggtgtattccctagaagttaacttaactccttgacttctagggagacctagga

SEQ ID NO: 18617 - DNA, 201 bp, Homo sapiens
atatacgatgaacaagtctagagatccagcgtacaacatgaggactatacttaaaaatgtcacattgcacttgggatttttgctaaaagagtagactttaygtgtccttgccacctaaatgagtaactgtgagatgatggatatgttaattttcttgactaccataatcattttactatcttcatatcaaaatatcatgct

SEQ ID NO: 18618 - DNA, 201 bp, Homo sapiens
taggggggagaggaagcaaaatcaagcaaaccaagatgatgagaggtttctgttgttacgtggaatacgtagaagatctaacctagaaacatcacatgccygcttgagtgagcaatctgcaagtcatctatggatggtgaaggaggacaaaggagccaacacaaatagctaacattctaaagaatcccaaagagtccaacg

SEQ ID NO: 18619 - DNA, 201 bp, Homo sapiens
ctcgaaaaagctttttctttctctgctatatagccaggctgcaaattttccaaatttttatgccctgcttcccttttaaatgtatatattccagctttaastcatatctttgctcccatatctgagtataggttgttagaagcagccaggtcacatcctgaatgctttgctgcttagacatttcttcttccagatacccta

SEQ ID NO: 18620 - DNA, 201 bp, Homo sapiens
aacatggatgactggaagacattatgctaaatgaaacaaggcagatacagaaaggaaaatactgcatgacctcatttatatgtggaatcttttttttttttaaagtgaatatacagagatagagaatacaacagtggttaccaggagttgaggaggagagcagggaggagatgtaggtcaaatgatacaaagcagcagata

SEQ ID NO: 18621 - DNA, 201 bp, Homo sapiens
ggggttggggtgccaaccctcctgcattgtcaaaaaatcttgtattccctaaagctgaactccgaatagcctaccattgaccagaagtcttatcgataacrtaaagaaccaattaacatgttttataattatttatattatatactgtattcttacaataaataagccagagaaaagaaatgttatcaagaaaatcatagg

SEQ ID NO: 18622 - DNA, 201 bp, Homo sapiens
agtaccccagtggggactctgtgcgagaccttgaacctcacatttccccatctgcatagccctagtagaagttctctgtgagggctctgtccctgcagcargcttttgcctaggcatgcaggcttttccatacatcctctgaaatctaggtggaggctgccaagcctcattcagtcttgcactctgtgtgcctgcaggctt

SEQ ID NO: 18623 - DNA, 201 bp, Homo sapiens
tgtcctacatccagggaacactggtacaaagggtgggatcccaaggccttgggaagctctgtccctgtgactttggctgctgtcatgggttgttgagtacctgtggcttttccaggctcaaggtgcaagctgccagtggatccaccattcttgggtctggaggatgatggccgccttcccacagttccactaggcagtacc

SEQ ID NO: 18624 - DNA, 201 bp, Homo sapiens
caacatggatgactggaagacattatgctaaatgaaacaaggcagatacagaaaggaaaatactgcatgacctcatttatatgtggaatcttttttttttttaaagtgaatatacagagatagagaatacaacagtggttaccaggagttgaggaggagagcagggaggagatgtaggtcaaatgatacaaagcagcagat

SEQ ID NO: 18625 - DNA, 201 bp, Homo sapiens
gtccttctcacactgcaaaatataattatgccttcccaataacccccaaagtcttaagtcattccagcattaactcaaaattccaaagtccaaagtctcayctgagataaggcaagtcccatcacctatgagcctgtcaaatcaaaatcaagttccaagatatacaaattccattttatacttccaaaatacaatgggagt

SEQ ID NO: 18626 - DNA, 201 bp, Homo sapiens
aaaagccctcaacagatttctgtttgtctcattggtcagaactatcttacttgaccactaatggttacagaggagagcagtgatgcaggatttttctcggyccctttgccagtcagggacctcttgctggtgatgctggaggccttgcttggggcacactacctgtccctggaggtgcctcacccaatcggcccccctggg

SEQ ID NO: 18627 - DNA, 201 bp, Homo sapiens
ctcccaaagtgctgggattacaggcgtgagccaccgcacccggcctatgattccttttatataaaatattcagaatatgtaaatagaatctatagagaaartagatgagtggttgcctggggctgggggaaatgggtacagggttaacactgttaatgggtaaagggtttcttgttggagtgatgaaacattctaacatta

SEQ ID NO: 18628 - DNA, 201 bp, Homo sapiens
attctttgcttgctggcttttggtccttacacttgttgcctcatggttgcaaaatggctgttttgtctccagacattacatcaacatttgaaggaggaagmagggttagtgtctgagccactgactctgctgataaaaggacagagaaagctctcccaaaagccctcaacagatttctgtttgtctcattggtcagaacta

SEQ ID NO: 18629 - DNA, 201 bp, Homo sapiens
ccgaaaagtgaaaggtataccagcttgctcatttcatggtggcattgtttacattaaaaaaggttggaaagcacttagtgccctctgttgggggaatggtraagaaaattatggtccagctaatcatgaagtggaacagtgtacagccataaaacggaacaaggaaactctgcatacactgatgtgggaaggtccctggga

SEQ ID NO: 18630 - DNA, 201 bp, Homo sapiens
ttctatcattctttgcttgctggcttttggtccttacacttgttgcctcatggttgcaaaatggctgttttgtctccagacattacatcaacatttgaagraggaagaagggttagtgtctgagccactgactctgctgataaaaggacagagaaagctctcccaaaagccctcaacagatttctgtttgtctcattggtc

SEQ ID NO: 18631 - DNA, 201 bp, Homo sapiens
catttcctagaagatgagaactagatcttcacccagaccttgcttccctatccatcccctcccaaggtcattggtaagcctgacatcaggtgagggtctcmctttcttcatccagggacttgtccatccctggaacactcctagtttcacccctgtcctagtgggcactcattcatgaaccataacaaatcttttcttcag

SEQ ID NO: 18632 - DNA, 201 bp, Homo sapiens
atgctttgcttcctttttaaacataagttcctatttcagatcatttctctcaagttcaaagttccccagatcctaaaggcaggggtaaaatgctgccagtytctttgctaaagcatagcaagagtgacatttgctccagttcccaataagttccttatttccatctgagaccacttcagactgaacttcattgtcaacatc

SEQ ID NO: 18633 - DNA, 201 bp, Homo sapiens
aaatcttctaaaattgactgtggtggtggttgcacaactctaaatatgctaaaaatcattgaattgtacactttaaataggtgaattgtatgtacagtatmtgaattacatctcaaagctatcttaaaaagataaataagctctgtgcctcattttgcctcctacagtgtttcgtaaagttgtagtactaaaagggagatt

SEQ ID NO: 18634 - DNA, 201 bp, Homo sapiens
cattacttatgcaaatttgtgcagctggcttgaatttctcccaagaaaatggttcttttattttctaccccatcatcaggatgcaaatattcaaaactttyatgctttgcttcctttttaaacataagttcctatttcagatcatttctctcaagttcaaagttccccagatcctaaaggcaggggtaaaatgctgccagt

SEQ ID NO: 18635 - DNA, 201 bp, Homo sapiens
gaatgcatgtgcgcacacatgtgtatacatgtgcatacaggcaggcatgacaggtatgtgcactgtttgtggtttatttatacattgcatgtgtgaaagcrtgtgtttgctcacatgtgtgcatgtgtgtgcatgtatgtgtgcatgcatgtgtttgcaagtgcttctacacacgtgtgtgtttgagcacatgtatgcatg

SEQ ID NO: 18636 - DNA, 201 bp, Homo sapiens
ttgagccctgagagggttgggtcctgccgagcctcacctgcaaacccagagccctgattttttcccagcccttagatgctcactacaaagactagtgtagagactcctgtcgggaggctgcctgagctggggaagctgtcactcacttggcgtaggctttttccagcaaggcgctccagaactcgttgtggtcggcagagt

SEQ ID NO: 18637 - DNA, 201 bp, Homo sapiens
aagtgctgtcggcacagccagaattcccctccgcttgccttcccagctcttccaaaggccagattcatggcccagggagaaaaagggtcatgaatgtagcsactgctcccaaagatgggcacatctaggctacgacaggaaaaccacctccaaccccgcttgagccctgagagggttgggtcctgccgagcctcacctgca

SEQ ID NO: 18638 - DNA, 201 bp, Homo sapiens
tacctggaaatggaatatcccggcataaccagggccaaagctttggtcctgggggatgactctggccagtgctttttgattaagcgtaagggaggcgatgrcggctaatagccagcagtctcctgcaaaatggaagccataaatcacaattttcattgctatttcacagcaaataggaaaactctgtgtcagaaggggatg

SEQ ID NO: 18639 - DNA, 201 bp, Homo sapiens
ctgcttgagtgagcaatctgcaagtcatctatggatggtgaaggaggacaaaggagccaacacaaatagctaacattctaaagaatcccaaagagtccaayggcgtctcacaccttggctccagtgaggaggaagggcagggtctcccttcagtgttctttactccccacgcattcagaggatgtcactcaaaaggtgggt

SEQ ID NO: 18640 - DNA, 201 bp, Homo sapiens
acattttatcatatacgattatttatcgatatgtcatatacgactttttaaaaataaaaaagaagcatcccgtaggacggacaattgatgtctctatatcmacgtgcgtaatagcccagatgtttgagccatgccagtgtccgagggaagtgtgaagcactaagtgctgtcggcacagccagaattcccctccgcttgcct

SEQ ID NO: 18641 - DNA, 201 bp, Homo sapiens
tctgcccgtctatcataaacagctgttgccttcttggcactgttataggacatgcttacttgggtttcagacatatggctgcctgatgcatcagctctgtraattccagcaactccctttccagaggaccaagactgcatacatcagtgtcagcacgggctgggcgagcagacatttcatagctgccacccaagtggttcg

SEQ ID NO: 18642 - DNA, 201 bp, Homo sapiens
acagcgaagtcagggagtcgggatggcgcctgcccctcccatcacccatggaggctgcatgagtggaagacaaattttattccagccttggctctcagtcmctttcttgatttctacctctgtgagtcccagaaaatgggagacaatggcccattttccctttataggctacgatctcaaagttgaggggcactgcacatc

SEQ ID NO: 18643 - DNA, 201 bp, Homo sapiens
ttacttgggtttcagacatatggctgcctgatgcatcagctctgtgaattccagcaactccctttccagaggaccaagactgcatacatcagtgtcagcaygggctgggcgagcagacatttcatagctgccacccaagtggttcggcagtacttgggagggtggttagaaatctccctgcagccccaacccagactcagc

SEQ ID NO: 18644 - DNA, 201 bp, Homo sapiens
ggatgtacttaatgctactcaactgcacacttaaaaatggtaaaatttatgtcatatacattttatcatatacgattatttatcgatatgtcatatacgaytttttaaaaataaaaaagaagcatcccgtaggacggacaattgatgtctctatatcaacgtgcgtaatagcccagatgtttgagccatgccagtgtccga

SEQ ID NO: 18645 - DNA, 201 bp, Homo sapiens
tgccgcctgtgtaagcagatatctgggaggatccatttatccgaatcacctttatccagattcacttgttttcagtagacaacatcaacgtcatcagaacmtaaaagcccatcacactcagcttggcagtttctgagttcacatttctggaaagcaccgtatgtcactgggcttgggacattgtaatatggccctttctgg

SEQ ID NO: 18646 - DNA, 201 bp, Homo sapiens
agctgaaggtcacacatcccatgagcgggcagcagggtcagaagtggcccccgtgttgcctaagcaagactctcccctgccctctgccctctgcacctccrgcctgcatgtccctgtggcctcttgggggtacatctcccggggctgggtcagaaggcctgggtggttggcctcaggctgtcacacacctagggagatgct

SEQ ID NO: 18647 - DNA, 201 bp, Homo sapiens
gcctgtgtaagcagatatctgggaggatccatttatccgaatcacctttatccagattcacttgttttcagtagacaacatcaacgtcatcagaacctaaragcccatcacactcagcttggcagtttctgagttcacatttctggaaagcaccgtatgtcactgggcttgggacattgtaatatggccctttctggctgt

SEQ ID NO: 18648 - DNA, 201 bp, Homo sapiens
gggggtacatctcccggggctgggtcagaaggcctgggtggttggcctcaggctgtcacacacctagggagatgctcccgtttctgggaaccttggccccractcctgcaaacttcggtaaatgtgtaactcgaccctgcaccggctcactctgttcagcagtgaaactctgcatcgatcactaagacttcctggaagagg

SEQ ID NO: 18649 - DNA, 201 bp, Homo sapiens
tcagaacctaaaagcccatcacactcagcttggcagtttctgagttcacatttctggaaagcaccgtatgtcactgggcttgggacattgtaatatggccytttctggctgtttgacacaggcaagagagactcgccagggctgaacatcgggaaagctaattccgaatcgccctggttctggctttctgagaggtgtcac

SEQ ID NO: 18650 - DNA, 201 bp, Homo sapiens
ggcctcaggctgtcacacacctagggagatgctcccgtttctgggaaccttggccccgactcctgcaaacttcggtaaatgtgtaactcgaccctgcaccrgctcactctgttcagcagtgaaactctgcatcgatcactaagacttcctggaagaggtcccagcgtgagtgtcgcttctggcatctgtccttctggccag

SEQ ID NO: 18651 - DNA, 201 bp, Homo sapiens
agttcacatttctggaaagcaccgtatgtcactgggcttgggacattgtaatatggccctttctggctgtttgacacaggcaagagagactcgccagggcygaacatcgggaaagctaattccgaatcgccctggttctggctttctgagaggtgtcaccagcagagtacaagccacccccagccttagctggagcacaga

SEQ ID NO: 18652 - DNA, 201 bp, Homo sapiens
tttttttttttgatagagatgtggtcttgctatgttgcccaggctagtctaaaactcctgggctcaagagatcttcccacctccccctcccaaagcgctgygattacaggtgtgagcactctacatgaccagatgttctagttcttattgtgggtggcaacagatcacggctgttcattttcttgttattctttataacat

SEQ ID NO: 18653 - DNA, 201 bp, Homo sapiens
ctttctctgtctcctccacactcaggcctgtggcgaactccctttgtttctcttcttcttgttcatcttgaagggcagcaggaggtgaacatagtgcctgsgtggctctgggatgccatggggcaaaaccccaaggacaaatgctcagaagcttcacatgggtgcagggagatgacctctaggaccccacccggtccaggc

SEQ ID NO: 18654 - DNA, 201 bp, Homo sapiens
agcctgtggtctggccaagtgatgtaaccctcctctccagcctgtgcacaggcagcctgggaacagctccatccccacccctcagctataaatagggcatygtgacccggccaggggaagaagctgccgttgttctgggtactacagcagaaggtaagccgggggccccctcagctccttctcggccttgtctctctcaga

SEQ ID NO: 18655 - DNA, 201 bp, Homo sapiens
aagtgatttctacatgaaatgaacctgacctggcatctggggccttcctggcctctcttttctgtgctgttctttctctgtctcctccacactcaggcctstggcgaactccctttgtttctcttcttcttgttcatcttgaagggcagcaggaggtgaacatagtgcctgggtggctctgggatgccatggggcaaaacc

SEQ ID NO: 18656 - DNA, 201 bp, Homo sapiens; identical to SEQ ID NO: 2784

SEQ ID NO: 18657 - DNA, 201 bp, Homo sapiens
ccctcctctccagcctgtgcacaggcagcctgggaacagctccatccccacccctcagctataaatagggcatcgtgacccggccaggggaagaagctgcygttgttctgggtactacagcagaaggtaagccgggggccccctcagctccttctcggccttgtctctctcagatgtaactgagctgtgggctaggaggaa

SEQ ID NO: 18658 - DNA, 201 bp, Homo sapiens
aatgcacctgccctcatgccgggccccagagaggtaaacccactggcccagggctccctcttacctggaaatggaatatcccggcataaccagggccaaakctttggtcctgggggatgactctggccagtgctttttgattaagcgtaagggaggcgatggcggctaatagccagcagtctcctgcaaaatggaagccat

SEQ ID NO: 18659 - DNA, 201 bp, Homo sapiens
actaatacatcatgctctgctgactccatatgtggctggtttcctggatccgattctgactgatggtatctgttctcacactgctaataaagacataccagagactgggtaatttataaagaaaaagaggtttaatggacttatgtgttccacgtggctggggaggcctcacaatcatggtggaaggtgaaggaggagcaa

SEQ ID NO: 18660 - DNA, 201 bp, Homo sapiens
ccatattggccaggctggtctcaaaactcctgacctgaggtgatccgctcaccttggcctcccaaagtgctgggattacaggtgtgagccacaccgcaccyggccaataatacattttagttcaagattagtgagagctaaggagaaatgagaatgctgattgttctgaaattcagtctccacatgaaaaccagctgaggg

SEQ ID NO: 18661 - DNA, 201 bp, Homo sapiens
ctataaatagggcatcgtgacccggccaggggaagaagctgccgttgttctgggtactacagcagaaggtaagccgggggccccctcagctccttctcggycttgtctctctcagatgtaactgagctgtgggctaggaggaaaaggccgggaggaggcacggtgatgactgaaaaacctctcccctctcataagaccagt

SEQ ID NO: 18662 - DNA, 201 bp, Homo sapiens
gcctgggtgcacaggtttggggccctggggaagtggttttaatgattaaaccacaaatctctgaagaggggaaacggcagaagtggaatgggggtggtccyggaaagttcacaaaaacagaactctgttcccttggatgggatcccaaagtggcaagaagacccccaagtcccttcaaaagctccccacccccaccactag

SEQ ID NO: 18663 - DNA, 201 bp, Homo sapiens
ctgtgctgttgtagcacaaaagcatcctggactattcataaactaatgagcatggctgtgttgcaataaaacttgtttacacaaacagatggtggtccagyccagatttggcccatgggctgtagtttgccaatccttggaacagataaatgttcatgctattatttgtttagtaagagtattctttagttgccaggttga

SEQ ID NO: 18664 - DNA, 201 bp, Homo sapiens
aatacagtagatgtttctaaagctaatttttaaatgaaaggacaatatataagtctatagctaactcctctgtcatgcacaatctgagttaacagaatagwttaggggttagcaagctttttctataaagggccatgtaataaatatttcaggctttgcagttcatatgttctctgttgcaacaactcaactgtgctgttg

SEQ ID NO: 18665 - DNA, 201 bp, Homo sapiens
ggtggagttggctttggaggctaaaaaacagccaaagaaacttgcacaaaatgatccacaaaaaagaaacatgacaaaaatagcaggaaagaagccaggascctgtgtgcccagccccatgtcaccctcctgaggcggtgtgcacaagctgcgtcctgtagcgtgaggaacattttctcatgaaggctcttttagaaggtg

SEQ ID NO: 18666 - DNA, 201 bp, Homo sapiens
acaggaatggaataataaaattatacattaaataagtgttgtaaatacagtagatgtttctaaagctaatttttaaatgaaaggacaatatataagtctakagctaactcctctgtcatgcacaatctgagttaacagaatagattaggggttagcaagctttttctataaagggccatgtaataaatatttcaggctttg

SEQ ID NO: 18667 - DNA, 201 bp, Homo sapiens
cgtgccaccaaacctagataattctttgtattttttgtatagatggggttttgccatgttgctgaagctggtctcaaactcctgggctcaagtgtttcacscacctcagcctcccaaagtgctggtattacaggtgtgagccactgtgcctagccagcaatattctttttaatcagttttcgattggtgaaaaagtgacta

SEQ ID NO: 18668 - DNA, 201 bp, Homo sapiens
atatagggtaggtatcaataattactcataaaagatgagaattattggttccctagaagtcattttcccattctaggcatggtgccttttaggggacatarctctgactgaactttatatgtcctccttagttagttacttagggtcttgatttcttctggaggctgtatttgtcatttaaattttgctagatattatgca

SEQ ID NO: 18669 - DNA, 201 bp, Homo sapiens
ttatatagggtaggtatcaataattactcataaaagatgagaattattggttccctagaagtcattttcccattctaggcatggtgccttttaggggacakaactctgactgaactttatatgtcctccttagttagttacttagggtcttgatttcttctggaggctgtatttgtcatttaaattttgctagatattatg

SEQ ID NO: 18670 - DNA, 201 bp, Homo sapiens
attctgctgagatgtagacatagttaagcaatcaccagccgttattctggaggtcatgaaatttgcaactttctcaattactcctataattaacatcactmctctagaccctaaaattggccttttcagattccttttcagacttttgtatttctgaaaccaggtgactttacctggacccacgacccctacctgtggtcc

SEQ ID NO: 18671 - DNA, 201 bp, Homo sapiens
ttagctaatgggctttatctagagaaaaacaagcttcttacatctttgtgacaggaggcagttttgcagcttggaggcatgtgcccactgaaggcaggctstcaccctcccacagacactgggagctggggccactgtctctcccttgatgtttgcctttcaaggagatggctcccgggtccttgagaaacacatgcctgg

SEQ ID NO: 18672 - DNA, 201 bp, Homo sapiens
tcttgtctagtgagaggtgagggggttaaaatatagggtatcctggctgggtaccctgcctcacgcctgaaatcccagcagtttgggaggccgaggtggayggatcacttgagatcaggagtttgaggctagcctggccaacatggcaaaaacccatctctactaaaaatataaaaaacaaaacaaaacaaaaaaatagcc

SEQ ID NO: 18673 - DNA, 201 bp, Homo sapiens
gcggactttattcaatggccaaagaatggagaagcaggagcatggccgcaagtcaacttcttgtctagtgagaggtgagggggttaaaatatagggtatcytggctgggtaccctgcctcacgcctgaaatcccagcagtttgggaggccgaggtggacggatcacttgagatcaggagtttgaggctagcctggccaaca

SEQ ID NO: 18674 - DNA, 201 bp, Homo sapiens
gggtgagagagcaagaccctgtctccaaaaaaaagtaaataataataaaaaaaagagtggggctattggttagtggaaggaagaccggagaggtaaagctsccctctcatctcatgatatcaagagtacctgccgtccacatgccttaccacagctgatgctggccttgatcacctggctaaggtagtgttagtcaggtgt

SEQ ID NO: 18675 - DNA, 201 bp, Homo sapiens
ggcacattccactcagaggcggcacctctgcttagtgcgctcagggggcctcatgggagagagaggattgcttcagaaggaaaaggagcaagaaacccaastggtccaggaggtggctttacggagaagtgcacggtgtggtcttgagtcccatctcctgcatcagagaatggcagagttttgtagtcggaagggaggttg

SEQ ID NO: 18676 - DNA, 201 bp, Homo sapiens
caaaactttgaaaaacaaaggagccagtagaatgatttcctattggatagcaatggaggactacggggtcgaggggaagggaggcagaggaagagggggasaggtgggcagcggcagggaggatctcctggagaaggaccacctgaatgtaaaccttttgaaaagtctacattgtatctagaatatggcatacatggggga

SEQ ID NO: 18677 - DNA, 201 bp, Homo sapiens
acctggtcaattcccgttacactgtaggcatgacccttaataagaccaaacggcgtccgggcctcagattctgcagcacttctggtctaaaacatggaaaragcagagtcacacccaccgtctaagtcaagcctcccctgctggatcagacccagctacatgcctggcccggtcacaacctccagccccttctgctgcccc

SEQ ID NO: 18678 - DNA, 201 bp, Homo sapiens
cagctagaaataagtcagggtccacacaagcttgcagtggtttgttctctaggctgatttcactggtattttttaaaagaaagtctctcgctctctcactytctctgtctttcatagatagaacaaaggtaaacccagcccagttggattaagtcctaaaatgcaggacccaatttgagtgacttgaggtgcactcaggtt

SEQ ID NO: 18679 - DNA, 201 bp, Homo sapiens
atttgagaccagcctgagcaatatagcaaaactctgtctctacaaacaaacaaataaacaaacaaacaacaaaaaataatgctttctgtacataaaccagsacataagtaatataatttcatgggatgatagtcactatagagaagataggggtggtgcagtggaataaggtgagatagggttggtgggcagggctcttct

SEQ ID NO: 18680 - DNA, 201 bp, Homo sapiens
ggtgtaggagagcccgaccaacgctgctgggtgtcactttcctctgtaaactccggggctgtgagccccacatcacaggcatgtctgactctagaggaacrgaggtgcaggggcttgaggccactggactccattcagagggagtgaggaagcagaggccgaagcagtgttgttcccccagccccgtgcctcttgggtcct

SEQ ID NO: 18681 - DNA, 201 bp, Homo sapiens
attgcttgaggcccagaatttgagaccagcctgagcaatatagcaaaactctgtctctacaaacaaacaaataaacaaacaaacaacaaaaaataatgctytctgtacataaaccagcacataagtaatataatttcatgggatgatagtcactatagagaagataggggtggtgcagtggaataaggtgagatagggttg

SEQ ID NO: 18682 - DNA, 201 bp, Homo sapiens
acaacctggaggagtgacagacaccaggggcgcctgcccagggagagctatgtgtggcattagtgtctaaaatactcaagaaagcttggccaggagaattkctgaagaacacggggtgtttttagatgcgccaaaaccccaggcccggcagaagtaaggacctcccaaatgctggcctgtcctctgccaggtctcacacgt

SEQ ID NO: 18683 - DNA, 201 bp, Homo sapiens
gcgcaggagtttgcaggtggctctgagctgagcccagaaggacaatgcaaaccaggaccatgtcagtgggcctcaatagagtcccaggaatagcctgcccsgctcagcagtagggttcagggtgggccatttaacttctcacggctgcatcctcatctgtcaccagcttagacattctgggcttgttgcagaatgtgcctg

SEQ ID NO: 18684 - DNA, 201 bp, Homo sapiens
aggaatagcctgccccgctcagcagtagggttcagggtgggccatttaacttctcacggctgcatcctcatctgtcaccagcttagacattctgggcttgytgcagaatgtgcctgcccgaagggaaacccaggagtcccccaagccctccctgtcttgattgcccagcccctgccaggggatagccctggcaagcaatgc

SEQ ID NO: 18685 - DNA, 201 bp, Homo sapiens
gtccctgagcagagggtctggattggccatacctcatttatattgagatgaatgaactccttgttctttgtactgagagcctggaacacccctgataggaragaagggggaaaggcatccttttaaagacaattcctttaccaagtttgtttcccagcgaccaaagggccttccagtggagcctgtggggaagctgctcca

SEQ ID NO: 18686 - DNA, 201 bp, Homo sapiens
aaaaaaatgtatttcagaatttacaggcccatgtgagatatgatttttttaaatgaagatttagagtaatgggtaaaaaagaggtatttgtgtgtttgttkattgttcagtcagtgaatgtacagcttctgcctcatatccaggcaccatctcttcctgctctttgttgttaaatgttccattcctgggtaatttcatgtc

SEQ ID NO: 18687 - DNA, 201 bp, Homo sapiens
aatattgagacaatgaaagatctggttagatggcacttaaaggtcagttaataaccacctttcaccctttgcaaaatgatatttcagggtatgcggaagcsagcaccccagtctgagatggctcctgccggtgtgagcctgagggccaccatcctctgcctcctggcctgggctggcctggctgcaggtgaccgggtgtac

SEQ ID NO: 18688 - DNA, 201 bp, Homo sapiens
agcctccatggggaccatgacagcctggaaagcacaggcctgtgtgccctgccctcacgctggggtctggctaatacagcagcggctgcaccatgtctggygacctggtagctgtgtctggactgaagacaaacactggctcagttttaaccaagttctagactagcttcagatttccccagaagctcaggggccatggat

SEQ ID NO: 18689 - DNA, 201 bp, Homo sapiens
accagcagggactgacttttaacagatcagttatttaagcttgtcctctgtgcctgggatggttttaggtacctgtctgcattcactgtgttaatacagtrtagtcctcaaataccgttggtccttgaacaacacagatctgaactatgtggggccacttcttggattttcttccacctctgccacccttgagacagcaag

SEQ ID NO: 18690 - DNA, 201 bp, Homo sapiens
cctctgcccactctgcactcctgcagactcagaggcagctctggggcctggcacattccactcagaggcggcacctctgcttagtgcgctcagggggcctmatgggagagagaggattgcttcagaaggaaaaggagcaagaaacccaactggtccaggaggtggctttacggagaagtgcacggtgtggtcttgagtccc

SEQ ID NO: 18691 - DNA, 201 bp, Homo sapiens
cagggggcctcatgggagagagaggattgcttcagaaggaaaaggagcaagaaacccaactggtccaggaggtggctttacggagaagtgcacggtgtggycttgagtcccatctcctgcatcagagaatggcagagttttgtagtcggaagggaggttggtgaatgaaagcaggatgcattatgtgaacacagctggcac

SEQ ID NO: 18692 - DNA, 201 bp, Homo sapiens
caactggtccaggaggtggctttacggagaagtgcacggtgtggtcttgagtcccatctcctgcatcagagaatggcagagttttgtagtcggaagggagsttggtgaatgaaagcaggatgcattatgtgaacacagctggcacagctcctgcacaggcaatcccatagtgattcagcactggggtcagcaaaccttttc

SEQ ID NO: 18693 - DNA, 201 bp, Homo sapiens
tacatggtggctggcaaaagagagaaagcatgttcaggggaactcccctttataaaaccatcagatctcatgagacttatgcactatcacaagaacagcaycagaaagatccaccctcatgattcaattacctcccactgggtccctcccatgacacatgggaattatgggagctacaattggagatttgggtggggacac

SEQ ID NO: 18694 - DNA, 201 bp, Homo sapiens
tgactctagaggaacggaggtgcaggggcttgaggccactggactccattcagagggagtgaggaagcagaggccgaagcagtgttgttcccccagccccrtgcctcttgggtcctcagggaccccatgctgcagttgcttgcctgtcccagtgactcaacctccctctcgccatgctccatccacttacactcacccagc

SEQ ID NO: 18695 - DNA, 201 bp, Homo sapiens
aatttatgtctcccatgtcagtaccttatatagggtaggtatcaataattactcataaaagatgagaattattggttccctagaagtcattttcccattcyaggcatggtgccttttaggggacataactctgactgaactttatatgtcctccttagttagttacttagggtcttgatttcttctggaggctgtatttgt

SEQ ID NO: 18696 - DNA, 201 bp, Homo sapiens
tacaaagcatgaaaatgaggccgtagatgcaaaagcttaaaagggtgacccatacctcaaaagttctcagtaagtggcagcattttattatcgtggctatyattttgccagttatatcttaacaggtataaatattgaaacctccttagcgaaaattataacggtgagcaaattatgacagcggaggagatctgacctaac

SEQ ID NO: 18697 - DNA, 201 bp, Homo sapiens
taccatgtatttaaggctggacacatcaccactcccaacctgcctcacccactgcgtcacttgtgatcactggcttctggcgactctcaccaaggtctctrtcatgccctgttataatgactacaaaagcaagtcttacctataggaaaataagaattataacccttttactggtcatgtgaaacttaccatttgcaattt

SEQ ID NO: 18698 - DNA, 201 bp, Homo sapiens
gaattttctatttttttttttttttttttatacgtggtcccagcacagactaaggaatccaactatcattgggcaagccatgctaggtatgcatgcctttrgggctctgcaggggatagcgctatgcagggatggttgagagctggttttggggttgagacacgtgggaaatacttggactttgggctgagcctgtggtgc

SEQ ID NO: 18699 - DNA, 201 bp, Homo sapiens
agccctcactgtgtggcctggagccttcctaactgtgcatcatctccccaggaccatccacctgaccatgccccaactggtgctgcaaggatcttatgacmtgcaggacctgctcgcccaggctgagctgcccgccattctgcacaccgagctgaacctgcaaaaattgagcaatgaccgcatcagggtgggggaggtatg

SEQ ID NO: 18700 - DNA, 201 bp, Homo sapiens
cgctgggcaggccttggtggccctggtcccaggaggggagacttctgaagggggagacaaagatgccctccatgctggtttgtgcgtccagcttttatctyggagaattctaactttgacaaaaagtaagtgagttgtagagtacagattacactttaaactagatgatgtcaatatagactgcaaggatgggggccctcc

SEQ ID NO: 18701 - DNA, 201 bp, Homo sapiens; identical to SEQ ID NO: 2809

SEQ ID NO: 18702 - DNA, 201 bp, Homo sapiens
cacccatcaccttgggcaggctcagccctggtgttggggctgctccttcaagaggggcagggcaatggatcactcacatggacgctcttctttgtggagcytcctgctgtgaatttccgagtttcctctgcccggcttctcccaccgtctgcaccagaccttctttccactagcctgacctcaggtagcctctcaaactct

SEQ ID NO: 18703 - DNA, 201 bp, Homo sapiens; identical to SEQ ID NO: 2810

SEQ ID NO: 18704 - DNA, 201 bp, Homo sapiens; identical to SEQ ID NO: 2811

SEQ ID NO: 18705 - DNA, 201 bp, Homo sapiens
ttacgccccagggccatgggacttgctcgtatctgcagttaacacaggaacaagcacggtaccagaattccccatcatccagagcagtgtgacacagacgyttctgctcagctggaccaacagaacgccactccggagaactaggagtaaacaaaattggtgttcaggcagaggtcatgatgaagagcaacaatggccttg

SEQ ID NO: 18706 - DNA, 201 bp, Homo sapiens
tgatggaccgtcacctcccatttgtggatcgcgtcttcctccagggcatcgggagtgaggttgcagatctccactttatcaaagtgggccttgaagtcctkaaatgccatcctgcagcaaagcggagagacacgatgcacaggagggcaagagtgagggcatcatccattcactcattcattaaatcattcacttattcat

SEQ ID NO: 18707 - DNA, 201 bp, Homo sapiens
aaatgatgcccaagccacagaggtctgcagggaacctggcaatgcttgtgatttccctatggcccgctaccccccggctccctgcgactctatgctgcaaraagagtctccatgctcatcctcagcccttttgttcctgattttacagaaatctgtaagatatgatgtaaagctcctaactcccctaaataagaaacagat

SEQ ID NO: 18708 - DNA, 201 bp, Homo sapiens
cctgggctcaagtgtttcacccacctcagcctcccaaagtgctggtattacaggtgtgagccactgtgcctagccagcaatattctttttaatcagttttygattggtgaaaaagtgactatttctacctataatattcattatggattggataaaacatattgtctaattattttggtgtcattatattcagaattccca

SEQ ID NO: 18709 - DNA, 201 bp, Homo sapiens
agcagttttaagcccacaccaaaactgagaggaagatacagcaatttctcatataccccctactaccttccagtctcccccattattgacatcccccaccsagagtggtccatttcttacaacccacgaacctacattgacacatcattattactcaacgtccatagtttacattagggttggctcttggtgttgtacatt

SEQ ID NO: 18710 - DNA, 201 bp, Homo sapiens
ggtcaaagggcatggtggtgccctgcatggcagatggtggagaaactgcaccaggcaggtgcctcaggctttctgggtcaggggagagggtcaggtggccyttgaagttctgtttgctgttagcctgactgagttaactgcatgggtacctgactgtctttgctcagtctcctagtggacaaccacatttccggaaggctt

SEQ ID NO: 18711 - DNA, 201 bp, Homo sapiens
gctggggccactgtctctcccttgatgtttgcctttcaaggagatggctcccgggtccttgagaaacacatgcctgggtaatcaagctgacaaaagtcctmtctgatcttcacaaaaatgttatatacatttgaaagagaggagaaagtgcttataattacaagttttctaaggtaaatgctctgagaataagagagggag

SEQ ID NO: 18712 - DNA, 201 bp, Homo sapiens
ttggcactgttataggacatgcttacttgggtttcagacatatggctgcctgatgcatcagctctgtgaattccagcaactccctttccagaggaccaagwctgcatacatcagtgtcagcacgggctgggcgagcagacatttcatagctgccacccaagtggttcggcagtacttgggagggtggttagaaatctccct

SEQ ID NO: 18713 - DNA, 201 bp, Homo sapiens
gccttcttggcactgttataggacatgcttacttgggtttcagacatatggctgcctgatgcatcagctctgtgaattccagcaactccctttccagaggwccaagactgcatacatcagtgtcagcacgggctgggcgagcagacatttcatagctgccacccaagtggttcggcagtacttgggagggtggttagaaat

SEQ ID NO: 18714 - DNA, 201 bp, Homo sapiens
ctaggcatggtgccttttaggggacataactctgactgaactttatatgtcctccttagttagttacttagggtcttgatttcttctggaggctgtatttstcatttaaattttgctagatattatgcatattacttaagttttcacacttaatggcataaatctgtccctagtattccctctcaattttctaatctcctc

SEQ ID NO: 18715 - DNA, 201 bp, Homo sapiens
tgtccctagtattccctctcaattttctaatctcctctgtaactgcagtctatttatatgtcctcagtaaatatttgttgagtctgatagtttttggttaygatcatggactagtgcagtgagggcagttggatattttcctcctgggaggacatctgggattcacaatctggatgtttggtatcatgagacaatctccct

SEQ ID NO: 18716 - DNA, 201 bp, Homo sapiens
gtctgaaaaatgaaggtctccacccaagaatgtcttgtgagcatgactctgggaccagtagaaaacagcaacttttcaatggtttgcttgagggagcgaggagcagagctagaagggatatgtgccttgccttgcagataagctaagaaagtgtcctgcagcctggcgtggtggctcactcctgtaatcccagcactttgg

SEQ ID NO: 18717 - DNA, 201 bp, Homo sapiens
ctcagtgcactccttgccctgggctcccttgagggcaagcctggctgtccactgccctccaatgtccccttggctttgtgctctgcccaccctccccaagyacagctgtgtttgacaagaaggtggtgctgaggaggagggccgtccagccccacggtcccacgggctgctgagacgtgcaccgtgtaatgctgagtccca

SEQ ID NO: 18718 - DNA, 201 bp, Homo sapiens; identical to SEQ ID NO: 2838

SEQ ID NO: 18719 - DNA, 201 bp, Homo sapiens
ggcccttccctgaatgtctaagaccaacctggtccccacatccaaatgcacagacacagctgaggatggagaaggctaaagagggacagaggtagagacayaggctgagaggaggcagttgtaggttgagctagggctaaggtgttttccccatattccatcttaccccacactcaggccaggccttagagttgtggaagg

SEQ ID NO: 18720 - DNA, 201 bp, Homo sapiens
tttccctccttggagacagggccctgtcggtttattcactgtatgtccttggtgcctggagcctactaaatgctcaataaataatgatcacaggaatgaaygcatgctgaaaagaccactcttttgcacaccatctgctcaaagctcctcttgtctgtcctgtccgctttcagcctccgtctgtccacttattaagtttgc

SEQ ID NO: 18721 - DNA, 201 bp, Homo sapiens
aaaggctttcagacttctctggagagtcctggagctttgaggggctctttaggggccatctgggttcggagattagcacactctgccccacagtggctcarcttttatctgcttcacatactgggcttctgggaagatcttatttcagtaaactatttcacaataggaaatatatttgaaaactcttgaatgattctgtgg

SEQ ID NO: 18722 - DNA, 201 bp, Homo sapiens; identical to SEQ ID NO: 2840

SEQ ID NO: 18723 - DNA, 201 bp, Homo sapiens; identical to SEQ ID NO: 2843

SEQ ID NO: 18724 - DNA, 201 bp, Homo sapiens; identical to SEQ ID NO: 2845

SEQ ID NO: 18725 - DNA, 201 bp, Homo sapiens; identical to SEQ ID NO: 2846

SEQ ID NO: 18726 - DNA, 201 bp, Homo sapiens
cttgctttgaagtcagacagaccaggatggaaatactggctcttctttactagtttgtgatcttgggtggtgataggaaagcatttttctattctatgcaraacacccagtgccacgaagaaagccgtgacaggtgcagcctgaatgccagtcaactggcaaattgtggcatctcttaacatttatcaaaatatccttatc

SEQ ID NO: 18727 - DNA, 201 bp, Homo sapiens; identical to SEQ ID NO: 2850

SEQ ID NO: 18728 - DNA, 201 bp, Homo sapiens
tctgtggggtagggctgcttggcttgactttattttggaaaatgtattcatttctgtgggagctgaggatttctgctgcccgcttcctctcttgtgaccascactcatacatggagttagcaggtgaagaggacagcctcctcatcccctctttttataccttgcccttttgtgggaagaggctgaccattccccaatttg

SEQ ID NO: 18729 - DNA, 201 bp, Homo sapiens
tgatgtcctgtcctgaaagaaagaaaaataaaggaaagtgggcatctgagcactcatttgaaggaaatcctccggaatcgattcagaaatcctcatgaagkacccagaattccctgctttggagccagccagaccaggatgaactaaaagtgactgaacacttattatctgccaaccactttacatatattaactaattga

SEQ ID NO: 18730 - DNA, 201 bp, Homo sapiens
tcaggccaggccttagagttgtggaaggtggagaacactgggaagccaacctccgaagaagaccaggttggagtcaaaggaggaaggagagctctcattgycaaaccaacagggaagccaaggatatcccagtaactgctctcacatcattgatgagaatgccttgaatccgagctactaaatcacatttccttccttcta

SEQ ID NO: 18731 - DNA, 201 bp, Homo sapiens
tgaggatttctgctgcccgcttcctctcttgtgaccaccactcatacatggagttagcaggtgaagaggacagcctcctcatcccctctttttataccttscccttttgtgggaagaggctgaccattccccaatttgatgtttattgcttcaccttaagactttgtcttcagtgaaaatgcaaatactggtagggaggga

SEQ ID NO: 18732 - DNA, 201 bp, Homo sapiens; identical to SEQ ID NO: 2841

SEQ ID NO: 18733 - DNA, 201 bp, Homo sapiens; identical to SEQ ID NO: 2842

SEQ ID NO: 18734 - DNA, 201 bp, Homo sapiens; identical to SEQ ID NO: 2844

SEQ ID NO: 18735 - DNA, 201 bp, Homo sapiens
gattagcacactctgccccacagtggctcagcttttatctgcttcacatactgggcttctgggaagatcttatttcagtaaactatttcacaataggaaawatatttgaaaactcttgaatgattctgtggattttttcaggggtggagggtttcagggaccaagatggagactttatcttctcaaatacttaaaactcct

SEQ ID NO: 18736 - DNA, 201 bp, Homo sapiens
ttcttacagccacattgtgctgttcacatggtctgtgcagaagtcatcatgtttaaaacagagtggtaagaagatgtcacccaaagagatactacattttsccagttgactggcattcgggctgcacctgtcacagctttctttgtggcattaggagctctacatggaatggaaaaatgcttctcagcaggaacattctag

SEQ ID NO: 18737 - DNA, 201 bp, Homo sapiens; identical to SEQ ID NO: 2847

SEQ ID NO: 18738 - DNA, 201 bp, Homo sapiens; identical to SEQ ID NO: 2849

SEQ ID NO: 18739 - DNA, 201 bp, Homo sapiens; identical to SEQ ID NO: 2848

SEQ ID NO: 18740 - DNA, 201 bp, Homo sapiens; identical to SEQ ID NO: 2851

SEQ ID NO: 18741 - DNA, 201 bp, Homo sapiens
aagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaatgcatgctgaaaagaccactcttttgcacaccat

SEQ ID NO: 18742 - DNA, 201 bp, Homo sapiens
cagcaaaccagcatggcacatgtatacctatgtaataaacctgcatgttcagcacatgtatcccagatttgaaataaaattcttttaaaaaagggggggggatttaaagacagagacaggcatgtatacagagaggaaaccatgtgaacatggaagcagggattggggtgaggctctactgaccaagggctgccaaactat

SEQ ID NO: 18743 - DNA, 201 bp, Homo sapiens
tacccgacaggagtgggacttggctaagagcctacagaaaaccatccaagcagcgaggtctgagaattactctctgaccgacttctgggcctacatggttrtctctaagcaaaccagagaagtaagtcattcccagctggggacctggggtgggggtaggagcaaggggtctcagggtgtggggttaccaaagatgctgac

SEQ ID NO: 18744 - DNA, 201 bp, Homo sapiens
ggacttggctaagagcctacagaaaaccatccaagcagcgaggtctgagaattactctctgaccgacttctgggcctacatggttatctctaagcaaaccrgagaagtaagtcattcccagctggggacctggggtgggggtaggagcaaggggtctcagggtgtggggttaccaaagatgctgaccagcaccacctttta

SEQ ID NO: 18745 - DNA, 201 bp, Homo sapiens
gcaatcctccaactactgggttcaagtgatcctcctatctcagcctcccgaagtgctgggattacgtgtatgagccactgcatccagcctatcctaacacwtcgggtttttgttgttttttgtttgttttgtttattcttgagacagggtttcactctgtcgcccaggctggagtgcagtggtgcaatcacagctcactgc

SEQ ID NO: 18746 - DNA, 201 bp, Homo sapiens
ctgggtgacagactgagacccctctaaaaaaaaaatgtggcctacgtgcagaggttccaccctgtgggacccacatgcctccctcacactgtcttggcacmttctcccaaagctgccggagtctcatttgtccaatatgaagaagcccgtggaagaagggacactaccctacccgatatttgcagccattgacaatgacct

SEQ ID NO: 18747 - DNA, 201 bp, Homo sapiens
atgcctccctcacactgtcttggcacattctcccaaagctgccggagtctcatttgtccaatatgaagaagcccgtggaagaagggacactaccctacccratatttgcagccattgacaatgacctgcaaccttcctggcaggaggcaagagcaccaggtaagcaaacatttagagggagggagaggtagtaagggatgg

SEQ ID NO: 18748 - DNA, 201 bp, Homo sapiens
taccctacccgatatttgcagccattgacaatgacctgcaaccttcctggcaggaggcaagagcaccaggtaagcaaacatttagagggagggagaggtartaagggatggaacagcacggagtggaatggaagaatgtttccctgccctccccttggggagcccaggaagagggaagggctcaggattgcagaaaacagg

SEQ ID NO: 18749 - DNA, 201 bp, Homo sapiens
tttgcagccattgacaatgacctgcaaccttcctggcaggaggcaagagcaccaggtaagcaaacatttagagggagggagaggtagtaagggatggaacrgcacggagtggaatggaagaatgtttccctgccctccccttggggagcccaggaagagggaagggctcaggattgcagaaaacagggtgctcagcttaga

SEQ ID NO: 18750 - DNA, 201 bp, Homo sapiens
agccattgacaatgacctgcaaccttcctggcaggaggcaagagcaccaggtaagcaaacatttagagggagggagaggtagtaagggatggaacagcacrgagtggaatggaagaatgtttccctgccctccccttggggagcccaggaagagggaagggctcaggattgcagaaaacagggtgctcagcttagacgaga

SEQ ID NO: 18751 - DNA, 201 bp, Homo sapiens
caagaaaacctttaagaggccaacatggtggctcacgcttgtaatcccagtggtttgggaggctgaggtgggaggatcgcctgaaaccagaagttggagaycaccctgggcaacatagtgagatcccatctcaaaacaacaacattaaaaaacaaaacaaaacaaaaaaacacaataaattagccaagcatggtggcagga

SEQ ID NO: 18752 - DNA, 201 bp, Homo sapiens
ccaggttcacgccattctcctggcccagcctcctgagtagctgggactacaggcacccaccactgcgcccagctaatttttttttttttttttttttttgkatttttagtagagaccggtgttagccaggatagtctcgatctcctgacctcatgatccacccgcctcagcctcccaaagtgctgggattacaggcatgag

SEQ ID NO: 18753 - DNA, 201 bp, Homo sapiens
cctcccgagtagctgagattacaggcatgcgccaccacacccagctaatttttgtatttttagtagagacggggtttcaccatgttggccaggctggtctygaactcctgaccttgtgatctgcccgcctcggcctcccaaagtgcagggattacaggcgtgagccaccacgcccggccaataaacagaaatttaagcaag

SEQ ID NO: 18754 - DNA, 201 bp, Homo sapiens
tgggtctccaggccccaggggtcttctggaggggtcttctggagaggtcttgcaaccatttcttattgcctccttctcagaccatccgggctaccactgaytactgccgccgccacaagatcccctttccccaagtagaagaggctgagctggatttgtggtccaaggcccccgccagctgctacatcctgaaaggagaaa

SEQ ID NO: 18755 - DNA, 201 bp, Homo sapiens
gtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtagtccacccatcagtgtat

SEQ ID NO: 18756 - DNA, 201 bp, Homo sapiens
ctctctcggtcttgcatgtttatgcatgttgctgcctctctctgcagccttcttgtcctacctgaatatccaaccccttccacctgggcatcccacattcytcatccagtctcaggtgagcagctgcttggaaggcctagcatccaggatgggtggtcctccggggcctgattgtgccacttcccacagtgggctcctttt

SEQ ID NO: 18757 - DNA, 201 bp, Homo sapiens
gccacttcccacagtgggctccttttagcttgtcaatcgtgtctcctgcgatgagactcccattagggataaattgtgtctgttttcttccttcatttaaygaacatttattggttacctatgctgcatcagccatggttccaggagaggcaggctagagtagtaaagaagacaggaagcagggggccaggcgcggtggct

SEQ ID NO: 18758 - DNA, 201 bp, Homo sapiens
cacaccattgcactccagcctgggcaacaagagtgaaacacagtctcaaaaaaaaaaaaagaaaaaagaaaaagaaaaagaaaaaaaagaaatgaaacaamcaaaaaaaaaaaaaaaaagaaaagaaaatcaacaacaacaacaaaattctctgtgacccaatttctcctttgtaaaatggatacaatagtgcatagcccc

SEQ ID NO: 18759 - DNA, 201 bp, Homo sapiens
ttcatttaatgaacatttattggttacctatgctgcatcagccatggttccaggagaggcaggctagagtagtaaagaagacaggaagcagggggccaggygcggtggctcacgcctgtaatcccagcactttgggatgccaagccggggcagatcacctgagatcaggagtttaaggccagcttggccaacagggtgaaa

SEQ ID NO: 18760 - DNA, 201 bp, Homo sapiens
atcgaggcaatcacacttttgacatattgcatgagatgaaactttttcctacaaattgggtggttacaaagtaataaacagaattttttttttttttttttgagacagagtctcgctctatcacataggctggagtgcagtggcacaatctcggctcactgcaacctccacctcctgggttcaagcaattctcctgcctca

SEQ ID NO: 18761 - DNA, 201 bp, Homo sapiens
atgccaagccggggcagatcacctgagatcaggagtttaaggccagcttggccaacagggtgaaaccccgtctctattaaaaaatacaaaaaattagccargcgtggtgatgcacgcctgtaatcctagctacttgggaggctgaggcaggagaatcgcttgaatctaggaggtggaggttacagtcacccaagattgtgc

SEQ ID NO: 18762 - DNA, 201 bp, Homo sapiens
gcctgtaatcctagctacttgggaggctgaggcaggagaatcgcttgaatctaggaggtggaggttacagtcacccaagattgtgccattggactccagcstgggagacaagagcgagcctctgtctcaaaaaaaaaaaaaaaaaaaaaagaaaaaaggaccggaaggggcatggatcataaaaatatagataaatccata

SEQ ID NO: 18763 - DNA, 201 bp, Homo sapiens
gagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgagcacttgaaatgtgc

SEQ ID NO: 18764 - DNA, 201 bp, Homo sapiens
aattttattgctcttttcttggcaggtttatggggaagtgctcttggtaacactgaagtcattagggaatacatttttggtgagtatttggggaacagaamggtcaaaccctagagatattttatgcaaggagattcacagtacttttcctactcatggcagaagagagacctgtgtgtaattgttctagcaactgctttt

SEQ ID NO: 18765 - DNA, 201 bp, Homo sapiens
tttgggaggctgaggtgggaggatcgcctgaaaccagaagttggagaccaccctgggcaacatagtgagatcccatctcaaaacaacaacattaaaaaacmaaacaaaacaaaaaaacacaataaattagccaagcatggtggcaggaacctgaagaatctacccaggagactggggcaggaggatcactggagcccagga

SEQ ID NO: 18766 - DNA, 201 bp, Homo sapiens
ataaattagccaagcatggtggcaggaacctgaagaatctacccaggagactggggcaggaggatcactggagcccaggaattcaaggcttcggtgagctstgattgcaccattgtactacagcctgagtgacaaagtgagaccctgtccccccaaaaagaagaaagaaaaaagaaaacagaggagaggagggacaaaaga

SEQ ID NO: 18767 - DNA, 201 bp, Homo sapiens
ctgccaccagcagcgtagactcaggtctgaggatgagatccccagtggtttctgataccacacagtccatctctaacattctcctgtcatggttgtaattyctcattaatagatttctttttcctgcatacccgctacattcctggttctgtgctgggactcacttgccgttgtatttcctctgcagagacctggttcgag

SEQ ID NO: 18768 - DNA, 201 bp, Homo sapiens
atggtggcaggaacctgaagaatctacccaggagactggggcaggaggatcactggagcccaggaattcaaggcttcggtgagctgtgattgcaccattgyactacagcctgagtgacaaagtgagaccctgtccccccaaaaagaagaaagaaaaaagaaaacagaggagaggagggacaaaagacaaaaaggggccggg

SEQ ID NO: 18769 - DNA, 201 bp, Homo sapiens
ctggaagtcattatcctcagcaaactattgcaggaacagaaaaccaaacaccacatgttctcacttataagtgggagctgaatgatgagaacacatggacrcagggaggggaacaacacacactggggcctgttgggggcgggtggggagaagaagagcaccaggaaaattagctaatgcatgtggggcttaatacctatg

SEQ ID NO: 18770 - DNA, 201 bp, Homo sapiens
gacccctctaaaaaaaaaatgtggcctacgtgcagaggttccaccctgtgggacccacatgcctccctcacactgtcttggcacattctcccaaagctgcyggagtctcatttgtccaatatgaagaagcccgtggaagaagggacactaccctacccgatatttgcagccattgacaatgacctgcaaccttcctggcag

SEQ ID NO: 18771 - DNA, 201 bp, Homo sapiens
tgactctgatgaggcctttctcccatcgtgctctcattttcctgcctgtgaaatggaaggattgtcccagatgattttgagtcctccttcgaacttgatcrttctgcagttgtatttatttaatggaaattttccgtttcctctgtgtgtcgccctctccatgaggcaggtgttcctgtgaaggacctccttgcacacatc

SEQ ID NO: 18772 - DNA, 201 bp, Homo sapiens
gacaaaaaggggccgggcgcagtggctcacgcctgtaatcccaggactttgggaggccgaggcgggtggatcacgaggtcaggagatcaagaccatcctgrctaacacagtgaaaccccgtctctactaaaaatacaaaaaattagctgggcgtggcggcgggcgcctgtagtcccagctgctcgggaggctgaggcagga

SEQ ID NO: 18773 - DNA, 201 bp, Homo sapiens
atccacccgcctcggcctcccaaagtgctgggattacaggcatgagccaccgcacccggccatctctcactttttagatgtcttccttctccataggtccrattatcacccaaatgctggcagctctccagacattccagtttctcttttgagctcatctctctcctgagatccagacctccttaccctatttcctaagca

SEQ ID NO: 18774 - DNA, 201 bp, Homo sapiens
gagtgtaatggcacgatctcggctcactgcaacctctgcctcccaggttcaagtgattctcctgcctcagcctcccaagtagctgggattataggcatgcrccaccacgcctggctaatttttgtatttttagtagggatggggtgtcaccatgttaatcaggctggtctcgaactcctgaccttaggtgatccactcacc

SEQ ID NO: 18775 - DNA, 201 bp, Homo sapiens
cagctgactccgtcctttccataagccccacaaattcagtcattcccagacctagaaatcaccccctcctcattttcatcctttgtgctcttctacatcayccccagaccaggtctcccagtctcctgggagactcttgtaattagttcctcactggcccgcccatcccaagctgtccacctccttccctggctacctgat

SEQ ID NO: 18776 - DNA, 201 bp, Homo sapiens
gcatacccgctacattcctggttctgtgctgggactcacttgccgttgtatttcctctgcagagacctggttcgagttcacccctcaccacgctggcttcyctgcactgggggcctttgtttccataacccacttcggaagcaaattcaagaagggaagactggtcagaactcaccctgagagagacctgactttcctgag

SEQ ID NO: 18777 - DNA, 201 bp, Homo sapiens
cccaccaaaagatgtggccattgtaacccccagtgcctgtgaatgtgaccttgcatggaaataaggtctttaccaatgtcatcaagtgaagatgaggtcaytcgtgtggaccctaatccacaatgactagtgtccttatgaaaaggagagatttcgccgggcgcagtggctcacgcctgtaatcccagcactttgggaggc

SEQ ID NO: 18778 - DNA, 201 bp, Homo sapiens
tcatattaccaaagttacttttctgattccttctcatttgagtagactatttcttttaattattcttgaatttatgttggatttgactgtgttttttttttcttttttccgcttaaggatgtgactttaatgtccctagctaattatagcctaatttggtccttggtgctttcaggggtgaagattgtaagagttccttgg

SEQ ID NO: 18779 - DNA, 201 bp, Homo sapiens
ggaccgcaggagtctccatcccgcttccgcaggtggatagtgacaagggcatctcccttcgcttccctcggtttattcgagtccgtgaagacaagcagccrgagcaggccaccaccagtgctcaggtgaggtcctgggaagcaggggtgggccgcccagctgcttggccctaccagctttttagcgtggtggcctctctgg

SEQ ID NO: 18780 - DNA, 201 bp, Homo sapiens
ctcctgggctcaagcaatcctcttgcctcagccttttgagtaagctggggcaacaggcatgcaccatcgtgcctggctaatttttaattatttttttttttgtagagacagggatcttgctatattgcccaggctggtctcaaactcctgagctcaagcaatcctccaactactgggttcaagtgatcctcctatctcagc

SEQ ID NO: 18781 - DNA, 201 bp, Homo sapiens
ctcctccatccttagcatattaagtcaccctcatgctgaactcctccacaccacgggatggcggctgcatccaatgaagctgcaacttttttttttttttttgaagtcagggtctctctctgtcactcaagctgccgtgcaaaagcacagtcatagcccaatacaggtcttgaactcctggcctcaagtgatcttcctgcc

SEQ ID NO: 18782 - DNA, 201 bp, Homo sapiens
ctataggtgcataccaccaggcctggctaatttttgtattttttagtagagatagggtttcaccatgttagccaggctgactttaaactcctgacttcaawtgatccgcccacctcagtctcccaaagtgttagcattacaggcgtgagccaccgtgcctggctgattattcattttttatgtctccctgtatcatataca

SEQ ID NO: 18783 - DNA, 201 bp, Homo sapiens
tctgcttggccatttgatgtcttgaattcactattttattttatttcattttatttttgagacagggtcttgctctgtcacccaggctggagtgcagtggygagatcatggctcactgcagcttcgacctcctgggctcaagcaatcctcttgcctcagccttttgagtaagctggggcaacaggcatgcaccatcgtgcc

SEQ ID NO: 18784 - DNA, 201 bp, Homo sapiens
gtggtgcatgcctgtaatcccagctagtcgggaggctgaagcaggagaatcacttgaatctgggaggcagaggttgcagtgagccgagatcacaccactgmactccagcctgggcaacagagcgagatcccatctcaaaataaataaataatacaaagttaggtggctggtgacattggtttagctgtgcaacattaagca

SEQ ID NO: 18785 - DNA, 201 bp, Homo sapiens; identical to SEQ ID NO: 2857

SEQ ID NO: 18786 - DNA, 201 bp, Homo sapiens
caggtttattctagattttctgctcctccatccttagcatattaagtcaccctcatgctgaactcctccacaccacgggatggcggctgcatccaatgaarctgcaacttttttttttttttttgaagtcagggtctctctctgtcactcaagctgccgtgcaaaagcacagtcatagcccaatacaggtcttgaactcct

SEQ ID NO: 18787 - DNA, 201 bp, Homo sapiens; identical to SEQ ID NO: 2860

SEQ ID NO: 18788 - DNA, 201 bp, Homo sapiens
tcctccatccttagcatattaagtcaccctcatgctgaactcctccacaccacgggatggcggctgcatccaatgaagctgcaactttttttttttttttkgaagtcagggtctctctctgtcactcaagctgccgtgcaaaagcacagtcatagcccaatacaggtcttgaactcctggcctcaagtgatcttcctgcct

SEQ ID NO: 18789 - DNA, 201 bp, Homo sapiens
ttgccccattgcactccagcctgggcaacagagcaatactctgtctcaaataaataaataaataaataaataaataaataaataaataaataaatgggagmctttgcctccaaccctgaagaaaataagcgtgcaaaagatgagtagaggtggaggcagagatgaaggagctagaaaaaagaggccagaaagtcagagaga

SEQ ID NO: 18790 - DNA, 201 bp, Homo sapiens
tgctcttttcttggcaggtttatggggaagtgctcttggtaacactgaagtcattagggaatacatttttggtgagtatttggggaacagaaaggtcaaascctagagatattttatgcaaggagattcacagtacttttcctactcatggcagaagagagacctgtgtgtaattgttctagcaactgcttttcctgacat

SEQ ID NO: 18791 - DNA, 201 bp, Homo sapiens
atgtgctcactgtgtgagcaagttcactgttgcctacagggctggaatggtagaagactcttgaagcttaactcattccccacaaggcatgcaattttttycccagtattttattgactggtttgatggttcaggcttcaggtctgtaggggagtgcataggaagtgattgtggccaaaacatgtgagtaaatgcaacacc

SEQ ID NO: 18792 - DNA, 201 bp, Homo sapiens
actttcctttctccccaggctctactacccgaaggatagtgcccgaagttgctgcttggcatagatgagcctcagcttccagggcactgtgggcctgttgrtctactagggccctgaagtccacctggccttcctgttcttcactcccttcagccacacgcttcatggccttgagttcaccttggctgtcctaacagggcc

SEQ ID NO: 18793 - DNA, 201 bp, Homo sapiens
tatcagtctattcgaggaacagaaggaaagctgttattgctggatcagggtaggggaagcacggaatgaaatgtgattggagagatggacagagatcagawcttgtgaattctggcaggtatcatgacattcgatgtaggccaaagagttacctcctagcccagctcctgatacatgcttaataagcgtagtgttggataa

SEQ ID NO: 18794 - DNA, 201 bp, Homo sapiens
ttgggaggcccaggcggacagatcacttgaggtcaggggttcgagtgcaagctgggtaacatggtgaaaatgcgtctctactaaaaatacaaaaattagcyaagtatggtggtgcacgcctgtgatcccagctactcaggaggttgaggcacaagaatcgcttgaaaccaggaggcaaaggctgcagtgagctaagatcac

SEQ ID NO: 18795 - DNA, 201 bp, Homo sapiens
aaaaaaattaaaaaataaagaaatgaggggccgggcgcagtggctcacacctgtaatctcagcactttgggaggctgaggtgggcagatcacctgaggtcrggagtttgagaccagcctgaccaacgtggagaaaccccatctctactaaaaatacaaaattagccgggcgtggtggtacatgcctgtaatcccagctaca

SEQ ID NO: 18796 - DNA, 201 bp, Homo sapiens
tgaagtttccataattcctgggctccagaaagaagaaaaggcggccgtggagagacgaagacttcatgtgctgaaagctctgaagaagctaaggattgagsctgatgaggtaagtgaggggaggagggtggccccagagatcccagaatcgccccctctgtgcccagtgtccagggcccaactcagccagggagagctgga

SEQ ID NO: 18797 - DNA, 201 bp, Homo sapiens
gctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggtttccaatttctccacgtcctca

SEQ ID NO: 18798 - DNA, 201 bp, Homo sapiens
agtgaaaccccgtctctactaaaaatacaaaaaattagctgggcgtggcggcgggcgcctgtagtcccagctgctcgggaggctgaggcaggagaatggcrtgaacccgggaggcggaggttgcagtgagctgagatcgcgccacagcactccagcctgggcgacagagcaagactccgtctcaaaaaaaaaaaaaaaaaa

SEQ ID NO: 18799 - DNA, 201 bp, Homo sapiens
atcttgagactggtgccctgcgagctccaccccacccctccatgcagttccccatgggccccgcctgcatcttcttgaggaaaggcattgctgagaaacascgggtgaggtggggagtgagggggaagggcggtgggcggggcaaagggagcaggggtgtgggacaaagaaggggacatgatggtgccacagaaccagggg

SEQ ID NO: 18800 - DNA, 201 bp, Homo sapiens
tgattgcaccattgtactacagcctgagtgacaaagtgagaccctgtccccccaaaaagaagaaagaaaaaagaaaacagaggagaggagggacaaaagamaaaaaggggccgggcgcagtggctcacgcctgtaatcccaggactttgggaggccgaggcgggtggatcacgaggtcaggagatcaagaccatcctgact

SEQ ID NO: 18801 - DNA, 201 bp, Homo sapiens
ccagcctgggcaacatagcaagagcctgtctctatcaaaaaataaattagccgggcatggtgacatgcatctgtagtcccagctacttgggaggttgaggygggtggattgcttgagcccaggaggttgaggctgtagtggcccattattgtaccactgcactccagcctgggtgacagactgagacccctctaaaaaaaa

SEQ ID NO: 18802 - DNA, 201 bp, Homo sapiens
gaatttaattcatagttaaactttgagacaaagaaaactgacccccagtccttgttgagagattgaagccacattcatttactttttatttatttatttakttttgagacagagtttcactcttgttgcccagactggagtgcaatggcatgatctctgctcactggcacctccacctcctgagttcaagtgattctcctc

SEQ ID NO: 18803 - DNA, 201 bp, Homo sapiens
gggcgtggtggcgggcgcctgtagtcccagctactccggaggctgaggcgggagaatggcgtgagcccggaaggcggagcttgcagtgagccgagactgcrccactgcactccagcctagggcacaaagcgagactccatctcaaaaaaaaataaaataaaataaaccaatcaaaccaaattccaggccaccctcaggacc

SEQ ID NO: 18804 - DNA, 201 bp, Homo sapiens
ctggctaacacagtgaaaccccgtctcaactaaaaatacaaaaaattagctgggcgtggtggcgggcgcctgtagtcccagctactccggaggctgaggcrggagaatggcgtgagcccggaaggcggagcttgcagtgagccgagactgcgccactgcactccagcctagggcacaaagcgagactccatctcaaaaaaa

SEQ ID NO: 18805 - DNA, 201 bp, Homo sapiens
ttttttattttattttattttatttatttatttattttttttgagacagcatctcgctctgtcgcctaggctggagtgcagtgacgcgatctcggctcackgcaagctccgcctccggggttcaagcgattctcctgcctcaacctcccgagtagctgggattacaggcgcacaccaccacacccggctaatttttgtatt

SEQ ID NO: 18806 - DNA, 201 bp, Homo sapiens
tgtgcctggcctgaagtcacattcataagacaaggttagaatcatgaaggtgctggaactttgctaaagaacagtcgtgggttgaagaatgacctgccatyccttagcttccttttctatatgtgctccagagtcacgtaaccaggggtcgcatgatttataacttccccagctacttctataaataatatcactgtcgtg

SEQ ID NO: 18807 - DNA, 201 bp, Homo sapiens
gtttcctctgtgtgtcgccctctccatgaggcaggtgttcctgtgaaggacctccttgcacacatctttccccagtcttcatcgtccacacttaaaatgcycaactcactctcttcctctgtcctccagggcaatatcttctctctacaccaatgatggtgacatggaagctctcgaggctgacctgaaacatcgatttac

SEQ ID NO: 18808 - DNA, 201 bp, Homo sapiens
aatgatggtgacatggaagctctcgaggctgacctgaaacatcgatttacccgacaggagtgggacttggctaagagcctacagaaaaccatccaagcagygaggtctgagaattactctctgaccgacttctgggcctacatggttatctctaagcaaaccagagaagtaagtcattcccagctggggacctggggtggg

SEQ ID NO: 18809 - DNA, 201 bp, Homo sapiens
atttacccgacaggagtgggacttggctaagagcctacagaaaaccatccaagcagcgaggtctgagaattactctctgaccgacttctgggcctacatgkttatctctaagcaaaccagagaagtaagtcattcccagctggggacctggggtgggggtaggagcaaggggtctcagggtgtggggttaccaaagatgct

SEQ ID NO: 18810 - DNA, 201 bp, Homo sapiens; identical to SEQ ID NO: 2859

SEQ ID NO: 18811 - DNA, 201 bp, Homo sapiens
agtgagcccagatcacaccactgcactccagcttcgatgacagagcgagaccctgtctcaaaaaaaaaaaaaaaaaaaaaagtcacatactcacaggctcyagggattaggatagggacatcattaggagacattattcaacctgccacaaagacacagacacaaccagatgacagaagccaggggaagagttggaatatt

SEQ ID NO: 18812 - DNA, 201 bp, Homo sapiens
atttttttgtttttttttgaatttttacttcaatagcttttggggtacaagtggtttctgttacacgatgaattatgtagtagtaaattctgagactgtartccacccatcagtgtatgttttagagtatgttgcattcaatatgtagttttttggttttgttttttgtgacagtctcactctgttgcccaggctggagtg

SEQ ID NO: 18813 - DNA, 201 bp, Homo sapiens
gggtgatggcagaggcttactctttcccttacagaagatgttgtccctgtccaagctgacccttgctctgttgtgtgtctgggctgttagctgaggtcccrttgggtctccaggccccaggggtcttctggaggggtcttctggagaggtcttgcaaccatttcttattgcctccttctcagaccatccgggctaccactg

SEQ ID NO: 18814 - DNA, 201 bp, Homo sapiens
aggaagaaaaccggcagcatttgttaaacttcaatcaaagacgacttcagagacctaagctgtccactacagtggttgccggccacatgtggcacttgagsacttgaaatgtgcctggcccaagttgaagtgtgctatgaagataaaatacacctcggattttaatgaccgagtatggaaaacgcatgtcaaagaccttat

SEQ ID NO: 18815 - DNA, 201 bp, Homo sapiens
caccaacccattcatgaaggatccactcccatgatccaaacatctccctctgggccccacctccaacactggggatcacatttcaacatgagatttggagrggacgaatttccaaactatatcagtctattcgaggaacagaaggaaagctgttattgctggatcagggtaggggaagcacggaatgaaatgtgattggag

SEQ ID NO: 18816 - DNA, 201 bp, Homo sapiens
cacatttgttgacttgcatatgttaagccatccctgcattcctagtatgaaacccacttgatcacatcatggcaaatttcaagctaccaacatgaggtcascgagcacagagttggaagacgggtacaaaattagctctccagaacccgtatcaacagactccaacccatggctgccatttctattaaagagacgtcgctg

SEQ ID NO: 18817 - DNA, 201 bp, Homo sapiens
tcccatggtcccagctactcaggaggctgaggcaggaggatcacttgagcccaagaggtcgaggctgtagtgaactatgattgtgccactgcattccagcstgggtgacagagcaagaccctgtctcgaaaaaataataaataagtaaattatatggagagacaaggagaggcgagagcaggtatccggtgaaaaattctg

SEQ ID NO: 18818 - DNA, 201 bp, Homo sapiens
tacgtgtatgagccactgcatccagcctatcctaacacttcgggtttttgttgttttttgtttgttttgtttattcttgagacagggtttcactctgtcgyccaggctggagtgcagtggtgcaatcacagctcactgcagccttgacctcctgggctcaagcaatcctcccagctcagcctcccaagtagctgggactac

SEQ ID NO: 18819 - DNA, 201 bp, Homo sapiens
gtggcgagatcatggctcactgcagcttcgacctcctgggctcaagcaatcctcttgcctcagccttttgagtaagctggggcaacaggcatgcaccatcrtgcctggctaatttttaattatttttttttttgtagagacagggatcttgctatattgcccaggctggtctcaaactcctgagctcaagcaatcctccaa

SEQ ID NO: 18820 - DNA, 201 bp, Homo sapiens
catttgagcctgggggtttgagactgcagtgagccaagatcatgccactgcactctagtctgggcaacagagcaagacctgtctcaaaaaaaaaaaaaaawatatatatatatatatatatagactctatgtgacacaccagctcccttgccttctgccatgagtagaagctttttgcaccatgcttcttgtacagcctgc

SEQ ID NO: 18821 - DNA, 201 bp, Homo sapiens
gtggcctctctggaaccttgtggaggtgggagcagccagggagcttctgaccaccccgtcccaccctctctccgcaggtggcctgtttgtaccggaagcaragtcagattcagaaccaacaaggcgaggactcaggctctgaccctgaagatacctactaagccctcgccctcctagggcctgggtacagggcatgagttg

SEQ ID NO: 18822 - DNA, 201 bp, Homo sapiens; identical to SEQ ID NO: 2856

SEQ ID NO: 18823 - DNA, 201 bp, Homo sapiens
ggagctccaggtcttctcaatgaatgaaagaatggatgaatgtctttctcctaagtcatgtatgacctgtagaggcttccaggtcttctaatcttatccartgtgcaacactgcctacaaagcacagtggtaacttctaactttcctttctccccaggctctactacccgaaggatagtgcccgaagttgctgcttggcat

SEQ ID NO: 18824 - DNA, 201 bp, Homo sapiens
gctgaggtcccgttgggtctccaggccccaggggtcttctggaggggtcttctggagaggtcttgcaaccatttcttattgcctccttctcagaccatccrggctaccactgactactgccgccgccacaagatcccctttccccaagtagaagaggctgagctggatttgtggtccaaggcccccgccagctgctacatc

SEQ ID NO: 18825 - DNA, 201 bp, Homo sapiens
gttggaagacgggtacaaaattagctctccagaacccgtatcaacagactccaacccatggctgccatttctattaaagagacgtcgctgcaggtaatctrtattttctataactagtgactttacagttaaacattccccctgcctctgctcttttgcagcccgattactgaggctgcaagaaagttcacaaggggaaca

SEQ ID NO: 18826 - DNA, 201 bp, Homo sapiens
attacactggacttgtagattgcttttggcagtatggtcattttcacaatattgattctacccatccatgagcatgggatgtgtttccatttgtttgtgtyatctatgatttctttcagcagtgttttgtagttttccttgtagcagtctttcacctccttggttaggtatattcctgagtattttattttatttttttgc

SEQ ID NO: 18827 - DNA, 201 bp, Homo sapiens
gatcagagtaccagtagggttggattctggggaaccctcttctgggttgcagagagccaacttcttgccacatggcgggctttaatgttgttttttgacaycagcattcaccatatgctggttatagacaagtctggaaggagaatctatctccaacctgcaaatggctaactaatgttgtgggatggtaggctggtgatt

SEQ ID NO: 18828 - DNA, 201 bp, Homo sapiens
accttggctgtctcggcttctttccctaggctcactcagtaacttgatggattttgtgaagaaaacaggcatttgcgcttcaaagtgggaatgggggaccmctcacaacttcctgtacaaacacggtgagaagaccctcttcccaccgccctggtctgtccttgcgtgtgaatgggctggagtaggggaagggggtgggcc

SEQ ID NO: 18829 - DNA, 201 bp, Homo sapiens
agtgggagctgaatgatgagaacacatggacgcagggaggggaacaacacacactggggcctgttgggggcgggtggggagaagaagagcaccaggaaaaytagctaatgcatgtggggcttaatacctatgtgatgggttgataggtgcagcaaaccgccatggcacatgtttacctgtgtaacaaatctacacgtcctg

SEQ ID NO: 18830 - DNA, 201 bp, Homo sapiens
tacaggcacatgtatgttcactgcagcactattcacaatatcaaagacatggaatcaacccaaatgcccatcagtgatagactggataaagaaaatgtggyacatatacaccatggaatactatgcagccagaaaaaggaacaagatcatgtcctctgcagggatatgggtggagctggaagtcattatcctcagcaaact

SEQ ID NO: 18831 - DNA, 201 bp, Homo sapiens
caacaacaacaacaacaaaaaagaaatggcaaccccaaggtgatggtattaagagatggggcctttgggaggtgttgagaccatgagggtggagccctctwgatttggattaatcccttataaaagaagcctcagagagctcactccaaggaatgcggtgaaggttgaagggtagaatttatgcaaaatgccaagatgagc

SEQ ID NO: 18832 - DNA, 201 bp, Homo sapiens
aaaagaaaaagaaatgtaatccccagtgttggaggtggggcctggtgggaggtgattggatcatgggggcggatccctcatgaatggcttagcgtcatccycttggtgattagtaagtgcttgctctgagttcatgtgagatacggttgtttagaagtgtgtggcaccttccccctcgctctcttgctcctgctctcggca

SEQ ID NO: 18833 - DNA, 201 bp, Homo sapiens
ggatcatgggggcggatccctcatgaatggcttagcgtcatcctcttggtgattagtaagtgcttgctctgagttcatgtgagatacggttgtttagaagygtgtggcaccttccccctcgctctcttgctcctgctctcggcaagtgatgtgcctgctccccattcactttccatcatgattggaagcttcctgaggccc

SEQ ID NO: 18834 - DNA, 201 bp, Homo sapiens
tcatgaatggcttagcgtcatcctcttggtgattagtaagtgcttgctctgagttcatgtgagatacggttgtttagaagtgtgtggcaccttccccctcrctctcttgctcctgctctcggcaagtgatgtgcctgctccccattcactttccatcatgattggaagcttcctgaggccccaccagaagcagatgccagc

SEQ ID NO: 18835 - DNA, 201 bp, Homo sapiens
ggatgcctagtttgcaaatatttgctcgcattcagtgggttgtgtgtttactctgataattacttcctttgctgtacagaagctttttaatttactcaggkcccatatatttgtttatttttgagacggagtctcactccatcacccaggcttcagtgcagcagcacgatctcggctcactgcaatctccgcctcccagac

SEQ ID NO: 18836 - DNA, 201 bp, Homo sapiens
tcagattgctttctgacacataaatgggattatttttttcctcctgacaccaaatgtgtgtggttttttccaacgctgcttctcgagctctctggtactarctgggtgtcctacaattctgagcaattctgacgctggctacctggagttcacatcagattccacaggtgaaaggggctcagtcccaaaaaactgctccca

SEQ ID NO: 18837 - DNA, 201 bp, Homo sapiens
ggtggccccagagatcccagaatcgccccctctgtgcccagtgtccagggcccaactcagccagggagagctggaccgaaggatatgaacttctatgggayagaaatagaaggatatgaacttctatgggacaggcattgcccctgcctaagggagatcctaggtctcctccttctcctcctcctcctttctttttctttt

SEQ ID NO: 18838 - DNA, 201 bp, Homo sapiens
agcaaaccagcatggcacatgtatacctatgtaataaacctgcatgttcagcacatgtatcccagatttgaaataaaattcttttaaaaaagggggggggwtttaaagacagagacaggcatgtatacagagaggaaaccatgtgaacatggaagcagggattggggtgaggctctactgaccaagggctgccaaactatt

SEQ ID NO: 18839 - DNA, 201 bp, Homo sapiens
ttgttctgtggattaaattaatacttgttaatacatgtgaagtgcttagcacagtatctgccacttactgtggggtttataaacattttcctcccctcccytcccctcccctcatggcctcctttcgagactgggtcttatggtgtgatcatagctcactgcagcctcaacctcctgggctcaagcgatcctcccacctca

SEQ ID NO: 18840 - DNA, 201 bp, Homo sapiens
ttggtagggtacttggacagtgtctgagaccacctggatttcttgacgtagatgaaggcggtgagcctgaacacacctggctgactgagatgctcgagaaytggaccaggacctccctggaaaagcaggagcagccccatgaggaccccgaaaggaaaggtaccatgtgtagtgtgataagtgtcatcaacagtaagtgcc

SEQ ID NO: 18841 - DNA, 201 bp, Homo sapiens
tgacctcctgaggctgtgtcacggttgtgcatccttaaccttggcaaaataaactttctacactgaccgagacctgtctcagaaacattgggttaacaacrctctcacatattgctgctgagaaggcagcttcatttggaacttcacgccaaaaaccccattttaccttaattacctctttaaagaccctgtctccaaata

SEQ ID NO: 18842 - DNA, 201 bp, Homo sapiens
tgctctgagttcatgtgagatacggttgtttagaagtgtgtggcaccttccccctcgctctcttgctcctgctctcggcaagtgatgtgcctgctccccaytcactttccatcatgattggaagcttcctgaggccccaccagaagcagatgccagcaccacgcttcctgtacagcatccagaactgtgagacaattaaac

SEQ ID NO: 18843 - DNA, 201 bp, Homo sapiens
tgggtaatggagagagatggaatgtgccacacgaagcctcactatgactttctataatgcctggctcctgtgctgaaatgagaacatgcatcctagccggscatggtggtgcgtgcacctgtagtcccagctattcggggaggctgaggtgggaggattccttaagcccaggagttggaggctgcagtgagctatgaatgc

SEQ ID NO: 18844 - DNA, 201 bp, Homo sapiens
gaggttgcagtgagctgagatcgcgctcctgcactccagcctggggacagagcaagactccttctcaaataaataaataaatacataccatcaggtctcgygagaactcaactcactgtcacgagaacagcatgagggtaaccacttccatgcttcaattacctcccacgacacttggggattatgggaactacaattcaa

SEQ ID NO: 18845 - DNA, 201 bp, Homo sapiens
gaggattccttaagcccaggagttggaggctgcagtgagctatgaatgcaccactgcactcagagtgagacccccatcccttaaaaagttttcttttaaaraacgtacttttttttgttttgttttttgtttttgtttgtttgtttgagatggagtctcgctctgtcacccaagctggagtgcggtggtgcaatcttggct

SEQ ID NO: 18846 - DNA, 201 bp, Homo sapiens
acttactataagatatacttgagcccaggtattcaagactagcctggaaaacactgtgagacctcatcttttttaaacaaaattaataaatagataaaacrtttaaaaaagccaggtgtgatggctcacgcctgtagtcccagctactcaggaggctgaggcgggagggtcgcttgaggccaggagttcaagaccagcaag

SEQ ID NO: 18847 - DNA, 201 bp, Homo sapiens
gttcaagaccagcaagcctgggcaacgtagtgagacctcctctctaaaataaataaataaaaatataagatagaatggccgggtgtggtggctcatggctktaatcccagcactttgagaggccaaggtgggcggatcgcttgaggtcaggagcttgagaccagcctggccaacatggcaaactctgtctctactaaaaat

SEQ ID NO: 18848 - DNA, 201 bp, Homo sapiens
tcccaggttcacgccattctcctggcccagcctcctgagtagctgggactacaggcacccaccactgcgcccagctaatttttttttttttttttttttttgtatttttagtagagaccggtgttagccaggatagtctcgatctcctgacctcatgatccacccgcctcagcctcccaaagtgctgggattacaggcatg

SEQ ID NO: 18849 - DNA, 201 bp, Homo sapiens
acgtagtgagacctcctctctaaaataaataaataaaaatataagatagaatggccgggtgtggtggctcatggctttaatcccagcactttgagaggccraggtgggcggatcgcttgaggtcaggagcttgagaccagcctggccaacatggcaaactctgtctctactaaaaatgcaaaaatacaaaattcgccgggc

SEQ ID NO: 18850 - DNA, 201 bp, Homo sapiens
acctgtattagtccatgctcacactgctaataaaaacatacctgagactgggtaatttacaaaggaagaaggtttaattgactcacagttcagcatggatkgagaggcctcaggaaacttacagtcatggtggaaagcgaaggccaagcaagtcaccttcttcacaaggcggcaggaaggagaagtgagtgccagcagggc

SEQ ID NO: 18851 - DNA, 201 bp, Homo sapiens
gtccaagctgacccttgctctgttgtgtgtctgggctgttagctgaggtcccgttgggtctccaggccccaggggtcttctggaggggtcttctggagaggtcttgcaaccatttcttattgcctccttctcagaccatccgggctaccactgactactgccgccgccacaagatcccctttccccaagtagaagaggctg

SEQ ID NO: 18852 - DNA, 201 bp, Homo sapiens
tgatccgcccacctcagtctcccaaagtgttagcattacaggcgtgagccaccgtgcctggctgattattcattttttatgtctccctgtatcatatacaratgtgtttggctaaaagtcactaaccaaccacagtgccccgaggacatgtgggattaattttcttacaaaagaaaaagacagactgagcaccgtgactca

SEQ ID NO: 18853 - DNA, 201 bp, Homo sapiens
tttttttttttttttgagatggagttttgctctttttgcccaggctggagtgcaatggcgcgatctcagctcaccgcaacctcggcctcctgggtttaagygattctcctgcctcccgagtagctgggattacaggcatgcgccaccacgcccggctaattttgtatttttagtagagacagggtttctccatgttggtca

SEQ ID NO: 18854 - DNA, 201 bp, Homo sapiens
tccccaagtagaagaggctgagctggatttgtggtccaaggcccccgccagctgctacatcctgaaaggagaaactggaccagtggtgatgcattttcccytgttcaacatagatgcctgtggaggtaggtgcaggggaggagcaggtgagaagccacctgtattagtccatgctcacactgctaataaaaacatacctga

SEQ ID NO: 18855 - DNA, 201 bp, Homo sapiens
ttccgcaggtggatagtgacaagggcatctcccttcgcttccctcggtttattcgagtccgtgaagacaagcagccggagcaggccaccaccagtgctcakgtgaggtcctgggaagcaggggtgggccgcccagctgcttggccctaccagctttttagcgtggtggcctctctggaaccttgtggaggtgggagcagcc

SEQ ID NO: 18856 - DNA, 201 bp, Homo sapiens
ccacccgccctctctccccttccttctctatctgcgaggctttgctctctgccgtgcaagtctgtgccaggcttactttgctgtctgtcactgtgactcakcctccctgtctctcttcctgtgtctccatcatggtctcttgtgcacacaatctcttgggcattctgtttctatttgttgtagcccaagaagacaacattg

SEQ ID NO: 18857 - DNA, 201 bp, Homo sapiens
ttattttcttacaattctgcaggcaggaagtccaagatcaaggtgccagtggggtcagtttctcctgaggcctctctccatggcttgcagagggatggccrccttctcaccgcatcctctcagcccagcctttcctcagtgcacacgcattcttggtattcttggtgtcttcctttttttcttttttttttttttttagat

SEQ ID NO: 18858 - DNA, 201 bp, Homo sapiens
attggtgcagcaaaccagcatggcacatgtatacctatgtaataaacctgcatgttcagcacatgtatcccagatttgaaataaaattcttttaaaaaagkgggggggatttaaagacagagacaggcatgtatacagagaggaaaccatgtgaacatggaagcagggattggggtgaggctctactgaccaagggctgcc

SEQ ID NO: 18859 - DNA, 201 bp, Homo sapiens
atggattttgtgaagaaaacaggcatttgcgcttcaaagtgggaatgggggaccactcacaacttcctgtacaaacacggtgagaagaccctcttcccacygccctggtctgtccttgcgtgtgaatgggctggagtaggggaagggggtgggcctgaaacaatcccaggctggtccttccccagagctttggaggggggt

SEQ ID NO: 18860 - DNA, 201 bp, Homo sapiens
ctgtccaagctgacccttgctctgttgtgtgtctgggctgttagctgaggtcccgttgggtctccaggccccaggggtcttctggaggggtcttctggagaggtcttgcaaccatttcttattgcctccttctcagaccatccgggctaccactgactactgccgccgccacaagatcccctttccccaagtagaagaggc

SEQ ID NO: 18861 - DNA, 201 bp, Homo sapiens
gtccttgcgtgtgaatgggctggagtaggggaagggggtgggcctgaaacaatcccaggctggtccttccccagagctttggaggggggtggtgtcaaagkgcccagggatctgattaggggaactttcgctcagtggtgtggtccatactgaaaaatgtgtggcctcgctgcgagtcccagtcatcgtgaaaagcctcac

SEQ ID NO: 18862 - DNA, 201 bp, Homo sapiens
agctgggcgtggtggcgggcgcctgtagtcccagctactccggaggctgaggcgggagaatggcgtgagcccggaaggcggagcttgcagtgagccgagaytgcgccactgcactccagcctagggcacaaagcgagactccatctcaaaaaaaaataaaataaaataaaccaatcaaaccaaattccaggccaccctcag

SEQ ID NO: 18863 - DNA, 201 bp, Homo sapiens
gctgtgtgtggcctgggaagggaaccctggctggatgtcagtcctgctcacctctcctggggtgcttcctacaaggcacacaggacttcagctgtgtctgmgcaccatgccatgcagctgccgggtcttatggcctcggaatacaccatcaagcatcaagtcactggatcatggcgatgagtgttttagcatcaaatttct

SEQ ID NO: 18864 - DNA, 201 bp, Homo sapiens
agtagagacaggatttcaccatgttggtcaggctggtcttgaactcctgacctcaggtgatccacccaccttggcctcccaaagtgctgggattacaggcrtgagccaccgtgcccggccaaaatagagtaattatgaaaattaatcctttatcacaaatacttgtagcagagcacatctccccatgtttttttgttgttg

SEQ ID NO: 18865 - DNA, 201 bp, Homo sapiens
caaaaaataaattagccgggcatggtgacatgcatctgtagtcccagctacttgggaggttgaggtgggtggattgcttgagcccaggaggttgaggctgyagtggcccattattgtaccactgcactccagcctgggtgacagactgagacccctctaaaaaaaaaatgtggcctacgtgcagaggttccaccctgtggg

SEQ ID NO: 18866 - DNA, 201 bp, Homo sapiens
tgttgttgttttcctatatataacaaaaggaggaggtggttgcatttctcctcttactttccgtaacaccctactctgtggagtaacgattctttcacccytttgctttcttaacagacttgctttcgctttgcactgtggactcaccctgaattctttcttgtatgagatccaagaaccctttcttggggtctggatcgg

SEQ ID NO: 18867 - DNA, 201 bp, Homo sapiens
gctgtagtggcccattattgtaccactgcactccagcctgggtgacagactgagacccctctaaaaaaaaaatgtggcctacgtgcagaggttccaccctstgggacccacatgcctccctcacactgtcttggcacattctcccaaagctgccggagtctcatttgtccaatatgaagaagcccgtggaagaagggacac

SEQ ID NO: 18868 - DNA, 201 bp, Homo sapiens
atctgggaagagagagaagtcagctcctagttggcaacctcacaactgctgtctacactgacaacgatcattttcccatccccctctctgccttccatttmcaagtcttgctttcagtccccagaagcagctgatcctctttcttcctgggcaccacaggtggcatccgggacaagataatgagcagccggaagcacctcc

SEQ ID NO: 18869 - DNA, 201 bp, Homo sapiens
gggaggttcacctcatcctctccttcgacttcagtgccggagatcctttcgaggtaatcgagaagggctttggggccggtcctgggtgggaggtgggctgyggcgaagctgactttgcggaggaactgaggacgcgggctgggaagcgggcaatggggaggtgctggctgggaagtccagagagccaaatcaactcaccca

SEQ ID NO: 18870 - DNA, 201 bp, Homo sapiens
ttgtctcaaaacaaacaaacaaacaaacaaacaaacaaaaaactagaatgtgttttgggcaccagcaaagcaaggggcatacaattttttttaaatggggyatttccagaaaaaattacaacaaaaaccaaaaacaaaacagtcatagtgagtaaaatcagaacttgattaaatgtccttgactgtagcttacacactggt

SEQ ID NO: 18871 - DNA, 201 bp, Homo sapiens
atttatgcccacagacaatcctccatgcaatcgtgtggctacactcttcccttgcactccaggattccatggagttgcagccacaatgagatggaagagaraggcagggctgagggttcaagctctggaaaatattggaaacaggctgctgtggaagttatgagctgccaccagcagcgtagactcaggtctgaggatgag

SEQ ID NO: 18872 - DNA, 201 bp, Homo sapiens
ggtgttgagaccatgagggtggagccctctagatttggattaatcccttataaaagaagcctcagagagctcactccaaggaatgcggtgaaggttgaagkgtagaatttatgcaaaatgccaagatgagcctggcaggtgacgttctcagcaaacgtgagcagagctattatcagtgtgtgtgtgtgagagagagagagt

SEQ ID NO: 18873 - DNA, 201 bp, Homo sapiens
agatttatgcccacagacaatcctccatgcaatcgtgtggctacactcttcccttgcactccaggattccatggagttgcagccacaatgagatggaagaragaggcagggctgagggttcaagctctggaaaatattggaaacaggctgctgtggaagttatgagctgccaccagcagcgtagactcaggtctgaggatg

SEQ ID NO: 18874 - DNA, 201 bp, Homo sapiens
agcagagtcttccctaactcccccggggaaagggagactccctttcctggtctctaggcactgacgcaaccgctagaccaaggtccgctaggcaatgggcrtcttcccagacgctggcgttaccccaagaccaaggggccctctagtggccctattcgggcatgacagagggctcacacttgtcttctggtcactcttgac

SEQ ID NO: 18875 - DNA, 201 bp, Homo sapiens
gcgtagagagagaggatagcttatgtcattatttcttttatgttcttttcagaaagatcaaagactttaatattttaatactttcactaattctgctactsctatctagagggtgcagccaggtatacagagtggaacaggaaagtgaaacaggagtgtgaccactgaagcacagcatcacagggagatggtcaggcctct

SEQ ID NO: 18876 - DNA, 201 bp, Homo sapiens
gactgagaattttctgaccgcagtgcaccatgggaaggtaagtcctcttagagctgaccactatggggaagcagagcatttgtgtaatggaatgcatagtragtgtcaagaggtgagggctgtgacagttcctctcgcttggtggagatagatggaaagagctgaaggttgggcatggtggcccatgcctgtaaccccagc

SEQ ID NO: 18877 - DNA, 201 bp, Homo sapiens
aggaactgaggacgcgggctgggaagcgggcaatggggaggtgctggctgggaagtccagagagccaaatcaactcacccatcgctcccgaagcacccgcrgtcggccacatccaacgaacttctgatccaaagccatcccagaccttcccgggcccctcttcctggcagatgactctccccgcttctgcgtcctgcctgc

SEQ ID NO: 18878 - DNA, 201 bp, Homo sapiens
caccacccaaggctaggattacaggcacaagccgccctgcccagctattttattaaaaaatatatacacctacataatatataactatatctattacatgrtacataccaatacatagtagtatatataaaataatcatggtaaaacatatcatctattatatttatgtgtaatgtaatatatatttatattcacacactt

SEQ ID NO: 18879 - DNA, 201 bp, Homo sapiens
atatttatgtgtaatgtaatatatatttatattcacacacttctatcagtttacattctgtaatatgaattaggaacatccatcctcctccccataccatratccagaaccaacttgtcaccatctttctagacccttggcccaggaatacccaggctttctggtcttaggatttctgctgaaataaatatcccaagacaa

SEQ ID NO: 18880 - DNA, 201 bp, Homo sapiens
ccacatgtggcacttgagcacttgaaatgtgcctggcccaagttgaagtgtgctatgaagataaaatacacctcggattttaatgaccgagtatggaaaaygcatgtcaaagaccttattcgtaattggtatattgacatactaggcagggctctccagagggacagaaccaataggatctatgtctagatgaaagggagt

SEQ ID NO: 18881 - DNA, 201 bp, Homo sapiens
tcttgggcatcagagattttgaaattgtcactcccaggtactccctataacattattatttccttagatgtatgtatcacctactgaagggattctgtacrtgtattttatccctcccctcacacaccagggtgctttttatttattattataaaataaacataacataaaatttgccattttaaccattttaaagtgtca

SEQ ID NO: 18882 - DNA, 201 bp, Homo sapiens
tgaagtgtgctatgaagataaaatacacctcggattttaatgaccgagtatggaaaacgcatgtcaaagaccttattcgtaattggtatattgacatactwggcagggctctccagagggacagaaccaataggatctatgtctagatgaaagggagtttcaggatcacaaggtggagtcctacaataggccgtctgcgag

SEQ ID NO: 18883 - DNA, 201 bp, Homo sapiens
caggcatgcgccaccacacccagctaatttttgtatttttagtagagacggggtttcaccatgttggccaggctggtcttgaactcctgaccttgtgatcygcccgcctcggcctcccaaagtgcagggattacaggcgtgagccaccacgcccggccaataaacagaaatttaagcaagacatatctgtaacaatttaac

SEQ ID NO: 18884 - DNA, 201 bp, Homo sapiens
gcagtgtgcatggaccagagcttgaccgtcccctagctgcaagggaggctgggaaatatttgcccttcctgcctgtgtgctgagaagggttggcatggacrggagcttgaaatggccttggggtagccagtctacagtgcccggctggctccacccatagaaggttcgtgaggacaaggaccttatctgtcttgtttactg

SEQ ID NO: 18885 - DNA, 201 bp, Homo sapiens
gcccggctaattttttgtaattttagtagagatggggtttcactgtgttagccaggatggtctcgatctcctgacctcgtgatccacccacctcagcctcycaaagtgctgggattataggcatgagccatgagccaccatgcccagcctctttcttgctcttgtcacccaggttggagtgcaatggcgctatctgggctc

SEQ ID NO: 18886 - DNA, 201 bp, Homo sapiens
gagaagggttggcatggacaggagcttgaaatggccttggggtagccagtctacagtgcccggctggctccacccatagaaggttcgtgaggacaaggacyttatctgtcttgtttactgctctattccaacagccagaagagtgccgggtgcccactaattgcttcataaatatttatggaatggaagaaagatctttct

SEQ ID NO: 18887 - DNA, 201 bp, Homo sapiens
gacaaggaccttatctgtcttgtttactgctctattccaacagccagaagagtgccgggtgcccactaattgcttcataaatatttatggaatggaagaawgatctttcttcctgctgcagatccctgcagtgctttatgccagtctgctggtgctttgaatatcaaacatgacagtcacgtgatggagaatgtttgaatt

SEQ ID NO: 18888 - DNA, 201 bp, Homo sapiens
aattgcttcataaatatttatggaatggaagaaagatctttcttcctgctgcagatccctgcagtgctttatgccagtctgctggtgctttgaatatcaarcatgacagtcacgtgatggagaatgtttgaattttattgctcttttcttggcaggtttatggggaagtgctcttggtaacactgaagtcattagggaata

SEQ ID NO: 18889 - DNA, 201 bp, Homo sapiens; identical to SEQ ID NO: 2914

SEQ ID NO: 18890 - DNA, 201 bp, Homo sapiens; identical to SEQ ID NO: 2916

SEQ ID NO: 18891 - DNA, 201 bp, Homo sapiens; identical to SEQ ID NO: 2918

SEQ ID NO: 18892 - DNA, 201 bp, Homo sapiens; identical to SEQ ID NO: 2919

SEQ ID NO: 18893 - DNA, 201 bp, Homo sapiens
tcccagtaagtacatataaaatctgtatttccagggtggattatcaacacagctgtattttagaaatattatctgccctcccaggtatcacagctactaawtattgggtactgaggtggaattttagggatcagccaattatgggaaagaaaatctgggggcaggataagatggtctccgaagccttaaaattatatgcca

SEQ ID NO: 18894 - DNA, 201 bp, Homo sapiens; identical to SEQ ID NO: 2920

SEQ ID NO: 18895 - DNA, 201 bp, Homo sapiens; identical to SEQ ID NO: 2921

SEQ ID NO: 18896 - DNA, 201 bp, Homo sapiens
catgccagctttatttcccgtggcacctggcacactgctaagcacttacatgcttaacaactagattgggaatggtgctgctctggggaagtgggcacacrttaaagaaatgtttatttcagtcttctgaaatagggaattactctggctaaaatgtagctccagaaagggaaagtggggctgtatgaatccaggtccagt

SEQ ID NO: 18897 - DNA, 201 bp, Homo sapiens
gtgtcatgccagctttatttcccgtggcacctggcacactgctaagcacttacatgcttaacaactagattgggaatggtgctgctctggggaagtgggcrcacgttaaagaaatgtttatttcagtcttctgaaatagggaattactctggctaaaatgtagctccagaaagggaaagtggggctgtatgaatccaggtc

SEQ ID NO: 18898 - DNA, 201 bp, Homo sapiens
ttatttatacccttcgagagaaaaacgtctcagctgtcacaggaagctgcttcggggggtgagcaaactttttaaaatgcagaaattatgatctacacccrtttcttaaaagtaagccatcgtacttggttctctttaattatatattttcttacatattgtgttcatgtaggcaagtcctgtttctgctaaaagaaggta

SEQ ID NO: 18899 - DNA, 201 bp, Homo sapiens
tttgcaaacatttatttatacccttcgagagaaaaacgtctcagctgtcacaggaagctgcttcggggggtgagcaaactttttaaaatgcagaaattatratctacacccgtttcttaaaagtaagccatcgtacttggttctctttaattatatattttcttacatattgtgttcatgtaggcaagtcctgtttctgct

SEQ ID NO: 18900 - DNA, 201 bp, Homo sapiens
gcccctcagggtcaggagcagtctgatcaaaaggagggcatccactgtccggggccattcccacagctcccggatgctgggtctggaggctgcgcccttcscctgcaggagctcagcccagtggtaagtcatctgtgtgtcatctatgtatttaaccccttatggccatgttgatgctgagcatggtttcacttttgcaaa

SEQ ID NO: 18901 - DNA, 201 bp, Homo sapiens; identical to SEQ ID NO: 2915

SEQ ID NO: 18902 - DNA, 201 bp, Homo sapiens; identical to SEQ ID NO: 2917

SEQ ID NO: 18903 - DNA, 201 bp, Homo sapiens; identical to SEQ ID NO: 2924

SEQ ID NO: 18904 - DNA, 201 bp, Homo sapiens
agccatcgtacttggttctctttaattatatattttcttacatattgtgttcatgtaggcaagtcctgtttctgctaaaagaaggtaagttctaccaaggyggtgtcatgccagctttatttcccgtggcacctggcacactgctaagcacttacatgcttaacaactagattgggaatggtgctgctctggggaagtggg

SEQ ID NO: 18905 - DNA, 201 bp, Homo sapiens; identical to SEQ ID NO: 2925

SEQ ID NO: 18906 - DNA, 201 bp, Homo sapiens
ccgatgagtagatagaaatgaggacgtaaaacaatactgatggtaggcaactctttcctgagtttggctgtgaatggtagttgagagaaagggtggtaagsgaagaggggaggggaaggagatttgagattcaagggagatatttgggagttattaattttttgtcgttatttttaggatgggaatgtgggtgcatatttt

SEQ ID NO: 18907 - DNA, 201 bp, Homo sapiens
agtgcagtggcgcgatcttggctcactgctgcaacctccgcctcccgtgttcaagcaattctcctgcctcagctttcctgagtagctgggactacaggcaygcaccaccacacccggctgatctttttagtagagacgggggtttcaccatattgaccaggctgggctcaaactcctgacctcgtgatctgcccgcctcgg

SEQ ID NO: 18908 - DNA, 201 bp, Homo sapiens
aaagggtggtaagggaagaggggaggggaaggagatttgagattcaagggagatatttgggagttattaattttttgtcgttatttttaggatgggaatgygggtgcatattttaatacctgtatataaagaaaggatttaataaagagggaaaggttgtagataggaaggaaataatcaactgcgtaaggtctttgagaa

SEQ ID NO: 18909 - DNA, 201 bp, Homo sapiens
tctttctttctttttctttctttctttctttctttctttctttctttctttctttctttctttctttctttcttttttggaaggtcattgaaagtcatgaraggatatagtaaataagtcaggtatttagagagatgagcaaagagcccatgtgggtaagagaatataagaacagagaaaagccacagatgaagaagagta

SEQ ID NO: 18910 - DNA, 201 bp, Homo sapiens
ttatttttattttacagttaaggaaattaaggtatagagaggttaagtaacttgccccaaattacacatatattctaattccagaacctacactctttacstatatactgttattactgcccagaagtgcaaagcagatgggccttttttcttttcctatttccttcactcagtgggcaacgaagtgaaaatggaatgttt

SEQ ID NO: 18911 - DNA, 201 bp, Homo sapiens
cccaactccggcgccgggctagagctggcctcctttcctggatcccgcggactgggtgcaaccagcatctgggcggaggaaaaaggggtgtcagccgtgcmgccccgagaacagaccgccgagcccacgtcggggaaagccgaaagatttctccagaagttcattccggagccccaatccaacccgtctagttcagcggcc

SEQ ID NO: 18912 - DNA, 201 bp, Homo sapiens
acagtgatcctcaaacttttttttttttttttttttttttgagacagagtctcactctgtcgcccaggctggagtgcagtggcgcgatcttggctcactgmtgcaacctccgcctcccgtgttcaagcaattctcctgcctcagctttcctgagtagctgggactacaggcacgcaccaccacacccggctgatcttttta

SEQ ID NO: 18913 - DNA, 201 bp, Homo sapiens
attcattcaagtaatagtttaatttcaaattatctgaagagtggcagtatagtgaggctgaaagggaacagtaaaacttaggagtcttgagatagagtccraattcttttattaaataactataattaaacttaattccatccaggaaaatgtttttgttatctgtgaaatgactaagttggacaggatttttctatttaa

SEQ ID NO: 18914 - DNA, 201 bp, Homo sapiens
gaagttcattccggagccccaatccaacccgtctagttcagcggcctgcagtgggacccgggagcctgcgttttgggaggaggtggtcaccccctgggccsggctgcaggagcgcgggctgcgatctgtgtcccagttcgagctgtgaacccggcgttccccacggcttagactcgccgcgcggtagtgaacttgggaccc

SEQ ID NO: 18915 - DNA, 201 bp, Homo sapiens
cactaatttggatatgaagagtaacaattcacttacttttcctattgcatatatatatttttaagatgttctcattccggaggggaagaacgtctagaaaytccttctgctaaaaaattaacagatataggaattcgaagaatcttttctccagagcatgacattttccggaaaagtgtaaggaagtttttccaagaagaa

SEQ ID NO: 18916 - DNA, 201 bp, Homo sapiens
taatttcaaattatctgaagagtggcagtatagtgaggctgaaagggaacagtaaaacttaggagtcttgagatagagtccgaattcttttattaaataastataattaaacttaattccatccaggaaaatgtttttgttatctgtgaaatgactaagttggacaggatttttctatttaaggtgctttccaattttaag

SEQ ID NO: 18917 - DNA, 201 bp, Homo sapiens
gtgctttggccaatgaaagtgttgcaatatacaaaaaagatatttgaaaaagaggcagaatacctacatcctcattccagtctgccaatgatgtgttgttrgtgaccattaaatagcaaccattaattaggaaatatattaacttctctctactttagttcctttaccagggaaacagtattaacatttatccctccccaa

SEQ ID NO: 18918 - DNA, 201 bp, Homo sapiens; identical to SEQ ID NO: 2940

SEQ ID NO: 18919 - DNA, 201 bp, Homo sapiens
ctaaaacacttataccaaggccaggcatagtggctcacacctgtaatcccagcacgttgggaggcctaggcaggcagattgcttgagcccaggactttgasaccaacctggacaacgtggcaaaacctcatctctacaaaaaatacaaaaattagccaggtgtggtggtgtgtgtctgtagtctcagctactcaagaggct

SEQ ID NO: 18920 - DNA, 201 bp, Homo sapiens
aagaggctgaggtgggaggattgcttgaacccaggattttgaggctgcagtgatccatgattgtgccactgcacaccagcctgggtgacagtcctgtctcaaaaaaaaaaaaaaaaaaaagcagaaaaaaggaggaacagaagtgataaaagagtcagaggcaaatagaagcatatggctaatgtaaataactacctttaa

SEQ ID NO: 18921 - DNA, 201 bp, Homo sapiens
aaattgtgtgaaaatcacttgcataattagagtaatgtttaagacctaatttttgtgttataggaaaggctgttaattgctgatgtggcaatttcagctastgaattcatgtttgaagaaaccaggaactatgttaaacaaagaaaagcttttggcaaaacagttgctcacctacaggtaagcttgtcactgtggtttagt

SEQ ID NO: 18922 - DNA, 201 bp, Homo sapiens
ctctggccttatctgtggttaagtgtatataattaagaaggaaacctgagaatgaagatggagaaaataagcagatttctttctttctttctttctttttytttctttctttctttctttctttctttctttctttctttctttctttctttctttcttttttggaaggtcattgaaagtcatgagaggatatagtaaata

SEQ ID NO: 18923 - DNA, 201 bp, Homo sapiens
gtaatatccaatcaaagcttataaagtaagtaggaaaaacagatatttcagttctgtgattccttcttagaatgattttagcttcttaactacaattcaaraacttttagctctttgtaaggaaatgtcttgcaaaacatttgatagtttgccagtttttaaataataactgtgaatcaaagggaaaagtataaaattcag

SEQ ID NO: 18924 - DNA, 201 bp, Homo sapiens
gcggagggtgacacacccgatgagtagatagaaatgaggacgtaaaacaatactgatggtaggcaactctttcctgagtttggctgtgaatggtagttgaragaaagggtggtaagggaagaggggaggggaaggagatttgagattcaagggagatatttgggagttattaattttttgtcgttatttttaggatgggaa

SEQ ID NO: 18925 - DNA, 201 bp, Homo sapiens; identical to SEQ ID NO: 2938

SEQ ID NO: 18926 - DNA, 201 bp, Homo sapiens
ttgcctcctaagggtaatgtgttcaactgtaatttgatgggtgtaactctagaaacacatactacgctcctggcaatatgaaggaagtgttaccacttgawatcactctgattttctcaactgtacccaaagtggaatgagtatcatttgcttctgaaatccaaccaccaccacttaaacatcaaaaatgtttactaaaac

SEQ ID NO: 18927 - DNA, 201 bp, Homo sapiens
tgcatattttaatacctgtatataaagaaaggatttaataaagagggaaaggttgtagataggaaggaaataatcaactgcgtaaggtctttgagaaaggstgagtttgtggatgctgacacatggaaagataggccttcccatcaacaggagagggattccttcatttgcacaggaagaaaggagcaaaggacatctatg

SEQ ID NO: 18928 - DNA, 201 bp, Homo sapiens
cctcctaagggtaatgtgttcaactgtaatttgatgggtgtaactctagaaacacatactacgctcctggcaatatgaaggaagtgttaccacttgatatcactctgattttctcaactgtacccaaagtggaatgagtatcatttgcttctgaaatccaaccaccaccacttaaacatcaaaaatgtttactaaaacact

SEQ ID NO: 18929 - DNA, 201 bp, Homo sapiens
ggaatattgcctggcaaagtaagcccacattaaaattagctgttatccttattttattccttacataatgccttgctccattttgtttcaatatgggagamctttttaccatctacttcctcttgctcttgatctagaccctctctttgtcgttttgggaactgtttgctaccggtattgtcatcaaattaactttttcca

SEQ ID NO: 18930 - DNA, 201 bp, Homo sapiens
tgctcagactgatatggaattctgccaattttaagctcagccttgagggtcttaaaggaagaaatctgtgaaatgaaaaataaaagtgagactccactttaaaaaaaaaatgctaaaaagttccattaagcatatgtataatgtgctaaaaatgtttcaagttggtatttaatttttttatcctaataggcaagcaaagtt

SEQ ID NO: 18931 - DNA, 201 bp, Homo sapiens
catctcaaaaataaacaaataaataaataaataacaatagagaaagtccttgaaagacaggtgagtgaaggaggcatggaggtgttgcagaagggtgaggsaggtatgaaatatcttcttcagaatgagaaactaaactactttctgctttttgtgtatcaatcagctttatgataagagtttagcttcccaggtacaaac

SEQ ID NO: 18932 - DNA, 201 bp, Homo sapiens
gctctgtcacccaggttggagtacagtggcatgatctgggttcactgcaacctccaccttccaggttcaaataattcttgtgcctcagtctccagagtagstggaattaacaggtgcgtgccatgacacctggctaatttttttgtatttttagtagaggtgtggttttgccatgttggccaggctggtctcaaacccctg

SEQ ID NO: 18933 - DNA, 201 bp, Homo sapiens
agaataaatgaaatcttgatttatctctaatttatacatgcaaacaaaggttcatgtgatttttgtttaaagtctctggccttatctgtggttaagtgtawataattaagaaggaaacctgagaatgaagatggagaaaataagcagatttctttctttctttctttctttttctttctttctttctttctttctttcttt

SEQ ID NO: 18934 - DNA, 201 bp, Homo sapiens
attcatcacctttcaaacagttcatgtgacctgattcttcctggatgctgggcaagaacccaggtgccgagagggcaggggctgccaccctgaccctccamtaagctggttggcacttggccatcctggatgcagagctgaaagagcattggttgaatacacttgaacaccactacagggttcgcacggagcctgctccca

SEQ ID NO: 18935 - DNA, 201 bp, Homo sapiens
  misc_feature (1)...(201): n = A,T,C or G, or insertion/deletion polymorphism (see Tables 1-2)
agggatacagtgaggtttgaaatgttatgtgagtcccactggggtctcgaatgttagttgggctttgttatactactgtataaaacctggctaatttatanaataaatcttaatcatatatttatttgtataagtgctttagaatataatagatcagcatggtttttcagtgcaattgtgtgaacattcttaatactcagc

SEQ ID NO: 18936 - DNA, 201 bp, Homo sapiens
cagattaagcactttattccccagatgactgcaggcaaatgtattggtgcaatagcaatgacagagcctggagctggaaggtaagttaatatttagttggytttggattcttggaagcagtgccttaacattttcttagtacttggttaatacatagactgagctatatgctaggaggaaggcaaagatgaacacgggata

SEQ ID NO: 18937 - DNA, 201 bp, Homo sapiens
tctttcatattgtaaagacagtgcataaattcccaaatgtggcatcatgtaggcaaaaaaatatcttgagacttgttggatccacccttattttccaaatraagtgtcatacatagtgtcattgaactaaactaggagtaggcttagaaaccatcttcagggattttcatggaatactcatctgttttcgatatatagatt

SEQ ID NO: 18938 - DNA, 201 bp, Homo sapiens
ctgagaaggtgacttttctttaggatacatacttaactcttccttggaacattataagacagtgatcctcaaacttttttttttttttttttttttttgaracagagtctcactctgtcgcccaggctggagtgcagtggcgcgatcttggctcactgctgcaacctccgcctcccgtgttcaagcaattctcctgcctca

SEQ ID NO: 18939 - DNA, 201 bp, Homo sapiens
ctttttttgttccatctttatattgtctaagagtaaacttcaatgtgtgggttgggagtgggaaactttgtgctgattaaagggtagatatttgacctaaktaaatatatgatgaatagaaatggagatagaaaaaattaagggaaacaataagcggggaagaaagttttgatgtgacccagcatgttcagaactagaggc

SEQ ID NO: 18940 - DNA, 201 bp, Homo sapiens
gaagatggagcaagagagacagaaggattgagagttttaaagaaatctagacatgagtaggaagagaagtcagttggaaaggctgtaggaaaggagaaagwagttagtaatgtcaaggccaccgtgatgttgagaatggagaagaggttttggcaggcctgatgatcctttgtgatttcagtggggtggaggggcagaagt

SEQ ID NO: 18941 - DNA, 201 bp, Homo sapiens
accacacaggaaaagtaccactgactctgtttcaaaaactctattagaaatagcaaaaaactgaaagcaagtaaaagtaaaggaatgggtaagcaaatacrgtgcatctgaacgaatgtgcagccattaacactagcaacacaaagtttttaacagtacaggaaataattatacattaagtgaaaaaacaggatatagaat

SEQ ID NO: 18942 - DNA, 201 bp, Homo sapiens
gaacatttttactatattaaaatttaaaaatatgagaaaggaaattatcaatgatagttgtattatgtacttatggagaattatattttcctttttcttthgaactttacattctctatacaatatctgcaatgattttctgttattttataagcatttaatatcctcctaccacccaaaaatgttggccctcattaggga

SEQ ID NO: 18943 - DNA, 201 bp, Homo sapiens
ggagggtgacacacccgatgagtagatagaaatgaggacgtaaaacaatactgatggtaggcaactctttcctgagtttggctgtgaatggtagttgagaraaagggtggtaagggaagaggggaggggaaggagatttgagattcaagggagatatttgggagttattaattttttgtcgttatttttaggatgggaatg

SEQ ID NO: 18944 - DNA, 201 bp, Homo sapiens
aattcctgcctgagtccctagatttaatagaattaatgagttgtctttgagacattgttacccatggcatgactctgaaaagaagggctatagaagtcctyttttacacaccttgcttccattgagaatccagtcacttccatcctttttagcatttgtttttattccctgtaagtcactgtaattgaaagaaaagataaa

SEQ ID NO: 18945 - DNA, 201 bp, Homo sapiens
ttattgtataatttctgatatgttaagtgggttgaagtttatatttctaccatgctcacttttttcttttatttcctttaaattcaagacagtgcaacatmaattagcagaattaaaaacacatatatgtgtaacccgagcatttgtggacaactgtctccagctgcatgaagcgaaacgtttggactccgccactgcttg

SEQ ID NO: 18946 - DNA, 201 bp, Homo sapiens
attaactactccaacttggcttccaatttgtgttttgtttttttggaaaaaataatattcacttcaatattcactgggttattggaagatttaaatgagaycattctctacattttttgtatggtctcttaggataccgcagaactattctttgaagatatacggttgccagctagtgccctacttggagaagagaataaa

SEQ ID NO: 18947 - DNA, 201 bp, Homo sapiens
gggatcaattgctgcttaggggaaaaataagacgaagggcaaagagtgttcattgaatacaatgatatggagattatttagtaagagccattaatggaggyggagggtgacacacccgatgagtagatagaaatgaggacgtaaaacaatactgatggtaggcaactctttcctgagtttggctgtgaatggtagttgaga

SEQ ID NO: 18948 - DNA, 201 bp, Homo sapiens; identical to SEQ ID NO: 2943

SEQ ID NO: 18949 - DNA, 201 bp, Homo sapiens
aaggtaaagacacctttgaaagaacactcccggcttctatctgggatgggcaaatcagcctgaagagtcacctgctggatccctccctgcaggccctgtcrtggggcaggtacagggactccaatccatgtgcctccagctccaacgctccccaagtcctggagcctcccctgtcaccccagtgcctgaccagtgaatggg

SEQ ID NO: 18950 - DNA, 201 bp, Homo sapiens; identical to SEQ ID NO: 2944

SEQ ID NO: 18951 - DNA, 201 bp, Homo sapiens
gaccaggaaaagggtccagtgtgatcctggccgttggggtttcagaccaatgcctgaattttagaaaagcaagattcttgttatgaagctcctgggacccwgagaattgtttaatagtcaatatgttgtgatgcagagaaagtgctcggaatgtttgggaactggggccgttagcaacacctggcataacagaaataaaag

SEQ ID NO: 18952 - DNA, 201 bp, Homo sapiens
acctggagaatcctgggtcacacttgagcacctcctggtaactgctcagtgtgctccagggacctgggtggcactgtctacatcttaagggacctgattcstggccaggcagcatatagagccatagacgttaatgccccaaagctttgtgactcacacacccacaacattctcaatagctttggggaatcactggggaaa

SEQ ID NO: 18953 - DNA, 201 bp, Homo sapiens; identical to SEQ ID NO: 2946

SEQ ID NO: 18954 - DNA, 201 bp, Homo sapiens
gtgggcctttctcattcccatttcctccccagctctggctctgagctcaccgctccgccgtccgtgggaccaagcccagcattttacaaacccagctcctktctccaagggtcctcagagcgcccctccgtcaccccctgcagggcgccgcagacgaggcgctgaccttgcgctcgctcccctcgctggggaaggacacac

SEQ ID NO: 18955 - DNA, 201 bp, Homo sapiens
gaagttgttccgtggattggaatcccccgaggatcaagggctaattgttgagctcaagcttcccgggcagcggaaggaaggcgctgccggggattcacctkggctggggcgcgcgcggagcactggcgccctccccgggaacccgagcgcgggcggcgcgggcaggtagcgcggagcgccctggcgcgcacggccggctga

SEQ ID NO: 18956 - DNA, 201 bp, Homo sapiens
gcctaaatgtggaaaaggcactgtccacatcctggggagccaggcaaattggtcagcgcgaccaccacggaccaagggcttcgtctttaaaattagggaasccgggttagtggcctgtaaatctgtgggacctggagggggtgtataaaactgtccagagcctgggagaaagcacatctggggccccaggccacatagtgt

SEQ ID NO: 18957 - DNA, 201 bp, Homo sapiens
ccttcaaatttctgtctgcatcaatcacccccatgtcccattccaagaacatctggcccatctctccccacccatcactgccccccttcccaccagccttytgcagcctccccgtgtccccagctctctggcctctccggctgtgcctatagaagggggagcctccagcagagaacccctggctgtgttgatgttttcctc

SEQ ID NO: 18958 - DNA, 201 bp, Homo sapiens
cacatagtgtaagtctggaaaagcccgccgggactgatgtgttttgacgtccccggaaattaacgtccaagaaaattattgtgacccgtcgaaatggtgartatatttagaagacttgggaagcaatgcttaaatttagaggatcccagaaaaagtaaaatgtccgagttcggggaaagcagggaagttgttccgtggatt

SEQ ID NO: 18959 - DNA, 201 bp, Homo sapiens; identical to SEQ ID NO: 2945

SEQ ID NO: 18960 - DNA, 201 bp, Homo sapiens
ctagattttgggggagcctggagtgtgatcagtacatttggggaaagcaaaataaaaaataaaaaaataaaaaatcagtattatttttctatgctaatttktaaatgatttccattagcttatttttggtaaataagaaaaagactatatattttcctggatgtcgtctgcatttgggggagccccagtgaaacacatttc

SEQ ID NO: 18961 - DNA, 201 bp, Homo sapiens
cccctctagtcaagaccagcatcggggttcttcctcaagactggctcctcccccactacttccagcccccggaggtaggaagggtcccgccagcagtccargggtgttgggagggggccagggtctcctcccacccagagcttggccggcaggaactttagccccaagcagcgtccgccccccagccctgaaccagcacct

SEQ ID NO: 18962 - DNA, 201 bp, Homo sapiens
agtgattttgaattatgaataatgtctctgtataagattaacctgagaaccagacagggcttagggaatcaaagggaagagcctgggttaccagaacctargaacttggtggaggagtcccatgcatttaatacatgtacttctaagaaggggcagcacctggctgatactaatatctttaagggggcctgatgaggtcgg

SEQ ID NO: 18963 - DNA, 201 bp, Homo sapiens
caagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctc

SEQ ID NO: 18964 - DNA, 201 bp, Homo sapiens
atcccttcatagatgttatctgccaacctattccattgtgaagttgctttttctctctatgccatacatattttgtgagaaagatactttaagactatgtwaaaatatcctgttcatcatcacactttatatttgttcacttatttgttaatatctgtatggattcatcgtttcttattttattcaacagattataatccg

SEQ ID NO: 18965 - DNA, 201 bp, Homo sapiens
ttaaaactgcaagctactctcccatcccacctcaccccacactcaatccctaatcaacttccatgctttttccccccatagcacttattcatcattctctrtaacttattttctttattttctgtatccaccctctcactctctttttttataagaattaagctccatgaggacaggatttttttttccgttttgtttact

SEQ ID NO: 18966 - DNA, 201 bp, Homo sapiens
tacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaaa

SEQ ID NO: 18967 - DNA, 201 bp, Homo sapiens
aattacctgttgggtactgtgctcattacctgagtgatgaaataatctgtatgccaaacacctgtgacatgcaatttatccatgtaacaaacctgcctgtstaccccctgaacctaaaataaaagttgggggaaagaaaaactgaatccaagggaaaacgagaaggtaaaaatgtttaatgatcatttatgccgaagtatt

SEQ ID NO: 18968 - DNA, 201 bp, Homo sapiens
atcacagatttatgtttaccgtgattgttagctaagatttaatctcaaatggttttaagttttttggtatttgtagtcttttttttttttttttttttttygtcctttttagggatctgcctgcctcagcctcctgagtagctaagactcgaggcacataccaccatacctggctaatttttaaatttttttttgtagaga

SEQ ID NO: 18969 - DNA, 201 bp, Homo sapiens
ttagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagcttta

SEQ ID NO: 18970 - DNA, 201 bp, Homo sapiens
aagtcctattaaattaggataaattaatataaattcctaatttaaaatgatcaaaaaaatattttttatcatataccttttgtgcctttaaaccaaaagtrtggtgaaagaattgtaatccaccaaaaaaaaaaaaatcatatcagtttttttgtggctttgtaatgctgacatggcttctttttctaccttttttagttc

SEQ ID NO: 18971 - DNA, 201 bp, Homo sapiens
gcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagaggtaagtgttagtaatacggctgagtcgagatgggc

SEQ ID NO: 18972 - DNA, 201 bp, Homo sapiens
agcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttct

SEQ ID NO: 18973 - DNA, 201 bp, Homo sapiens
caaagggaacagcatgtttaaaggcacagttatgaaatggcatgacatgttcataaaaaagtgaaaagttcagtgtatcttgtatatgtggggagtgtgcytgaggctagatatatggttagaagtataggtgctgctgtgtacaatgaggcatccctagcttttaggtggagggtaacataatcagctttgcatattagg

SEQ ID NO: 18974 - DNA, 201 bp, Homo sapiens
acatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaacc

SEQ ID NO: 18975 - DNA, 201 bp, Homo sapiens
gagactggaagtgggtcctctagggatgaggaggcattctgctggatgacttctaaaaatgttttctatggagtcatctgcctcattaacaagtttttgtyttagaagtctctttttgattttgtaaactgacatgatttctttttctgttatgactgtatgctgctttagtccttcactaggcccatcacacatttttac

SEQ ID NO: 18976 - DNA, 201 bp, Homo sapiens
ggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtat

SEQ ID NO: 18977 - DNA, 201 bp, Homo sapiens
ctaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaaatcacc

SEQ ID NO: 18978 - DNA, 201 bp, Homo sapiens
atgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtg

SEQ ID NO: 18979 - DNA, 201 bp, Homo sapiens
gacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatct

SEQ ID NO: 18980 - DNA, 201 bp, Homo sapiens
ttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgaca

SEQ ID NO: 18981 - DNA, 201 bp, Homo sapiens
tagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctca

SEQ ID NO: 18982 - DNA, 201 bp, Homo sapiens
agaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagag

SEQ ID NO: 18983 - DNA, 201 bp, Homo sapiens
tttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcc

SEQ ID NO: 18984 - DNA, 201 bp, Homo sapiens
acagtgatttgaaagactgaaatttgtccctgaatcaaatgttgggaattgagatgtttcatcatttgtgttattcaaaagaattttttgattggccccatttttttttttttttttttgagatggagtctcagtctgttccccaggctggagtgcagtggtgcgatcttggctcactgcaacctctgcctcccaggttca

SEQ ID NO: 18985 - DNA, 201 bp, Homo sapiens
atttgtgttattcaaaagaattttttgattggccccatttttttttttttttttttgagatggagtctcagtctgttccccaggctggagtgcagtggtgygatcttggctcactgcaacctctgcctcccaggttcaagcgattctcctgcctcagcctcccgagtagctgggattacaggcacctgccactatgcccag

SEQ ID NO: 18986 - DNA, 201 bp, Homo sapiens
gagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgat

SEQ ID NO: 18987 - DNA, 201 bp, Homo sapiens
atcaagtgggcttcatccctgggatgcaaggctggttcaacatacacaaatcaataaatgtaatccagcatataaacagaaccaaagacaaaaaccacatrattatctcaatagatgcagaaaaggcctttgacaaaattcaacagcccttcatgctaaaaactctcaataaactaggtattgatggaacatatctcaaaa

SEQ ID NO: 18988 - DNA, 201 bp, Homo sapiens
tcaagtgggcttcatccctgggatgcaaggctggttcaacatacacaaatcaataaatgtaatccagcatataaacagaaccaaagacaaaaaccacatarttatctcaatagatgcagaaaaggcctttgacaaaattcaacagcccttcatgctaaaaactctcaataaactaggtattgatggaacatatctcaaaat

SEQ ID NO: 18989 - DNA, 201 bp, Homo sapiens
catgctaaaaactctcaataaactaggtattgatggaacatatctcaaaataaaagagctatttatgacaaacccacagccaatatcatactgaatgggcraaaactggaagcattccctttgaaaactggcacaagacagggatgccctctctcaccactcctattcaacatagtgttggaagttctggccagggcaatc

SEQ ID NO: 18990 - DNA, 201 bp, Homo sapiens
cctcttcaaggacaactacaaaccactgctcaatgaaataaaagaggacacaaacaaatggaagaacattccatgctcatggataggaagaatcaatatcstgaaaatggccatactgcccaaggtaatttatagattcaatgccatctccatcaagctaccaatgactttcttcacagaattggaaaaaactactttgaa

SEQ ID NO: 18991 - DNA, 201 bp, Homo sapiens
cttcaaggacaactacaaaccactgctcaatgaaataaaagaggacacaaacaaatggaagaacattccatgctcatggataggaagaatcaatatcctgraaatggccatactgcccaaggtaatttatagattcaatgccatctccatcaagctaccaatgactttcttcacagaattggaaaaaactactttgaagtt

SEQ ID NO: 18992 - DNA, 201 bp, Homo sapiens
agtcctgaaaactccaaaagggaaatatttactcagaggtctattcaaatttgcttagtctctgacgttttcctgtgtcgtacaaatccctcgtgcggcaraagtagtttgtctttactaggccaccgtctcgtcagcgttacggagtattttgtccgcctgccgccgccgtcccagatattaatcacggagttccaggga

SEQ ID NO: 18993 - DNA, 201 bp, Homo sapiens
ttctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcac

SEQ ID NO: 18994 - DNA, 201 bp, Homo sapiens
gcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagt

SEQ ID NO: 18995 - DNA, 201 bp, Homo sapiens
ttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatac

SEQ ID NO: 18996 - DNA, 201 bp, Homo sapiens
ttccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttc

SEQ ID NO: 18997 - DNA, 201 bp, Homo sapiens
ttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaa

SEQ ID NO: 18998 - DNA, 201 bp, Homo sapiens
agcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatga

SEQ ID NO: 18999 - DNA, 201 bp, Homo sapiens
aatggatagataataaaattgagacccacagactatttggatcctaaattttgtttcatcatgactcccttgttgaaaatactttattgactctgtgtaaygtaaataagataatttttgtgaagctcattgaatgcgtctgagctccttaactcaaaaaaggctaaaagttactgaaatagctatggttaagggtatatt

SEQ ID NO: 19000 - DNA, 201 bp, Homo sapiens
tgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagt

SEQ ID NO: 19001 - DNA, 201 bp, Homo sapiens
tggctctggaatactttataaagtccctacttctgcaaaaattaatctctttgtgattttcccctttcttgcaaatggttggaaaaacttttataataatraacttaggaactggtgttacaatatggtatccaatgtgaatcatttgcctgttattagtacttgttacttgaagccacgtttttgttccttttaagatgg

SEQ ID NO: 19002 - DNA, 201 bp, Homo sapiens
ctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaa

SEQ ID NO: 19003 - DNA, 201 bp, Homo sapiens
aattcaaccatctgtgtactcatactaatcaatgtaatataggttggcgctttttatgcacttaattttgccacctctctcacttccccaaagaaattagwctaatgtataacaataggcttcataacttaatttagaaaacataacaaaaataatttcgctcagtaagtttctgttgtagtagatattgttggtattaaa

SEQ ID NO: 19004 - DNA, 201 bp, Homo sapiens
cttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccct

SEQ ID NO: 19005 - DNA, 201 bp, Homo sapiens
ttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgaccccta

SEQ ID NO: 19006 - DNA, 201 bp, Homo sapiens
aagggaaatatttactcagaggtctattcaaatttgcttagtctctgacgttttcctgtgtcgtacaaatccctcgtgcggcaaaagtagtttgtctttamtaggccaccgtctcgtcagcgttacggagtattttgtccgcctgccgccgccgtcccagatattaatcacggagttccagggagaaggaacttgtgaaat

SEQ ID NO: 19007 - DNA, 201 bp, Homo sapiens
taacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaa

SEQ ID NO: 19008 - DNA, 201 bp, Homo sapiens
acatacacacacacacacacacacacacacacacccctacctgttttacagatactatccagttttatcatagaattgtgtctcaccctatccttaacacmcacacacacacacacacacacacacacacacacacacccctacctgttttacagatactatccaattttattatcatagaattgtgaatgacccctaaac

SEQ ID NO: 19009 - DNA, 201 bp, Homo sapiens
cacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataat

SEQ ID NO: 19010 - DNA, 201 bp, Homo sapiens
gtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcgg

SEQ ID NO: 19011 - DNA, 201 bp, Homo sapiens
cacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataatac

SEQ ID NO: 19012 - DNA, 201 bp, Homo sapiens
ataactgtgggacacttcctggtagcataattttatgtcgtcttctgatacccaggctgcattttccagacttatctgatcacttgacttaatgttctctracagagcattcagttctttgtagtcagttcaccgactcacttctatcgggtatcctgccctgtccctccctgaatgtgcccatttccattgttttccagg

SEQ ID NO: 19013 - DNA, 201 bp, Homo sapiens
cttttaaggtgaagattcattttttaatagctttattgaggtataattgacatataataaactgcacatatttaacaccacattttatgtgtgatatgtakgtgtgtgtgtgtgtgtgtgtgtatatatgtatatacttatataggtgaaatcatcaccatagtcaaaataatcagcatccccatcagtcccaaaagtttt

SEQ ID NO: 19014 - DNA, 201 bp, Homo sapiens
tgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctg

SEQ ID NO: 19015 - DNA, 201 bp, Homo sapiens
atttttgtgcttttttttttttagtagagacggggtttcaccatgttggccagtctggtctcgagctcctgacctcaactgatccgcctgccttggcctcmtaaagtgctgggattacaggcttgagccactgcactcggcctgaagcattttatgatgctcactaccaagtgttcataagcggtaaataaagcccttggg

SEQ ID NO: 19016 - DNA, 201 bp, Homo sapiens
acttcaaataaaaactataatttttcatcatcccaacgaaatattgacctcttagaagccctgaatttggcctgttctaggactaagccaattgttatatrtaacagattgttctttgttaattttaggatcacctgctgttaccagctaccacccataacaagaccacaagaccaaaaatgtcaattgtgttaccagcaa

SEQ ID NO: 19017 - DNA, 201 bp, Homo sapiens
cagatattaatcacggagttccagggagaaggaacttgtgaaatgggggagccggctggggttgccggcaccatggagtcaccttttagcccgggactctytcacaggctggatgaagattggggtgagtgggatctgagaatgtaccagggtggctcgggttcgcgtctaaaggtttcttcctccctacttccgcccact

SEQ ID NO: 19018 - DNA, 201 bp, Homo sapiens
gccggctggggttgccggcaccatggagtcaccttttagcccgggactctttcacaggctggatgaagattggggtgagtgggatctgagaatgtaccagkgtggctcgggttcgcgtctaaaggtttcttcctccctacttccgcccactcgtggtgacaggtgtggaccaaccctgcctggggagtgaggcccctcgtc

SEQ ID NO: 19019 - DNA, 201 bp, Homo sapiens
tcttttaagaacgatttttaatatatagagtataaatcagtgagaaaaatgcaaattaattcaaccatcaatggacaatatatacgaatagataattcacraagaagagtggtaaattttaaaaatgaaagtatcaatggctgtgtattcctgaagggatattccctctgaaagattactattttataactatgtgaaaga

SEQ ID NO: 19020 - DNA, 201 bp, Homo sapiens
agatcttgtggctggttacaggtagttcgagaatgatattcaagaatttaaagtgttatggttagacttttctgtggctcttacctcccttgagtatgagwtctaaaggaaaatgtcttatggcttcttataacttcccagtgtgtatacactgcggttgtgtgtgtgtgctgacacatgttaaactttggttattgtatg

SEQ ID NO: 19021 - DNA, 201 bp, Homo sapiens
tttcatctttccaacttccagaccttttttttctgctgataactcataccttttaattaaactttaatttaatttaatttaatttagtttcttccaactckgctctccaccacttccttgcccctagcacacacacaattaatcagcacttacaaaaacaaaaatttacctctttacaaaaggtacagggatagagtagag

SEQ ID NO: 19022 - DNA, 201 bp, Homo sapiens
cagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcc

SEQ ID NO: 19023 - DNA, 201 bp, Homo sapiens
agattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggccc

SEQ ID NO: 19024 - DNA, 201 bp, Homo sapiens
gattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggccca

SEQ ID NO: 19025 - DNA, 201 bp, Homo sapiens
attaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccac

SEQ ID NO: 19026 - DNA, 201 bp, Homo sapiens
cccaggctaggtaggcaccttcctctttattcttgttgcaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcata

SEQ ID NO: 19027 - DNA, 201 bp, Homo sapiens
gtaaaaaagctttaaatagtacctgactattttggggttagctgctgttttactgcaataatcatcattgccattgtccttaagacatcattgccaacttytaaggtaatttcttccttttggaccctgactcctagcacttctcacagtgctcaaagactttactctgcatttataacattcgtcttttatacagtttct

SEQ ID NO: 19028 - DNA, 201 bp, Homo sapiens
tcacaggaaaacagcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgta

SEQ ID NO: 19029 - DNA, 201 bp, Homo sapiens
gccggcaccatggagtcaccttttagcccgggactctttcacaggctggatgaagattggggtgagtgggatctgagaatgtaccagggtggctcgggttygcgtctaaaggtttcttcctccctacttccgcccactcgtggtgacaggtgtggaccaaccctgcctggggagtgaggcccctcgtcactcctgttcgtg

SEQ ID NO: 19030 - DNA, 201 bp, Homo sapiens
gcgtctaaaggtttcttcctccctacttccgcccactcgtggtgacaggtgtggaccaaccctgcctggggagtgaggcccctcgtcactcctgttcgtgyccctggaagagtctgggagtatcgttcggcttctgtcctggccacagggagagtagaatattgtctaactggagttaactgtcgtttttcactattccca

SEQ ID NO: 19031 - DNA, 201 bp, Homo sapiens
aaccctaattattgcaagaaagtttcaggacaacaggttcaggctagtaatttaagttacatacttaatggtaaatagcttctaccattaagtatgaaagytagtagccattttgtaatcagtaaatgtaggacagtagaaattgcattgtattgcaattctaggcccacctttggccctagggatgggtgactttggaaa

SEQ ID NO: 19032 - DNA, 201 bp, Homo sapiens
tgattttaagatgtgtatgttttattcttttaatattcttttgctgatttgaaacctacaggaaaacaattttgataatcttgattttgatttggatttgrtgccttgggagtcagacatttgggacatcaacaaccaaatctgtacaggtaattatgtgtttcactggtaaaagttttaaaaagatcaattttattttgt

SEQ ID NO: 19033 - DNA, 201 bp, Homo sapiens
tggggttattgggctattctggtaggttaaaagattcctggtgttatgcattctacttctggtatggcaattatgtaaacaaatttcttgccaaaaatggrtatgaggagtttcatagttatgtttcagtagtgtaatgaatgaacagttcatatcagaaatagaaatagtgattttgaattatgaataatgtctctgtat

SEQ ID NO: 19034 - DNA, 201 bp, Homo sapiens
tgaatgaacagttcatatcagaaatagaaatagtgattttgaattatgaataatgtctctgtataagattaacctgagaaccagacagggcttagggaatsaaagggaagagcctgggttaccagaacctaggaacttggtggaggagtcccatgcatttaatacatgtacttctaagaaggggcagcacctggctgatac

SEQ ID NO: 19035 - DNA, 201 bp, Homo sapiens
atataccccctccccacatatatatataatttgtaacacaagtggaaacatactagatatattgttttctgcatctttcattttcactcgttatattttgrtgaccttagcttccatatctgattgaattttaaaagtagattttaccttctttcttgttcattttattataagtttttattgtccagtgggtaaaacctt

SEQ ID NO: 19036 - DNA, 201 bp, Homo sapiens
atatctttaacaggatggcatagacttactctgcattttgagttatttttcctttggtatagatggatcatgctgatagtcacttattacttaatatatakatacagtttctaatatacctttcctttgaagttaccctgaagtgtttttctgtttatatgtgggtctcctccttttctatgcaatttgctgcttaaggat

SEQ ID NO: 19037 - DNA, 201 bp, Homo sapiens
aactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgaca

SEQ ID NO: 19038 - DNA, 201 bp, Homo sapiens
gtcttctagttctcagatgtctcccctttccttatatggtgaaaactctaatagtctctcttcagcggagccactgaaggaagataagcctgtcactggtyctaggaacaagactggtattactctatctcctaacttctgttatttctatttcagattgagcttaggttccatttcttaaaagaaaatgctggattaaat

SEQ ID NO: 19039 - DNA, 201 bp, Homo sapiens
caaccatattagtagttaaattcagtgggctaaacacatcaattaaaaggaagaaattttcaaactagatttttttaaaaaggaaagatccaactatataktgtttataagaaataacactttaaatatgaagacactgacagatggaaaataaaggtgaaaaaggatgtatgccatgcaaacatgaagcattaaaaagct

SEQ ID NO: 19040 - DNA, 201 bp, Homo sapiens
ggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatatgtgcaggttaccatgctaaggattt

SEQ ID NO: 19041 - DNA, 201 bp, Homo sapiens
ttataaataaggtacttttatacttagaaaaattgtttttgatatgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttattt

SEQ ID NO: 19042 - DNA, 201 bp, Homo sapiens
aagtatatcttaaatcaaaacttgaatttgtacttattaggatttcaagctcatttttcctctggtgaccttgccagcattatcagatttgtattaagtgwcaaaagtttcctcttgtcaaagtgtaaaccttggctcattcttgggccatctgttgtacactaatagttttgatttattcttctggctgacatgcgtatt

SEQ ID NO: 19043 - DNA, 201 bp, Homo sapiens
ttgagttatttttcctttggtatagatggatcatgctgatagtcacttattacttaatatatatatacagtttctaatatacctttcctttgaagttaccytgaagtgtttttctgtttatatgtgggtctcctccttttctatgcaatttgctgcttaaggattatactcattaatttttgtttttattatgctacagga

SEQ ID NO: 19044 - DNA, 201 bp, Homo sapiens
caactgaagaaagaaaatggaacactgaagcggcagctggatgaagttgtgtcagaggtaagtgttagtaatacggctgagtcgagatgggctaaagtatyctctggattaataaatagagaaacttttacattttaaattaaattatgtaaaataatagtgctaggaaaaggagggtataataagtcctaaaacatttgc

SEQ ID NO: 19045 - DNA, 201 bp, Homo sapiens
gtcctaaaacatttgcagtaaggataaagcatttgaaggggaccctttgaattgtactccccaatctacatagaaaagttgtctccttttcctaggtttckcctcattcattgccttagcaccctcttttctggctaagtgaatcacactgaggcttctaaagtgccctgccatattttcccttttaaaaaagaaaacaat

SEQ ID NO: 19046 - DNA, 201 bp, Homo sapiens
atgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtg

SEQ ID NO: 19047 - DNA, 201 bp, Homo sapiens
aatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatgtttgtcaaaaatgtgtctacacaaagta

SEQ ID NO: 19048 - DNA, 201 bp, Homo sapiens
atacaatgtatctgagtaccaggtgttactgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagc

SEQ ID NO: 19049 - DNA, 201 bp, Homo sapiens
cacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagag

SEQ ID NO: 19050 - DNA, 201 bp, Homo sapiens
aaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgg

SEQ ID NO: 19051 - DNA, 201 bp, Homo sapiens
ggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgac

SEQ ID NO: 19052 - DNA, 201 bp, Homo sapiens
gagtaacatcttgaacccagatctcctgtctccaaattttgtgctcattccactatttcacattaaaacctgaagatctccctgctcttttcatcttaacrtaatttcagctttttgtgtgtggctctccaagccacagagcagcagcagcttttgaggataagaagcagtttcttttaaggataagaagcagtatggttc

SEQ ID NO: 19053 - DNA, 201 bp, Homo sapiens
aaattttgtgctcattccactatttcacattaaaacctgaagatctccctgctcttttcatcttaacgtaatttcagctttttgtgtgtggctctccaagycacagagcagcagcagcttttgaggataagaagcagtttcttttaaggataagaagcagtatggttcttacctggtaagatggcttgaattcaaaattga

SEQ ID NO: 19054 - DNA, 201 bp, Homo sapiens
agtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcag

SEQ ID NO: 19055 - DNA, 201 bp, Homo sapiens
atacatgtaattatcaagtttttaaaacatatagaacactactattgtttaaacagtttataaataaggtacttttatacttagaaaaattgtttttgatrtgtgcaggttaccatgctaaggatttgaacaccttcagtaccctatttgtacttgcgtctatgcctagcatttttgttacgtgcatggatctgcaaagga

SEQ ID NO: 19056 - DNA, 201 bp, Homo sapiens
cttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaactgggtaa

SEQ ID NO: 19057 - DNA, 201 bp, Homo sapiens
gatagatagaaacgtttatgctgagcccagggacaaatttgtgttagggagatgaggaagaaccagcaaggtaggtcaaccactgaggtgggaggaaaacygggtaagtgtgatattctggaagtcaagtgaagaaaatgcttcagttaaaatgaaaggatcaactatgttaatgctgttgataggtcaagtaagatgagg

SEQ ID NO: 19058 - DNA, 201 bp, Homo sapiens
ttttgtttttattatgctacaggaggagttggatttgtcttctagttctcagatgtctcccctttccttatatggtgaaaactctaatagtctctcttcascggagccactgaaggaagataagcctgtcactggtcctaggaacaagactggtattactctatctcctaacttctgttatttctatttcagattgagctt

SEQ ID NO: 19059 - DNA, 201 bp, Homo sapiens; identical to SEQ ID NO: 2962

SEQ ID NO: 19060 - DNA, 201 bp, Homo sapiens; identical to SEQ ID NO: 2964

SEQ ID NO: 19061 - DNA, 201 bp, Homo sapiens
tggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcgga

SEQ ID NO: 19062 - DNA, 201 bp, Homo sapiens
gaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaatttt

SEQ ID NO: 19063 - DNA, 201 bp, Homo sapiens; identical to SEQ ID NO: 2966

SEQ ID NO: 19064 - DNA, 201 bp, Homo sapiens
taatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctc

SEQ ID NO: 19065 - DNA, 201 bp, Homo sapiens
aacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaa

SEQ ID NO: 19066 - DNA, 201 bp, Homo sapiens
aaaattcttgccctaaatgctttttttttggccttatcattagatggaacttgtcatgtttttctttcctagtcattaaatgaatagagcatttactgtgraaggggtgcttggtattctttattcttaaaggaattccaatgcaagaaaaagaattttgttttaattttactgtctttgttcatttggagatgtgtagtt

SEQ ID NO: 19067 - DNA, 201 bp, Homo sapiens
ttttttggccttatcattagatggaacttgtcatgtttttctttcctagtcattaaatgaatagagcatttactgtggaaggggtgcttggtattctttawtcttaaaggaattccaatgcaagaaaaagaattttgttttaattttactgtctttgttcatttggagatgtgtagtttaaagtcttatttcattctgtgc

SEQ ID NO: 19068 - DNA, 201 bp, Homo sapiens
gtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccggttacctctttcagttgctaagagtatcccaaactctta

SEQ ID NO: 19069 - DNA, 201 bp, Homo sapiens
ggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttc

SEQ ID NO: 19070 - DNA, 201 bp, Homo sapiens
aaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaa

SEQ ID NO: 19071 - DNA, 201 bp, Homo sapiens; identical to SEQ ID NO: 2957

SEQ ID NO: 19072 - DNA, 201 bp, Homo sapiens; identical to SEQ ID NO: 2958

SEQ ID NO: 19073 - DNA, 201 bp, Homo sapiens; identical to SEQ ID NO: 2959

SEQ ID NO: 19074 - DNA, 201 bp, Homo sapiens; identical to SEQ ID NO: 2961

SEQ ID NO: 19075 - DNA, 201 bp, Homo sapiens
gctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtc

SEQ ID NO: 19076 - DNA, 201 bp, Homo sapiens
cattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccc

SEQ ID NO: 19077 - DNA, 201 bp, Homo sapiens
aaaggcagtacagaactaggttgttgccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgt

SEQ ID NO: 19078 - DNA, 201 bp, Homo sapiens
aattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaagtactcagaattctcccatgttcac

SEQ ID NO: 19079 - DNA, 201 bp, Homo sapiens
acttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattggtagattagatctgtctaataatttttaactct

SEQ ID NO: 19080 - DNA, 201 bp, Homo sapiens
tatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcatggtacataagtgcc

SEQ ID NO: 19081 - DNA, 201 bp, Homo sapiens
aaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatcca

SEQ ID NO: 19082 - DNA, 201 bp, Homo sapiens
tgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatatt

SEQ ID NO: 19083 - DNA, 201 bp, Homo sapiens
accatctagtacattttagagccttgattcagaaatcagaattttagcataagtgaatgggttcttataaaatatcctgatccttgggctttacaaaataktgttataaaaattactgccaaagtgcaactaatattttggttgagagagattcttagaattcagacatagccttagaatgggaagtattttgggaaaaca

SEQ ID NO: 19084 - DNA, 201 bp, Homo sapiens
ggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtt

SEQ ID NO: 19085 - DNA, 201 bp, Homo sapiens
tccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttt

SEQ ID NO: 19086 - DNA, 201 bp, Homo sapiens
taagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattg

SEQ ID NO: 19087 - DNA, 201 bp, Homo sapiens
agaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggcta

SEQ ID NO: 19088 - DNA, 201 bp, Homo sapiens
atggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacag

SEQ ID NO: 19089 - DNA, 201 bp, Homo sapiens
ttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgg

SEQ ID NO: 19090 - DNA, 201 bp, Homo sapiens
tacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaa

SEQ ID NO: 19091 - DNA, 201 bp, Homo sapiens
ctggctaacacggtgaaaccccgtctctactaaaaatacaaaaaaattagccgggcgtggtggtgggcacctgtagtcccagctactcaggaggctgaggygggagaatggcgtgaacctgggagacggagcttgcagtgagccgagatcgcgccactgcactccagcctgggtgacagagtgagactccatctcaaaaaa

SEQ ID NO: 19092 - DNA, 201 bp, Homo sapiens
ggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaa

SEQ ID NO: 19093 - DNA, 201 bp, Homo sapiens
acgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttc

SEQ ID NO: 19094 - DNA, 201 bp, Homo sapiens
actgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttaggccataaattcacagtttgcttatccacttac

SEQ ID NO: 19095 - DNA, 201 bp, Homo sapiens
cctcatttaactttaattacctcctaaagactgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtg

SEQ ID NO: 19096 - DNA, 201 bp, Homo sapiens
gctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgat

SEQ ID NO: 19097 - DNA, 201 bp, Homo sapiens
gatacagatttaagatgtatgtatatatgcatatatatttaaagatactttctgagggagtttctaaggggaaaattggaagattaataaacgagccttaraaaacataagaagaaattatttaacatttgggttttagaaggccttatttaatcatttgattttaacttatttagtttgagcagtgtgttttcaaacctc

SEQ ID NO: 19098 - DNA, 201 bp, Homo sapiens; identical to SEQ ID NO: 2955

SEQ ID NO: 19099 - DNA, 201 bp, Homo sapiens
acttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatagaaataactgctcaccttgaactgaaatt

SEQ ID NO: 19100 - DNA, 201 bp, Homo sapiens
gagacggggtttcactacattggccaggctagtctcaaactcctgagctcaagtggtccacccacctcggcctcccaaagtgctgggattacaggcatgarccaccacacctggctaaggctgcttaattttttgatgtgaagatccaaataagagaaaaaagtgaaggagattgattttttaaaaaatggtttttttatg

SEQ ID NO: 19101 - DNA, 201 bp, Homo sapiens
aaaggtcattttgatacactgtatgtgcaaaagcagtttaccaaacagaattacatacagtgtaatcctttttttcttatataggaaaatacccacttccycccacttaaaaaaataccaaacaccacaatgtgtgtatgtttagcctacaaatcatattttttttgcctaggaagtattgaataatttaaatattttata

SEQ ID NO: 19102 - DNA, 201 bp, Homo sapiens
aggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccgcccttctttatctacctcttttcatctttccaacttccagaccttttttttctgct

SEQ ID NO: 19103 - DNA, 201 bp, Homo sapiens
gttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtatt

SEQ ID NO: 19104 - DNA, 201 bp, Homo sapiens
tgtgcccatttccattgttttccaggtttcccttttcaaactgttaacagtcttctcttctttgaagactttaatttaattccttaggtgttcagtaagtmggatagattttgttggcaatagagtgaaacactactgtctgatagtgtttcgttctgtgacagttgctgttttggatgttcaagtacttcactgatttac

SEQ ID NO: 19105 - DNA, 201 bp, Homo sapiens
ctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatca

SEQ ID NO: 19106 - DNA, 201 bp, Homo sapiens
ggcagtcgtgtccattgtgaactccaataagaaagattaaaaagaaggaagaaaaagtccgctgtagaaatgaaaaaacaaatttatccattgtgacatcrtttagaaatagcagtcagaatttaaccaagaaagtctggctctatgttcttgatcatttccctctattgcctgtttaagatatccaaatatcatatcttt

SEQ ID NO: 19107 - DNA, 201 bp, Homo sapiens
ttgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacac

SEQ ID NO: 19108 - DNA, 201 bp, Homo sapiens
ttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaatt

SEQ ID NO: 19109 - DNA, 201 bp, Homo sapiens
attttaccttctttcttgttcattttattataagtttttattgtccagtgggtaaaacctttcctccatgttttccagttaaagatattaaggcagaaccycagccactttctccagcctcctcaagttattcagtctcgtctcctcggtcagtggactcttattcttcaactcagcatgttcctgtgagtagccagtctt

SEQ ID NO: 19110 - DNA, 201 bp, Homo sapiens
attaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtatgtgtgtgtgtgtgtgtgtgtgtatatatgtatatacttatataggtgaaat

SEQ ID NO: 19111 - DNA, 201 bp, Homo sapiens
attgtccagtgggtaaaacctttcctccatgttttccagttaaagatattaaggcagaacctcagccactttctccagcctcctcaagttattcagtctcrtctcctcggtcagtggactcttattcttcaactcagcatgttcctgtgagtagccagtcttttacaatgattttggttataatatgctatctggaaaata

SEQ ID NO: 19112 - DNA, 201 bp, Homo sapiens
agcctcctcaagttattcagtctcgtctcctcggtcagtggactcttattcttcaactcagcatgttcctgtgagtagccagtcttttacaatgattttgsttataatatgctatctggaaaatatgtatatggaggaggcagttaacatttattgaatactactatgagttatattgtctcatttattgagggaactgag

SEQ ID NO: 19113 - DNA, 201 bp, Homo sapiens
tacaatgattttggttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatt

SEQ ID NO: 19114 - DNA, 201 bp, Homo sapiens
agtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactca

SEQ ID NO: 19115 - DNA, 201 bp, Homo sapiens
atgggagggacagtgtgagatttatgcatcttgaattagagatgtcattggtgggtatttttgtgtatctcttgtaacagattggtgtgtatttctgtgtrtctcttgtaacggaataccaagtaattcttgactgatgaatttcattttctttcctttttgttagatactaccagccccctcacaagttagtgtcccttt

SEQ ID NO: 19116 - DNA, 201 bp, Homo sapiens
taatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagat

SEQ ID NO: 19117 - DNA, 201 bp, Homo sapiens
aagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagg

SEQ ID NO: 19118 - DNA, 201 bp, Homo sapiens
gctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgctttttttttatttaactgtgtctc

SEQ ID NO: 19119 - DNA, 201 bp, Homo sapiens
taaatagtctttcctccactgaacatccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaattt

SEQ ID NO: 19120 - DNA, 201 bp, Homo sapiens
taactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatcca

SEQ ID NO: 19121 - DNA, 201 bp, Homo sapiens
tctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatac

SEQ ID NO: 19122 - DNA, 201 bp, Homo sapiens
tagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaa

SEQ ID NO: 19123 - DNA, 201 bp, Homo sapiens
gattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataat

SEQ ID NO: 19124 - DNA, 201 bp, Homo sapiens
gctttcagctgggacctgagcctgggatgtgggccagggttcttggtttttcttcatttggacctctccacagctgcatgggtttcctcacagtttagtgkctgggttccaagaataagcatcatctattagaatagtgcttgctttataattgcttattgaatgaatgaaagaatctcaggttgttttcttgctcatgtt

SEQ ID NO: 19125 - DNA, 201 bp, Homo sapiens
agatggatatatggacacagtaatgaacaaatgattaaaaaattatttaaaccattgtttgacagggtaagattactttctaatgaaatagaacttggtartatgcccttgaagtctgataccctgacaaaccgcttctgaaaatcagcttacataactaccagggagaataaaaaggcatagtgcaaagcaaatgctgtg

SEQ ID NO: 19126 - DNA, 201 bp, Homo sapiens
ccttaagacatcattgccaacttctaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgtt

SEQ ID NO: 19127 - DNA, 201 bp, Homo sapiens
taagataatttttgtgaagctcattgaatgcgtctgagctccttaactcaaaaaaggctaaaagttactgaaatagctatggttaagggtatattgtcatyacaatgtgataatcattaccaaagtgggcacttggaaaaatagtgaccacttatgagccaaaccaatcaacattaaaactgatttccagtaagtacagct

SEQ ID NO: 19128 - DNA, 201 bp, Homo sapiens
tcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagt

SEQ ID NO: 19129 - DNA, 201 bp, Homo sapiens
ctgagctccttaactcaaaaaaggctaaaagttactgaaatagctatggttaagggtatattgtcattacaatgtgataatcattaccaaagtgggcactkggaaaaatagtgaccacttatgagccaaaccaatcaacattaaaactgatttccagtaagtacagctgccaagtgattatagagcagcctggatacagat

SEQ ID NO: 19130 - DNA, 201 bp, Homo sapiens
ggttggaatgcagtggtgcgatctcagctcactgcaagctccacctcccgggttcacaccattctcctgcctcagcctcccgagtagctgggactacaggygcctgccaccacgcccggctaattttttgtattttcagtagagttagggtttcaccgtgttagccaggatggtttcgatgtcctgacctcgtgatccgcc

SEQ ID NO: 19131 - DNA, 201 bp, Homo sapiens
tgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtaatgt

SEQ ID NO: 19132 - DNA, 201 bp, Homo sapiens
ctattacctagagcaggtaaataaagtcatttgcttgactgaaaggtaagagggttaaaacccaccattctaaatgtcaagtaatagttacgttgcagtcwgcttagttttatactataaattatgatgatttggttccatgtttttttttagtataatgtgattgctgttcagctttatattcagcgcatagcactatgc

SEQ ID NO: 19133 - DNA, 201 bp, Homo sapiens
atttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaaca

SEQ ID NO: 19134 - DNA, 201 bp, Homo sapiens
tatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtct

SEQ ID NO: 19135 - DNA, 201 bp, Homo sapiens
tcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagct

SEQ ID NO: 19136 - DNA, 201 bp, Homo sapiens
actacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtatt

SEQ ID NO: 19137 - DNA, 201 bp, Homo sapiens
cctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagta

SEQ ID NO: 19138 - DNA, 201 bp, Homo sapiens
atttactgtaatttcttattgttattaaaacctaacacttggtcatatgctatttactttatgtgtttctaatttttatttgcgtatttggcctaagcatrtttatatctgcttctgagtaatttctgcattttatatgtttttacttcataaaagatggaggccacctcaaaacaaattaggcatcaaaggaacatacct

SEQ ID NO: 19139 - DNA, 201 bp, Homo sapiens
aataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacag

SEQ ID NO: 19140 - DNA, 201 bp, Homo sapiens
gccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaa

SEQ ID NO: 19141 - DNA, 201 bp, Homo sapiens
ctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcattt

SEQ ID NO: 19142 - DNA, 201 bp, Homo sapiens
gctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcct

SEQ ID NO: 19143 - DNA, 201 bp, Homo sapiens
gatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatatt

SEQ ID NO: 19144 - DNA, 201 bp, Homo sapiens
cctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataa

SEQ ID NO: 19145 - DNA, 201 bp, Homo sapiens
cttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaaggg

SEQ ID NO: 19146 - DNA, 201 bp, Homo sapiens
tggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcat

SEQ ID NO: 19147 - DNA, 201 bp, Homo sapiens
ctcaaaagtggtagctactgttaaaatatactgtatttgcatcttagaagagcatttaacattcttgtgatatctttatggtcaagatgggaaattttgayctaggtggtatttcagttaattcataagtagataaacctacgtttttacagatttagaaggagctttttattttaataacaactcagtacaggatattga

SEQ ID NO: 19148 - DNA, 201 bp, Homo sapiens
agctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctt

SEQ ID NO: 19149 - DNA, 201 bp, Homo sapiens
ggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtatt

SEQ ID NO: 19150 - DNA, 201 bp, Homo sapiens
tttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggc

SEQ ID NO: 19151 - DNA, 201 bp, Homo sapiens
caactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaat

SEQ ID NO: 19152 - DNA, 201 bp, Homo sapiens
ctagaacaaatggaggaattatccttttccattctgtagtggtcatactacctaagaagtactgtggccaattctggacattacctctgagaagcatgttkataggacagtgatcaaatatgctaaaggaacttcagactatgctgtaaagaggagcatgtgaaagaatcaagaaactataatcttgaaaaagaaagcctg

SEQ ID NO: 19153 - DNA, 201 bp, Homo sapiens
aagttttttggtttgttttcacattcaatttagagaccctgaagcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttg

SEQ ID NO: 19154 - DNA, 201 bp, Homo sapiens
tttttaattttagtaaggcacatacatggtacttttaatatcaatgactagcagttgttgagtgactcctatgggacaggatccatgcttggcacttgacwtataacatctccagtaacagtcctacaagggttgtgtggttatactctttttattgaggaggaaacagtttgttcatggagggcaatttccccaggagtg

SEQ ID NO: 19155 - DNA, 201 bp, Homo sapiens
atgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagcaaattctgttttttcttggttataatgttatcttaatcagaaa

SEQ ID NO: 19156 - DNA, 201 bp, Homo sapiens
cagtgccgaaatatatttctttctatggcaacattcttattctactatcctttttatttttaagtagtttcatttttgtcactgttgggttattttaaacratttaattggagggaaagaaatacaaattcatcaaattttacctccagaattgaatttccttcactagttccttaataagtatttaagtaaaagggggtg

SEQ ID NO: 19157 - DNA, 201 bp, Homo sapiens
gtggctaggaaagacctcactgagaaattgacatttgaatgaagatctgaagtgggggcaggtaaaggtgtgtgcctctacaaaggccacagctgaggccrcccttctttatctacctcttttcatctttccaacttccagaccttttttttctgctgataactcataccttttaattaaactttaatttaatttaattta

SEQ ID NO: 19158 - DNA, 201 bp, Homo sapiens
tcttccaactctgctctccaccacttccttgcccctagcacacacacaattaatcagcacttacaaaaacaaaaatttacctctttacaaaaggtacaggsatagagtagaggctttgaatacttgtgcttcaattatttttctcctgtcatcttttatattaaaggaaataaaatataggggtgtctccttttcctggtt

SEQ ID NO: 19159 - DNA, 201 bp, Homo sapiens
ttttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggc

SEQ ID NO: 19160 - DNA, 201 bp, Homo sapiens
tacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtc

SEQ ID NO: 19161 - DNA, 201 bp, Homo sapiens
agctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaag

SEQ ID NO: 19162 - DNA, 201 bp, Homo sapiens
aggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattc

SEQ ID NO: 19163 - DNA, 201 bp, Homo sapiens
gtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatag

SEQ ID NO: 19164 - DNA, 201 bp, Homo sapiens
aagtagcttatctaaggacacaaaaatggtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctg

SEQ ID NO: 19165 - DNA, 201 bp, Homo sapiens
tcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaat

SEQ ID NO: 19166 - DNA, 201 bp, Homo sapiens
acatatacacccttatcccctccctcatgtaccacccatatataattctctttaccgcatcctttatcacactcctacaagccttgaagcaatctgaacayagaaaccatctttgattttcaactcctaattgggactgaacatacttgtcttgaacacagattgctgccttgttagtataggtatcctaatatggcacat

SEQ ID NO: 19167 - DNA, 201 bp, Homo sapiens
ttaaaggctgccctctcagaaaacgagcaactgaagaaagaaaatggaacactgaagcggcagctggatgaagttgtgtcagaggtaagtgttagtaatasggctgagtcgagatgggctaaagtatcctctggattaataaatagagaaacttttacattttaaattaaattatgtaaaataatagtgctaggaaaagga

SEQ ID NO: 19168 - DNA, 201 bp, Homo sapiens
tctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccac

SEQ ID NO: 19169 - DNA, 201 bp, Homo sapiens
ttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtga

SEQ ID NO: 19170 - DNA, 201 bp, Homo sapiens
ttagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtg

SEQ ID NO: 19171 - DNA, 201 bp, Homo sapiens
tttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaatt

SEQ ID NO: 19172 - DNA, 201 bp, Homo sapiens
cctccaaatagaatcttttgtgcttctctagggagattccctttgtgttgaattttatgagtagtgtaaattgtgtgggttgcatcataaaacaaagtgcraacacacacacaaagtcttattgatgagccaagttcctaagcactattaatgagttaaaagtgttaattaaggctgggcgcagtggcttacatctgtaat

SEQ ID NO: 19173 - DNA, 201 bp, Homo sapiens
tcagatatgatcattctgtttcaaatgacaaagccctgatggtgctaactgaagaaccattgctttacattcctccacctccttgtcagcccctaattaayacaacagagtctctcaggtgagtgttgtagattattgcagaaacatctgagttggttcccatgtttagttttggaacctagacaagtaattggtcaagtt

SEQ ID NO: 19174 - DNA, 201 bp, Homo sapiens
tctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaact

SEQ ID NO: 19175 - DNA, 201 bp, Homo sapiens
ctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaattattttttttaagttgtaggcactgatttccaaatgagttccataaa

SEQ ID NO: 19176 - DNA, 201 bp, Homo sapiens
tttttcagatgagaaaagttcaccaaagattttacccattggtgccagaaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaa

SEQ ID NO: 19177 - DNA, 201 bp, Homo sapiens
ccatttctgaacttagacatttactactatggtttaatgacaggtcttacttagaatctgttaagtgggggttccatctcaatgttgtttgccacaaaacrccattaagtcattccgtcattcatcaaatatttgttgttagaatttagactagcaactggcatctgcaagttcccaataatgagccaaggactgttcttg

SEQ ID NO: 19178 - DNA, 201 bp, Homo sapiens
tccttctctttattcttctgtcagctgtacttaagatatgtgtatcaagatcagaagctttcgtctgccactgtggtttcgtttatgtcttcagtctcttstgtgaaggttctcttggctttctagcactaaatcaaaatctggtgctcctggatgacacaacttcccgtaatgccccggtgaacggttgctaattttatt

SEQ ID NO: 19179 - DNA, 201 bp, Homo sapiens
cctttcctcctccctaaaaatatctaagttgaaatctcattttgtcacaatatcccatcctctacctctcctgattcctggatcactctctttcacttttytttttttcttttagagatggggtcttgttctcttgcccaggttggagctggagtatgcggtggagcaatcacagctcactgcatcttcagacccctgggg

SEQ ID NO: 19180 - DNA, 201 bp, Homo sapiens
ccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaat

SEQ ID NO: 19181 - DNA, 201 bp, Homo sapiens
agcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacag

SEQ ID NO: 19182 - DNA, 201 bp, Homo sapiens
cacagagagaaagtaatgattcaggattcattgttgtgaggttcaagaaacatttattttgaggaagtggaggtaaatattcaatgaagttaactacattrtcccagatatatagataagatagataaaatgtatatattatatagacacttatttttattataagatatgtactgttagagttggtagtataccagcttt

SEQ ID NO: 19183 - DNA, 201 bp, Homo sapiens
ggggcagaactgaaagaaagtagctttttgaagccaaagtaaaaagagcttcaagcaggtcttgggcagtggtatcacatgctgctgagagcttgggagaygtagaaagctgaatttggcaattatcaggtcagttgtaatcttggaaagcagatttagtaggggtaggcatgaagtctgtattaaaattggttgagaaat

SEQ ID NO: 19184 - DNA, 201 bp, Homo sapiens
cctacttctgcaaaaattaatctctttgtgattttcccctttcttgcaaatggttggaaaaacttttataataataaacttaggaactggtgttacaatayggtatccaatgtgaatcatttgcctgttattagtacttgttacttgaagccacgtttttgttccttttaagatggcagctgaattgagcaggtgtttttt

SEQ ID NO: 19185 - DNA, 201 bp, Homo sapiens
ggactcattctgttgcccaggctggggtacaatggcgtgacccatggctcactccagcctccacctcctgggctcaagcagttctcccacttcagcctccygagcagctcctgaacacaggcacattccactcccagctaatttttaaattgtttgtagagacagagtctccctatgttgcccaggctggtcttgaactcc

SEQ ID NO: 19186 - DNA, 201 bp, Homo sapiens
ggcagaactgaaagaaagtagctttttgaagccaaagtaaaaagagcttcaagcaggtcttgggcagtggtatcacatgctgctgagagcttgggagatgyagaaagctgaatttggcaattatcaggtcagttgtaatcttggaaagcagatttagtaggggtaggcatgaagtctgtattaaaattggttgagaaattg

SEQ ID NO: 19187 - DNA, 201 bp, Homo sapiens
attctgttgcccaggctggggtacaatggcgtgacccatggctcactccagcctccacctcctgggctcaagcagttctcccacttcagcctcccgagcasctcctgaacacaggcacattccactcccagctaatttttaaattgtttgtagagacagagtctccctatgttgcccaggctggtcttgaactcctaggct

SEQ ID NO: 19188 - DNA, 201 bp, Homo sapiens
gtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttactt

SEQ ID NO: 19189 - DNA, 201 bp, Homo sapiens
taaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagt

SEQ ID NO: 19190 - DNA, 201 bp, Homo sapiens
gtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctac

SEQ ID NO: 19191 - DNA, 201 bp, Homo sapiens
cttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaa

SEQ ID NO: 19192 - DNA, 201 bp, Homo sapiens
tcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataa

SEQ ID NO: 19193 - DNA, 201 bp, Homo sapiens
tctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctc

SEQ ID NO: 19194 - DNA, 201 bp, Homo sapiens
ttgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctagg

SEQ ID NO: 19195 - DNA, 201 bp, Homo sapiens
agcagattacatgcaattgaagttttctcatctacaaaatgctggctgcacagagttgatataatggttaaattagataatatatttagagcacttagcayggtacataagtgccccccaaaatggtaaatgataatgatgtgatgtcattgacaacagtatcactgaagtgaaatttgaggatctcagcttctatctgta

SEQ ID NO: 19196 - DNA, 201 bp, Homo sapiens
catctttttttgtttgtttgtttgtttgttttgagacagagcctcactctgtcacccaggctggagtgcagtggcgcaatcttggttcactgcaacctccrcctccagggttcaagtgattatcctgcctcagcctcccaagtagctgggattacaggcatgcgccgtgacacccggctaatttttgtatttttagtagag

SEQ ID NO: 19197 - DNA, 201 bp, Homo sapiens
ttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctct

SEQ ID NO: 19198 - DNA, 201 bp, Homo sapiens
gaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgac

SEQ ID NO: 19199 - DNA, 201 bp, Homo sapiens
ctcccgaagtgctgggattgcaggcgtcagccactacacctggcccctgcagagtctttatcaaacagaagtgaatattaggaggagcctggggaagaatyctctttgatttaccttggtgttaacactccagcgatacaactatggatcctccagaaagactatgtttttgctgtatcagtgccacctattaggaattgt

SEQ ID NO: 19200 - DNA, 201 bp, Homo sapiens
ctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggcc

SEQ ID NO: 19201 - DNA, 201 bp, Homo sapiens
ttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgt

SEQ ID NO: 19202 - DNA, 201 bp, Homo sapiens
taaattgataaacctgatattgggttataataatgtcataagcactattctggtctaactctctctttttactaatatgtaaatacaccctacaaggtgaygtgatttatttttatttttatttttagattttccaattaattcattgcaatgctgggccaagaattaaggactcctaacttccaattttgtattttcatt

SEQ ID NO: 19203 - DNA, 201 bp, Homo sapiens
tacaaaatgctggctgcacagagttgatataatggttaaattagataatatatttagagcacttagcatggtacataagtgccccccaaaatggtaaatgrtaatgatgtgatgtcattgacaacagtatcactgaagtgaaatttgaggatctcagcttctatctgtagctctaccacacatttgcagttcacttatatg

SEQ ID NO: 19204 - DNA, 201 bp, Homo sapiens
tcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctca

SEQ ID NO: 19205 - DNA, 201 bp, Homo sapiens
agttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctg

SEQ ID NO: 19206 - DNA, 201 bp, Homo sapiens
atagtttgagacatcagacttggatgaggaagggtaaatcatgctactagtgggccagttactctgtggttttcttatgagactgtgctttaaggaaaagktaaccacggagcatatggcattgagtttgagtcatgtggaactggttagaagtaaaatgtttctattccagcattctctgagtttgtcagcttttcatta

SEQ ID NO: 19207 - DNA, 201 bp, Homo sapiens
taaaagagaagtcgagtccttgagaaggggcaaaagggtggaattcagataacaggtggaaggatggccctttgctagtaaggcaggacattatggtagargcaagatgagttcatagataggaccttaggttccaggaagataaagagaagacacttctaacagtttctgttttcccagtgaaggacatctcaactgatg

SEQ ID NO: 19208 - DNA, 201 bp, Homo sapiens
ctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatg

SEQ ID NO: 19209 - DNA, 201 bp, Homo sapiens
cttggccagtgggatagtgagcctactagagacatttggattgtgaggccttggtggggtgtcagtatgccgtatgctttaaagtcaaatctctgcaacaraatgccaggtgtagagttacagttgattaataagacacagcccctgtactcaaggagtttgtaatctagagaatgaaagacatataattacaatatggtg

SEQ ID NO: 19210 - DNA, 201 bp, Homo sapiens
ttagaaatttctttctgttactgctccagaatctgtgcttttcaattattggttctaattcagtatttttaggcctcagagaaaaagccttaatgccgtcytcacgtggtaggctaccaggtctttgaagatggccattttgtatcccacatcttctccacatctgctcatagaaatacagtttcttcatttgctccctta

SEQ ID NO: 19211 - DNA, 201 bp, Homo sapiens
taatttttgtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtc

SEQ ID NO: 19212 - DNA, 201 bp, Homo sapiens
ttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaa

SEQ ID NO: 19213 - DNA, 201 bp, Homo sapiens
agtctcgctctgtcgcctgggttggaatgcagtggtgcgatctcagctcactgcaagctccacctcccgggttcacaccattctcctgcctcagcctcccragtagctgggactacaggcgcctgccaccacgcccggctaattttttgtattttcagtagagttagggtttcaccgtgttagccaggatggtttcgatgt

SEQ ID NO: 19214 - DNA, 201 bp, Homo sapiens
catatcatctgtgttctccatgccagttttatttttgtaatttattgttttttactttgcattctgtttattatttaaattcctttgtttcataagagagytgaaaacaggttagtgaagctgcaagaaagtaagtctttctttgtctgaggaagttgtcacacaagattattgaaataaaaatagaatgctaggtatgct

SEQ ID NO: 19215 - DNA, 201 bp, Homo sapiens
cagaaagataatattttaactaggcacattatgatttgaaaaaaaatttggagtctttttagtaaggatccaccctcggcctcccaaggtgctgggattasaggtatgagccaccgtgcctggccatccgttgttttttgtttgtttgttttattatattgagaagtccacagcaaagaatcacagtgatgaaccagttgc

SEQ ID NO: 19216 - DNA, 201 bp, Homo sapiens
gggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtg

SEQ ID NO: 19217 - DNA, 201 bp, Homo sapiens
cagattggtgtgtatttctgtgtatctcttgtaacggaataccaagtaattcttgactgatgaatttcattttctttcctttttgttagatactaccagcsccctcacaagttagtgtccctttccatctgttgtattgtcttagacttctcctcattcaccaccttgatgcttttacaagataacaaagcttatggagat

SEQ ID NO: 19218 - DNA, 201 bp, Homo sapiens
ggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtgg

SEQ ID NO: 19219 - DNA, 201 bp, Homo sapiens
cactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagca

SEQ ID NO: 19220 - DNA, 201 bp, Homo sapiens
gaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggg

SEQ ID NO: 19221 - DNA, 201 bp, Homo sapiens
actttaaaataaattcattccatccaaatttagcagccatctattgcaaagtttgcttcctttttccatgacatttaaatatacaaaagccttttttttaaaaaaaaaagcattttttagtaggtaaatgtcagtcactttcttaaactagcctgtcctagaccaacagaccagttctactttcaaaacaaaacatagcat

SEQ ID NO: 19222 - DNA, 201 bp, Homo sapiens
gaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggtt

SEQ ID NO: 19223 - DNA, 201 bp, Homo sapiens
tttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcagtatccatc

SEQ ID NO: 19224 - DNA, 201 bp, Homo sapiens
ttgggagaatcacgtgaacccaggcagcggaggttgcagtaagcagagattgtgccactgcactccagcctgggcgacagagtgagactccctctcagttaaaaaaaaaaaaaaaaaaaaaaaatcaccttaatgccttttatctctggttacttcaacaccataattaccataaataattcatctctgttggaatatttg

SEQ ID NO: 19225 - DNA, 201 bp, Homo sapiens
gagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgtta

SEQ ID NO: 19226 - DNA, 201 bp, Homo sapiens
tgtctgcagagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatcc

SEQ ID NO: 19227 - DNA, 201 bp, Homo sapiens; identical to SEQ ID NO: 2969

SEQ ID NO: 19228 - DNA, 201 bp, Homo sapiens
atacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaa

SEQ ID NO: 19229 - DNA, 201 bp, Homo sapiens
tggaacctacaaatgattagattcatttccacccacagggtgaaacattcatttctatgtttaattaatttctatgtttaattaattaaactatattttawaggttaaatcatgaacttcgaggatgggttcatagacatgaagtagaaaggaccaagtcaagaagaatgacaaataatcaacagaaaacccgtattcttc

SEQ ID NO: 19230 - DNA, 201 bp, Homo sapiens
acatctcactttcaaacatcctgctctgactgccttcgcctgttttaccagcttacttcctttagtattccagtttcaatagttgttcagtccttctgagrttttgccatgtttccagtgtctctcattctcttcagttcatcacgtccctcttacccagtttaaataccatggacagtcattgtcactatttccttcctt

SEQ ID NO: 19231 - DNA, 201 bp, Homo sapiens
tactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctc

SEQ ID NO: 19232 - DNA, 201 bp, Homo sapiens
tccctcttgaggtttgataattttctagaatggctcacagaactcaggaaaacactctatttactattactggttttattataaaggatatgtggggcaarctaaatgggagagacgcatagggtaaggtataggggaagagtgcagagctttcatgccctctccaggtgcaccaccctcctagtacctccttgtgtttgc

SEQ ID NO: 19233 - DNA, 201 bp, Homo sapiens
actccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctcc

SEQ ID NO: 19234 - DNA, 201 bp, Homo sapiens
ctccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctcca

SEQ ID NO: 19235 - DNA, 201 bp, Homo sapiens
accttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctccagggtt

SEQ ID NO: 19236 - DNA, 201 bp, Homo sapiens
cagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctacccta

SEQ ID NO: 19237 - DNA, 201 bp, Homo sapiens
gtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagata

SEQ ID NO: 19238 - DNA, 201 bp, Homo sapiens
atggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaaca

SEQ ID NO: 19239 - DNA, 201 bp, Homo sapiens
ctctgaagaggatatacattgatgagtgaagatattagggagggtagggagaaagaatagaagtttttacatataaatacaaatagaagtatttaaaaaawttttttttcttagctttatctgatagcctgccttctggaattgtgaaaggctaacaatgaatttgacttttattcctacttcatttgaagtattctctca

SEQ ID NO: 19240 - DNA, 201 bp, Homo sapiens
tgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctg

SEQ ID NO: 19241 - DNA, 201 bp, Homo sapiens
tggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacag

SEQ ID NO: 19242 - DNA, 201 bp, Homo sapiens
gtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgt

SEQ ID NO: 19243 - DNA, 201 bp, Homo sapiens
ggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacagg

SEQ ID NO: 19244 - DNA, 201 bp, Homo sapiens
tgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtc

SEQ ID NO: 19245 - DNA, 201 bp, Homo sapiens
gagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacagga

SEQ ID NO: 19246 - DNA, 201 bp, Homo sapiens
gcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtct

SEQ ID NO: 19247 - DNA, 201 bp, Homo sapiens
tgctattcctatcaaactatcaatgacatttttcacacaattaggaaaaactattctaaagttcacatggaactgaaaaagagcctaaatagccaaagcasccctaagcaaaaagaacaaagccagaggcatcaagctacctgatttcaaactgtactacaagactacagtaaccaaaacagcatgatactggtataaaaa

SEQ ID NO: 19248 - DNA, 201 bp, Homo sapiens
tttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaa

SEQ ID NO: 19249 - DNA, 201 bp, Homo sapiens
aatgtctaaaatatggaaacttggtttatgagatctactctgccatttttatctgggctttctcttccttttgtctctgttgtacctgtcctgcttggttytgatttaaccccagtggtttctcctgaatgtggagccttctcctagaaggcagcctcggctagtcccagggttcagagtagccagctgctctcttcacct

SEQ ID NO: 19250 - DNA, 201 bp, Homo sapiens
agtcacatattcttgtatgtgtacaaaaaatacacactggatctctgcaagcatagccaagcaactggaaatatgtttttaaaaacttgcttttcattctrtctcttctagtactgttttgatgctctttgaaaacaatctaattgctgtaacaaatgaccatacgtaggccgggtgtggtggctcatgcctgtaatccca

SEQ ID NO: 19251 - DNA, 201 bp, Homo sapiens
gctatgacatcacttggtgataggaatttttcagctccattataatcttatgggaccactgttccacatgtgctctgtcattgacagaaatgccgttaagyaccacatgactattttttttggtggtctgttcctttttattattacagagtattccacagtatggttgtaccacagtttaactgatcacctgttgaagaa

SEQ ID NO: 19252 - DNA, 201 bp, Homo sapiens
aaagaagttaatatggagaagtggcaagtcttttcttctctcttctcttctcttctcttctctcttctttttcttttttctttttttctctgtcagatacygttgtaaagactttgcttttaccggaaactgatacgttgggtcatgtaccctggccagtcagttctctttattctaacacttagccgatcagttagattt

SEQ ID NO: 19253 - DNA, 201 bp, Homo sapiens
tataaagggaaagaatgtgatatgtcacccaggctctggagtacagtggcatgatcataggtcacagcagcctcaaagtttccagttcaagcgatcctacytccttggcttcctgagtatgtggcactacaggtgcatgccaccatgcccagctaacttttttgtagagacagggtctccctatgtttcccaggctggtct

SEQ ID NO: 19254 - DNA, 201 bp, Homo sapiens
atgaggggaagggacagttaatccctactgatcagataaaacctcattgtttcatactaataaatggtttttttatgcttatgaaaggaaaagccagaagkgtaatttttagtgtttagagagctagtgattctagttagggaacttaatacctttgaagttattagtttgcaagcaatagaatctactactaccaaggtg

SEQ ID NO: 19255 - DNA, 201 bp, Homo sapiens
gtgttttcaagaaccctctttattagctaagtggtgagacatgccacctggtggttatagtagtatcatttttctcactgttcttggtgcttttcttctcsttctgattccagttatactaggacaactgctataaacctggaatgtttcacactatattatttcagtaatttcaaaaacagcagaaatcactaagctgtt

SEQ ID NO: 19256 - DNA, 201 bp, Homo sapiens
agtgtctttaaataccccttacctttaaagtaagaaatattaaaatcaagcagaatataataatgaaaaattcttaagatatacttactaaaaacttatcsttcggttaatacactgtatgtaggttgtacatacaatatgaaaaagtatatttttgtagcctacttttaaatccagaatagaggaggttaagaaggttgt

SEQ ID NO: 19257 - DNA, 201 bp, Homo sapiens
ctattattgacattattcctttctgtggtctgaggtgcctcccatgaaacttgcttctaggacactaggattgagaaccatcagcgtaacatatctgttaygctacaatagtttattttcatattttagctactttacatactcgggtataatgaactttattcatagcttctgaagcagttggcacatttgagatatttt

SEQ ID NO: 19258 - DNA, 201 bp, Homo sapiens; identical to SEQ ID NO: 2997

SEQ ID NO: 19259 - DNA, 201 bp, Homo sapiens
tcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatc

SEQ ID NO: 19260 - DNA, 201 bp, Homo sapiens
ctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtat

SEQ ID NO: 19261 - DNA, 201 bp, Homo sapiens
taagcatcttcctcatgctttcagtaaattggaaaacccacggaggttaaatattaccttttttttttttaacttaaatcaattctgtttatttttttatyacattttcctatatgtgaagaatactattcattaaggctgactcatagaaatttgcttgaatacacacacacagactgatgcataaatttgagaaatatc

SEQ ID NO: 19262 - DNA, 201 bp, Homo sapiens
ctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgt

SEQ ID NO: 19263 - DNA, 201 bp, Homo sapiens
cctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatg

SEQ ID NO: 19264 - DNA, 201 bp, Homo sapiens
ctgggtgctaaggctgtctgcaggctactaatatgcataataacaatcctgaaaaagaaggaaaagtatactgtgccttactgaagaaggcaggacagcckttggtatttgttagagtaaatattagttatcttacataaagcatgttatattccctgatgtcagggcctgataaatgagcccttacactcttgatagtca

SEQ ID NO: 19265 - DNA, 201 bp, Homo sapiens
cctactaaactatttgcatataattttaacatttgagtggctgtatataaagctaaaagttctttataagatttatagcatcttagaatgtttaaattagrtaacattagtgtgcttttagtttttgaatttaattttgctcttgattttgtttgtgttaatgtagactttgtctacgtaagcttgagcccaactttggag

SEQ ID NO: 19266 - DNA, 201 bp, Homo sapiens
cccgccccaaattttcttttaacttaaagtgttaatgtttgtttgttcccaatatttttatatatgtcaaggctttttcattatatacaggccagctcttkggagttctgcatagtgtttcttgtttaaaccacacctataatgtaccatctacaatttccaattctttaagacagagtgaaaaattaagacacctgaagc

SEQ ID NO: 19267 - DNA, 201 bp, Homo sapiens
gtgccttgatgctagagagtagcctgcaagctgtaattatatatgggcattagggaatgaagaacagccttaatactattgatcttttaagtgaaggtcascttagaaagcttttacttgttaaaaagcttcacagtttgtccttgtagttaatgcaattgaagttgaattaatctttcttaattttttttttagggtttc

SEQ ID NO: 19268 - DNA, 201 bp, Homo sapiens
ctgcacctggccttggatttcgtgatttgactgacatcttttacaccaattattgccatttttttattgggtactaattattagtattgctttctttattygttaaataagaagtaaaagaacttttaaaaaataaaataactttttttcctagtacaaagcttattttcaattttttttattgcttaaattttgcaggtt

SEQ ID NO: 19269 - DNA, 201 bp, Homo sapiens
ggcttcaggtgatacccgagtggagtttttactccatttccattccgtaaggctataggcatttgaaagaggaaacttttctttggcaaccttccaccttyctttctacagaatatttcagtatttctagctcataggttttctaaaatattctctgtaatttattttgaaatggagtttttttatcgtttacagatatga

SEQ ID NO: 19270 - DNA, 201 bp, Homo sapiens
ttgtacgttgcttaaatctgagaaatcctcagatcacctgtactggttttgatcgaccaaacctgtatttagaagttaggcgaaaaacagggaatatcctkcaggatctgcagccatttcttgtcaaaacaaggtaaggatttaatggttgatgaattttggtaatgatttcctttttttttttttaacaacttatgtatt

SEQ ID NO: 19271 - DNA, 201 bp, Homo sapiens
tcgaaaactgtatcttcgggcaccaaagagcattgttataatcaagtaccagttgaattaagtacagagaagaaggtttgttttaaagaaattgttctgayttatttcattctttattgattcaaattctgtttaaaattttatattttaattcctttccaattaaagagaaaatggcatatataacaaagcataaaattc

SEQ ID NO: 19272 - DNA, 201 bp, Homo sapiens
cttccttattaaatctctaaaagcaggaatgctctggaacaatgaacaattagaatgtggtaatgtaattttgggccaaaaaatactttgtagaaatgtgrttctcttacttggaatagaaagaattctgactcgaaaaagtgcagttaatgtatgcttttctgggtaagatttgtgatagattttgattgagatttaaaa

SEQ ID NO: 19273 - DNA, 201 bp, Homo sapiens
tacaatattaatttcataaaggtaaaggcatatctgttttgttcctatttgattccttgtgaaagcacaatgcctagcgcacaatagacacttaaacttayctgttgaatggacaggtgaatgcttttaaagtctttccatatagaaaattaagtttcattacatttgacttgatctaggttttcatttcatagaatggag

SEQ ID NO: 19274 - DNA, 201 bp, Homo sapiens
tcattgtatttttagtttgcttttccctaatgactaattatattgagcatttttcatacacttattggccatctgtatatcttctttgagggagtatctgytcaaatcttttgcctattttttcttagtgagttttgatagtcatttctatattctgaatataaattatttatttgatatatgctttgcaaacattttctc

SEQ ID NO: 19275 - DNA, 201 bp, Homo sapiens
agagggtcagtttactctttctgatgttgtcctgccggcctctccctatccagacttcggctatctttaggaagcggccccgggagctttgcttcacgtcyaggtaaaacctctttttctggatgtccactcgtttggaggccagctcctggatttcggctgcgcccccggcctgattaggggtggctgaggccgcgtagt

SEQ ID NO: 19276 - DNA, 201 bp, Homo sapiens
gaagttagaatgacccttgaattacaatcggccacattcatcacaaatacattaaataagagtaatttgccataaagctctatgtttgtatacttctttgktttttttttttttttttttttttttttttgagacagggtctcactctgttgctcagtctgtagtgcagtggtgtcatcatagctcactgcagtcttgatc

SEQ ID NO: 19277 - DNA, 201 bp, Homo sapiens
catttttgctttttccctatttcagtaacatttttcgctatttcagtaacattacatgtcaacaagagaatggtgggtattttggggggggttgggtgggragaaattttactaagcttgctagattctaaaaggtataccttatttggccccttttccccatttaggggaacaagggtgttggggctgggaagtagataa

SEQ ID NO: 19278 - DNA, 201 bp, Homo sapiens
taacagagttgggagtattaaaaagatgtaaagagccccttaaaattttgttgctgggaattttagtgttctactgatgaaggaaatagacactggaaggygttgtttctattaggtaacttagatatcatactgaagacttcaaatacttattgttgacactcaaaagacacacttagtgtaagtaagcatttccccgct

SEQ ID NO: 19279 - DNA, 201 bp, Homo sapiens; identical to SEQ ID NO: 2999

SEQ ID NO: 19280 - DNA, 201 bp, Homo sapiens
aaggcgatcctcctgccttggctttccaaagtgccgggattacaggcgtgaaccaccgcacctgatgcagttgttgttgttgttgttgttttaatatctgrttattattttattgtatttcattgaatatagcacagtttgtttttacattttcttattgatagacacctaggctatttttctggttttggactgttacta

SEQ ID NO: 19281 - DNA, 201 bp, Homo sapiens
gtttgtattggaattaaaaaatagaaaacattaacccatggtagctgtcactgtattctttcaaagaagccaatgaaataaactgttttctccctctatgkggtgtttttctacttgaacataaatgcacattttattttatttccagactttttgtggccagcacccaatgaagagcaagttacttgcctcaagatgtac

SEQ ID NO: 19282 - DNA, 201 bp, Homo sapiens
ttcccaccagcagtgtatgagaggtccagttcctccccatccttgctatcacttagtctggctgatctttaacttaagccattctaatagtatctcattgkatttttagtttgcttttccctaatgactaattatattgagcatttttcatacacttattggccatctgtatatcttctttgagggagtatctgttcaaat

SEQ ID NO: 19283 - DNA, 201 bp, Homo sapiens
atggtacctgttacagtgctagttatgaaagaaagaaagagagagagagagaaggaaggaagggagaaaggaaggaaggggctgggagtggtggctcacasctgtaatcccagcactttgggaggccgaggcgggtggatcatgaggtcaggagatcgagaccatcctggcgaacatggtgaaaccctgtctctactaaaa

SEQ ID NO: 19284 - DNA, 201 bp, Homo sapiens
gcatgaacccgggaggcagagcttgcagtgagccgagattgcgccactgcactttagcctaagaaaaggaaggaaggaaggaaggaaggaaggaaggaaawatcagtcactcactcaggtttagtttcaaaagccaaaacagtgataatattgaattttttccagccactcagtagtacccagagaattttgatacaaata

SEQ ID NO: 19285 - DNA, 201 bp, Homo sapiens
ttccttattaaatctctaaaagcaggaatgctctggaacaatgaacaattagaatgtggtaatgtaattttgggccaaaaaatactttgtagaaatgtgawtctcttacttggaatagaaagaattctgactcgaaaaagtgcagttaatgtatgcttttctgggtaagatttgtgatagattttgattgagatttaaaac

SEQ ID NO: 19286 - DNA, 201 bp, Homo sapiens
cctttaaaaatataaagagttacatttttcactggtgggccataacaaaacaggctgtgggccatatttgtccgaatgtcttctcagtgatctttcatccrtatgtccttttactctaggatgctgtgaaatcctggttaccccttcttgtatcacattgaaaacctaaagtttgaactattctatagaaattttattaaa

SEQ ID NO: 19287 - DNA, 201 bp, Homo sapiens; identical to SEQ ID NO: 2989

SEQ ID NO: 19288 - DNA, 201 bp, Homo sapiens
taggaatttttcagctccattataatcttatgggaccactgttccacatgtgctctgtcattgacagaaatgccgttaagtaccacatgactatttttttyggtggtctgttcctttttattattacagagtattccacagtatggttgtaccacagtttaactgatcacctgttgaagaacttttgggttgttttccagt

SEQ ID NO: 19289 - DNA, 201 bp, Homo sapiens
gttttgttttgttttttgctttttaactgcagtattttgaggagtcttggagtagcaagctaatctttggaagaaaggaaaatataaacctgaaaactaayaatttaaagaacgtcttttcaggttgtcatttgaaaaatacttgatttctgatcactgatttgaattgagtgtcaaatatttgatatgttttgtaaatta

SEQ ID NO: 19290 - DNA, 201 bp, Homo sapiens
aggaatttttcagctccattataatcttatgggaccactgttccacatgtgctctgtcattgacagaaatgccgttaagtaccacatgactattttttttrgtggtctgttcctttttattattacagagtattccacagtatggttgtaccacagtttaactgatcacctgttgaagaacttttgggttgttttccagtt

SEQ ID NO: 19291 - DNA, 201 bp, Homo sapiens
ttgtctataggatgttctcccatacttctctcagatctcttggatttaggcctcctgggccaccatatttgaaatatcagattagttccccctcccccatyattcagcattcctcgtaaatctttgctgttttaaaaatagcactatcactgtctaacttactgtgttatattttgttaattttctgtgagttcttcttca

SEQ ID NO: 19292 - DNA, 201 bp, Homo sapiens
ctgcagtattttgaggagtcttggagtagcaagctaatctttggaagaaaggaaaatataaacctgaaaactaacaatttaaagaacgtcttttcaggttrtcatttgaaaaatacttgatttctgatcactgatttgaattgagtgtcaaatatttgatatgttttgtaaattaggtgaagatgagtgagtaggttctaa

SEQ ID NO: 19293 - DNA, 201 bp, Homo sapiens
tctcctcctatgtcatttttttcttcttatttttcttgactgtataagagagaatgtatgacatttcctgcttgaccgctgagtttgattataaattaaawtacacaatattttatacaaattgttttgtagaagatttatttacagatgctcattcacaggtaaaattgacttatgaaaatagttttcatgacaaatgta

SEQ ID NO: 19294 - DNA, 201 bp, Homo sapiens
aggctgtaaacctgtacagatgttactgtaatgaatattgcaggcaattgtaatacaatggtaagtatttgtgtatctaaacttatctaatgtagaaaagrcacagtaaaaatacagtataaaagataaaagatggtatacctgtatagggtgcttcctgtgaatggagcttgtaggactggaagttgctctgagtgagtg

SEQ ID NO: 19295 - DNA, 201 bp, Homo sapiens
tgaattcactcttttgtgaggtttatctccaaaaaaggcaatattcacatatttgcaaagcatttagtactataacttcttgaatgtctgagcagtcctgrcattagggtgggatccatcagggcccaagatgagtgtttcatctttgttacttgtggcaaagcagcccttacttcttttactttgtagcattgctatgta

SEQ ID NO: 19296 - DNA, 201 bp, Homo sapiens
agcacagtcagaaaatgttctaacagatattaaattgtgagtaatttttttccctcaacttttattttggatttatgggggtgcatatgcaagtttgttaygtgggtgaattacatgttgctgaggaagttgtgagtaatttatgtcatttctaatcatgtggtcagatgtctgtggtatatgagagaattttgtatacaa

SEQ ID NO: 19297 - DNA, 201 bp, Homo sapiens
tgtatttctgagtgggggcatgattttagggattcattcaggaagttgggctccctaaagacagcactgccaatggtaagctttgccaagtctgatgtccygaaattacattcttaataaggagagcattcaggattggggagtggtaaagaagctgaagacttcactataaaagagcaaatggataatgtaaaaagagaa

SEQ ID NO: 19298 - DNA, 201 bp, Homo sapiens
ttcagtagaaatttgctgactctttttatctcttttaatagctaatgcatgagataaaattgaaggtattaccaaggagaaatgcaggtggatagttttgraggcaaagtcacagtaagcaattcatctctccaaggaatagtgatgaaagctgagatccaataaatgtcttgtttggattaatacataaatatttccttt

SEQ ID NO: 19299 - DNA, 201 bp, Homo sapiens
gtttgtactgatttggaaagacattctcatttaggggatgaaatagaaagtcaatgaggagaaagaaaagcttttattatttattttcttttaaatatttyagtatcatggtacagtcaccagaaaaagcttacagttcctcacagcctgttatttcggcacaagagcaggagactcaggtaaggcttttgtaaaaaggta

SEQ ID NO: 19300 - DNA, 201 bp, Homo sapiens
ccatttcttgtcaaaacaaggtaaggatttaatggttgatgaattttggtaatgatttcctttttttttttttaacaacttatgtattttatgttatttaygatttccttctaatgcatatttaacatatttcaaattccacctagttttggttcaagtcaagcatgatgttatataatcaattcagtgattgagactagt

SEQ ID NO: 19301 - DNA, 201 bp, Homo sapiens
tggtaagttgtacttaagcaaaacctaatcctttaaaaaaataaaacataaagagtttgaaatgcttaatctttcattaaactctcaaaatacaaatgcarctacaaatgatgtaaactatagaagagagtgaacaaagaacagatgctcagatttatgtatcaattagcttttaggaagatagcatactagtattgacca

SEQ ID NO: 19302 - DNA, 201 bp, Homo sapiens
gtgaaaaaaaattggaaacaactgcacagcagcggaaatgtcctgaatggatgaatgtgcagaataaaagatgtgctgtagaagaaagaaaggtatgttgytcattgactattctttcgggtgagaaatttaatttatatttgactgtgcaaagagtcagttgttacttgtaaacttcaagtcattgtttaggtcagagtt

SEQ ID NO: 19303 - DNA, 201 bp, Homo sapiens
ttagcacaaggaaagacattcatcataggtttgtaagagatgaaattcaggtatgaggatcaatcatcattgctctccgttgctcatagtggaagtggatrtttctcaaatgtttatttaccagatctttattgaatactttctttgtgttgaacataaagcagtccctctgataaatgtgggagaacaaacttgcagatt

SEQ ID NO: 19304 - DNA, 201 bp, Homo sapiens
ctttaaatatgtatgtttggttttcattcatattgacagtactacctctcagttttctttcagatattgttttgtatttacccatgaagacattgtttttyggactctgcaaataggacatttcaaagatgagtgaaaaaaaattggaaacaactgcacagcagcggaaatgtcctgaatggatgaatgtgcagaataaaa

SEQ ID NO: 19305 - DNA, 201 bp, Homo sapiens
aaactgaagcttagagagttaaataaagagctcaaaatctcacatctagtaagtggcaaaaacaggatttcagctcaagcaatctgattccaaaacagacytttttcactgtgctgccattcttttgcctggtttttctgttaacttcttaaatatatgtcatgtttcatgcttacttcctcattttcataaatatattac

SEQ ID NO: 19306 - DNA, 201 bp, Homo sapiens
tcaaagatgagtgaaaaaaaattggaaacaactgcacagcagcggaaatgtcctgaatggatgaatgtgcagaataaaagatgtgctgtagaagaaagaarggtatgttgttcattgactattctttcgggtgagaaatttaatttatatttgactgtgcaaagagtcagttgttacttgtaaacttcaagtcattgttta

SEQ ID NO: 19307 - DNA, 201 bp, Homo sapiens
aaagattcctttcaaaatgttattgctcattgacaacacttagtcaccaagagccgtaatggagacatacaaggagactaacgttgttttcatgcctgctygcttaacatccattctgtagctcatggatcaagaagtaaattaaccttttaagtattattatttaagaaatacagtttgtaatgctttagcttctgtaga

SEQ ID NO: 19308 - DNA, 201 bp, Homo sapiens
atgattggttgaaatcacattgaattccactttgtgccagggacttaagttaacgaacaaattattcttacaaaaaggtataaatgtaaggttttcattcygctaaatatgtttgtcaaactgtgttgtgatttgttctcagtgtgtcatagctaccatagcttttggaatgggcattaataaagctgacattcgccaagt

SEQ ID NO: 19309 - DNA, 201 bp, Homo sapiens
gtaatgagaagtttcgattatacaaattaaagatgatggcaaagatggaaaaatatcttcattctagcagatgtaggagacagtatgtattatttattttrtgccaatagtatggatttatggatgatgctcttttaagacaacaatttggctaaataattatcagtattttgaaaaaatattttgttgctgttacatgtg

SEQ ID NO: 19310 - DNA, 201 bp, Homo sapiens
acagctgataatttagaaacaactgtaagacagtccactttttctgattatgaaataataccatagttaagtgtaatttcctataatagaataaaaacacsagttctagttttaggggaggcatgttgttactgtaccttagaatttctggaagatgacatattcatgcttttcctgataactgctgagtctcctgctctg

SEQ ID NO: 19311 - DNA, 201 bp, Homo sapiens
tttttgttgctatttatgtgattcaaattataccagtttataggcctctcacaagtaaaatgaattacctgtttgtttttgtatgcctattttagtcagtytgggggaagggatctgtgaggaaaggataagtcatagagcacttttcttttttaagagacagagtctctctgtgttgctcaagctggagtgcagtggtgc

SEQ ID NO: 19312 - DNA, 201 bp, Homo sapiens
gctgataatttagaaacaactgtaagacagtccactttttctgattatgaaataataccatagttaagtgtaatttcctataatagaataaaaacacgagwtctagttttaggggaggcatgttgttactgtaccttagaatttctggaagatgacatattcatgcttttcctgataactgctgagtctcctgctctgtct

SEQ ID NO: 19313 - DNA, 201 bp, Homo sapiens
gtccactttttctgattatgaaataataccatagttaagtgtaatttcctataatagaataaaaacacgagttctagttttaggggaggcatgttgttacygtaccttagaatttctggaagatgacatattcatgcttttcctgataactgctgagtctcctgctctgtctgccaatccagtcaagaagcctttgctagc

SEQ ID NO: 19314 - DNA, 201 bp, Homo sapiens
atatagtatgttattgattatctcagtaccactgaagagaggttatctgggtcattggagctttgcttctagatttgtgaagccataaacctatatatttmaaataggaggccaaaaaaaaacgaccattgctttatatagttagattttcagtgaattgagagtttatcatttgtaattatacattaatcaaatataagg

SEQ ID NO: 19315 - DNA, 201 bp, Homo sapiens
ttttcatgcacttaaatatatcattatttttgataggctttcttcctttagtcttttctttagaaggtagaaaggaagaattaaataagataaaaccaaaygggtctgaagcatgtataaagtatatatgtttgctcttttgttcttctttttctttagttcccactgggaatttgaaggtccaacaatcatctactgtcc

SEQ ID NO: 19316 - DNA, 201 bp, Homo sapiens
atatgagacattctatcaattttaccctcttaaagatgcagagataatgcattatgtttcatcccaccatctttaatgagaagcttccatcttagattaayattagagaatgttaaaatactctgcaatcaggtaaggacgcttgaaacttcattataatgcaaaagttttctttaacacaataaatattttgaacccttt

SEQ ID NO: 19317 - DNA, 201 bp, Homo sapiens
tgtttcatcccaccatctttaatgagaagcttccatcttagattaatattagagaatgttaaaatactctgcaatcaggtaaggacgcttgaaacttcatyataatgcaaaagttttctttaacacaataaatattttgaaccctttttgtgtcttgtattcataggagttcagatagaccactttatttactatttttta

SEQ ID NO: 19318 - DNA, 201 bp, Homo sapiens
aatattagagaatgttaaaatactctgcaatcaggtaaggacgcttgaaacttcattataatgcaaaagttttctttaacacaataaatattttgaacccyttttgtgtcttgtattcataggagttcagatagaccactttatttactattttttatagagagtgaacagaaatcccatttctagtcaccagtccttaat

SEQ ID NO: 19319 - DNA, 201 bp, Homo sapiens
ctgaggtcaggagttcgagaccagcctggtcaacatggtgaaaccctgtctctactaaaaatacaacaattagctgggcgtggtggcaggtgcctgtaatsccagctacttgggaggctgaggcaggggaattgcttgaactcgggaggtggaggttgcagtgagccgagattgtgccattccactccagcctgggcaaca

SEQ ID NO: 19320 - DNA, 201 bp, Homo sapiens
atgatgaataaattctaagcaggggaagtgtttgggaaagcagggcaggctttgtgctgttgatggcaaatgatgtaccagacaggatgaagttgagaatytggaagttgatcactgattagaaaggcttacattttattttggccgggggtggcagctcatgcctgtaatcccagcactttgggaggccaaggtgggcgg

SEQ ID NO: 19321 - DNA, 201 bp, Homo sapiens
tttttcttgtcatttatcaatcaggactgtttgctttagttaagaaatactcaaggtcaatgtgtttctgaatttaaaattactgttaaatacaaatttayacataaacatggtatgtataagaagtaggacataaatccatcatacttgacagaacttatggaaataacaagaaaatgttacagtttttccccagggatt

SEQ ID NO: 19322 - DNA, 201 bp, Homo sapiens
ttctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgtt

SEQ ID NO: 19323 - DNA, 201 bp, Homo sapiens
agggaatacatttgttgcttacttttttgtacctttacatgtgattgatcacttgtgagttttttctttcaaacatcttaaagcttccagagctttttctrgaaaaaaaaaccagttttaagaatcaccagttctaaaagggtaatatcttattcatctttctgagaatggagtatcatgattcatgaattagatacttgc

SEQ ID NO: 19324 - DNA, 201 bp, Homo sapiens
aatatcttattcatctttctgagaatggagtatcatgattcatgaattagatacttgcatcttaacatttgaaataatttaattttattattttttagttygaaaactgtatcttcgggcaccaaagagcattgttataatcaagtaccagttgaattaagtacagagaagaaggtttgttttaaagaaattgttctgatt

SEQ ID NO: 19325 - DNA, 201 bp, Homo sapiens
ttgttgcttacttttttgtacctttacatgtgattgatcacttgtgagttttttctttcaaacatcttaaagcttccagagctttttctagaaaaaaaaaycagttttaagaatcaccagttctaaaagggtaatatcttattcatctttctgagaatggagtatcatgattcatgaattagatacttgcatcttaacatt

SEQ ID NO: 19326 - DNA, 201 bp, Homo sapiens
ttttgtttgccagccggtcttcagcattttaaggcaacattattattacagttgtaatacgaatataattaccagagaaaaaactcaggaaaataaatgcytttatgaaaatgggattagaggtttgaaaataaacttgttaggagaaataatttcacaatgggatggttttttctttgttaagttttctttatgacttca

SEQ ID NO: 19327 - DNA, 201 bp, Homo sapiens
cttgtgacctgggtacattttgcaaagccacaggtttgcagtgttacacaagggccaaaggaggccatgagttgtctttggttgtggggccggagggtaaytgttcatgaaaatagtgagtgtctgaagattaagaaaatcatgctgcagcagaggagaagggagaggaaggcaggaagggaaaggagatgcctgagggtc

SEQ ID NO: 19328 - DNA, 201 bp, Homo sapiens
attgaatgcttcagtgaactttattatttcagtgaacatttgttatttgatgtgaactttgtgcctgttttgaaatttactaaactcaaggcatgtgttcrgaagagtgtttttgaagatgacctccccttcttagaattcactggatccattgtgtatagttacgatgctagtgattgctctttcctgtcagaagatatt

SEQ ID NO: 19329 - DNA, 201 bp, Homo sapiens
caacattaactttgttgaattttttgtttgccagccggtcttcagcattttaaggcaacattattattacagttgtaatacgaatataattaccagagaaraaactcaggaaaataaatgcttttatgaaaatgggattagaggtttgaaaataaacttgttaggagaaataatttcacaatgggatggttttttctttgt

SEQ ID NO: 19330 - DNA, 201 bp, Homo sapiens
agatgttaacctgttcctttatgacaatgtcctgtttaccaattaacagtgtgtttttgtggtgatgggggcaagacaaatctttaaatggtggaaagcaragaaagaaattataaaacatgattagttgtattatacgttgtttttggttgttggaaaaactatacatttattgagagaatcattaggaagctgaacatc

SEQ ID NO: 19331 - DNA, 201 bp, Homo sapiens
tagccaccgcgcccagcctgaaagatgaactttaaaatggggaaggatactagtaaagccatttcttactcatgtatacatttttccctccatgaaattaragcagccaccttttacatgacttttacatgcatttcagatttttgtactagcaattaaaatatctactggatgtaaatcacatgtgcttaatgctttgct

SEQ ID NO: 19332 - DNA, 201 bp, Homo sapiens
gtgtgtttttgtggtgatgggggcaagacaaatctttaaatggtggaaagcaaagaaagaaattataaaacatgattagttgtattatacgttgtttttgkttgttggaaaaactatacatttattgagagaatcattaggaagctgaacatcagctatattgctggagtgatactgtttcagtggtttcttgaccttttt

SEQ ID NO: 19333 - DNA, 201 bp, Homo sapiens
cttcttggttccagtctagagcccatatagcaggtgggctttaagagataattatccagctcagaccgggagtgagacgggactgttttttcattctaatrcctctctgggcctgataatttaaaggggcttgcattcttcagctaaaattttattttcttttattttttttcccccacagtggtctccctttattaatcc

SEQ ID NO: 19334 - DNA, 201 bp, Homo sapiens
attctgaaaatgaaaaacttaagtaaaggtttagttcattgtttatttcacactgagcatttactacctgaatgttttggacattttatttccatgactgragtggacacttttacaactcactgggttctttgctgatctttctctagaagagcatagctgagagcaggattctgcctctcatgacaattggcatgcact

SEQ ID NO: 19335 - DNA, 201 bp, Homo sapiens
attgtttatttcacactgagcatttactacctgaatgttttggacattttatttccatgactggagtggacacttttacaactcactgggttctttgctgrtctttctctagaagagcatagctgagagcaggattctgcctctcatgacaattggcatgcacttatcccaagcggtgaaagctggctgcccccttgattt

SEQ ID NO: 19336 - DNA, 201 bp, Homo sapiens
gggacaccttccttaaagcgcattggacattggctttgtgggtaactgatctttacctgaatgaaatttatcagtactgtattaagggtctagggtggaayggatgctagcaaggcaaccgttaacatccacttactgatgaatcctataaaattttatttcaggccatacgaagtaacagtaataaatataaaaggaaaa

SEQ ID NO: 19337 - DNA, 201 bp, Homo sapiens
cattgaaatgacatactgccctctctttgtcttctaagttttggatacttttttttttttttttttgacacaaagctgcattagaacctaggtttcttgaytttcagtccagatttctttccactctacttcctgcttcttcatagtataattttcaacactagagcagtctgcataacttttgcaaaatcagctagtctt

SEQ ID NO: 19338 - DNA, 201 bp, Homo sapiens
gaaaggaatacaacagaactttctgagatgctagaaatgtttttttatcttgatggggtgtgggttttgtagataatgaaaaataaacagtaaaaaataaktaaaaaaaaaagtaagaaagttgccaatacagttttacatattcctgtgatgtttttaatcgacaggcaccttcttactgagatacgtaatgagaagttt

SEQ ID NO: 19339 - DNA, 201 bp, Homo sapiens
atacggttctcttgaggtgaatttctactctatcaagagtgaagtagagtatggcttaaaagttaagtgattaaaaagctaccctttcttagctaatttgkaatgtaattggtcttaatttttctaaattcgttctaaccaaaatcttattggcgtgatttctattgacatgaactagaagtgacttcagcagacaacttg

SEQ ID NO: 19340 - DNA, 201 bp, Homo sapiens
acaactgcacagcagcggaaatgtcctgaatggatgaatgtgcagaataaaagatgtgctgtagaagaaagaaaggtatgttgttcattgactattctttygggtgagaaatttaatttatatttgactgtgcaaagagtcagttgttacttgtaaacttcaagtcattgtttaggtcagagttgctgttgtctaaatgca

SEQ ID NO: 19341 - DNA, 201 bp, Homo sapiens
ggtgcgttggctcacgcctgtaatcccagcactttgggaggccgaggctgggggatcacgaggtcaagagattgaaaccatcctggccaacatggtgaaaycccgtctctactaaaaatacaaaaatcagctgggcgtggtggcacgcgcctgtagtcccagctacttgggaggctgaggcaggagaatcgcttgaacctg

SEQ ID NO: 19342 - DNA, 201 bp, Homo sapiens
ccactttgggactcattatactgaattagtttcacagaggaggtaaaatctgttgtttatgattacatattaactctaccattttaccttcagcattgctrtagtatgtcatatctgaaggcaattagcacaagtgacttgaagaattgtagttttgatgacttatatgtattttataaaaggcaggcagagtttttgtgt

SEQ ID NO: 19343 - DNA, 201 bp, Homo sapiens
agccgagattgggccactgcactccagcctggcgacagagcgacactcttgtctcaaaaaaaaaacaaaaaaaaaaacaaaaaaaaaaactagtaagaggkcccagtggctcacacctgtcattctagctctttgggagactgaggagagaggatcagttgaggccaggattcaagaccagtctgggcaacataacgagac

SEQ ID NO: 19344 - DNA, 201 bp, Homo sapiens
tctccgaggatctgtaagtatatatctgtgaattcccttcatagatcttcttttacttctattacacttttcttcagaggtttgcagtattatgattgtarctttgacttcagatgggtgactaggaactcatagagtcttactaagttccagttaaacactacattcattactttggataaaacccgtgtgtatggcatc

SEQ ID NO: 19345 - DNA, 201 bp, Homo sapiens
ttaatttttttgtaggtatggggtctccccatgttgccctgcctgtctcaaactccagggctctcaggtgatacccaccacccttggcctcccaaagcacygagagtcactgtgccaggctgagtttaaaatttcttgagttggagtttatggctattttttccactagttattaaacatgtatttttgtataaggcactg

SEQ ID NO: 19346 - DNA, 201 bp, Homo sapiens
gtagcagagaattagataagggacgtatgaatacatataaatgctgttgaagttctgaagagagagagtgtttagagaaattagaggagtctttgtgaagktatcactagaacttcctatttttgtggaatatatagtagattttggtgtgatactgtggatttggacattcactcagagaaggaatgagggaagaatggt

SEQ ID NO: 19347 - DNA, 201 bp, Homo sapiens
tatttcctacagacttcatctgcagagagaaagagacgattacctgtgtggtttgccaaaggaagtgataccagcaagaaattaatggacaaaacgaaaasgggaggtctttttagttaagctggcaattaccagaacaattatgtttcttgctgtattataagaggatagctatattttatttctgaagagtaaggagta

SEQ ID NO: 19348 - DNA, 201 bp, Homo sapiens
ttagagtagtcacatgttataatacttatagttgatcaaaaaattgattcctaagtgttcttattaaagacacacaccacacacacacacacacacacacmttctctctctctctctctctcacacacacacacatgcacacacacttatgtactttcttgctttttttgacctaagatcttagataactattacagatta

SEQ ID NO: 19349 - DNA, 201 bp, Homo sapiens
gatacaaataactgactttgaccccatgtttagtaggttttttttttgtttgtttgtttgttttttttttttgtctttcttctccacactctcttaggackgttgtagcttgtaatgttagtgaattgtaattgtttatttgcatgtctgtctcctcttttagaattgtgaactcctcaggtcatggattgtattttatta

SEQ ID NO: 19350 - DNA, 201 bp, Homo sapiens
cttttttttttttttattttgagacagggtctcactctgtcacccaggctggggtgtagtggtgccatcttggctcactgcaaccttcacctccagggctsaagtgattctcctgcatgagcctcctgagtagctgggattacaggcgtgtgccaccatacccggcttatttttgtattttttgtagagatggggtttcac

SEQ ID NO: 19351 - DNA, 201 bp, Homo sapiens
tttatctcccaatgataatgaaaacgatacgtcctatgtaattgagagtgatgaagatttagaaatggagatgcttaaggtatgtttacaattataaaaayattacttcaagttctttccaaaggacatttaattaagtaaaatattaactaattctaaaccaggttccaccacaatgaaattgctactaattatgtaaca

SEQ ID NO: 19352 - DNA, 201 bp, Homo sapiens; identical to SEQ ID NO: 2994

SEQ ID NO: 19353 - DNA, 201 bp, Homo sapiens
tttggttctttgtttctttgttcattcttctctctctcccttttttatctatcatataaatatgtaaatatatattatatatccattagggaagaggaagytgtctaaagatatctagtatataggagctttgttctgcagaaaagaggatatgaagtcaattatattggaaattaatgcttaatacttttttttaaagca

SEQ ID NO: 19354 - DNA, 201 bp, Homo sapiens
aaatcagtggatgtcaaggaacaactattgttctttgtacggcatttttcaacattgtgaagagttcttatactcaaaaagtttgggagacacagtgtgayattgtttaacctgagttgaacttgtcattttgtattcttgtttagagcagggattttattttgtctctttatctaactttgtattcctaactatttcttt

SEQ ID NO: 19355 - DNA, 201 bp, Homo sapiens
atttgacatggagtggccaccattatacaatagagggaaacttggcaaagttgcactaattcagttgtgtgtttctgagagcaaatgttacttgttccacrtttcttccatgtcaggttggtatctctacatttcatttttatatggctgataattgtaatatgtcaactttatccctataaaattaagttcttttattag

SEQ ID NO: 19356 - DNA, 201 bp, Homo sapiens
ttttaaatcagtggatgtcaaggaacaactattgttctttgtacggcatttttcaacattgtgaagagttcttatactcaaaaagtttgggagacacagtktgacattgtttaacctgagttgaacttgtcattttgtattcttgtttagagcagggattttattttgtctctttatctaactttgtattcctaactattt

SEQ ID NO: 19357 - DNA, 201 bp, Homo sapiens
agatctttaaattgaacatgttttatttgggaagcaagaattaaatttgaggcatatacacagactgggtgtccttggtatctctgaagaacaaagagaaktttggaggttatagaaaaaggaaaatgtgacattgtttttccagaaagttctttggcactagtaaattttggggagttggaagctctgatgggttagtga

SEQ ID NO: 19358 - DNA, 201 bp, Homo sapiens
acataccatgcgggcatgagttttagcacaaggaaagacattcatcataggtttgtaagagatgaaattcaggtatgaggatcaatcatcattgctctccrttgctcatagtggaagtggatatttctcaaatgtttatttaccagatctttattgaatactttctttgtgttgaacataaagcagtccctctgataaatg

SEQ ID NO: 19359 - DNA, 201 bp, Homo sapiens
agacagatctttaaattgaacatgttttatttgggaagcaagaattaaatttgaggcatatacacagactgggtgtccttggtatctctgaagaacaaagrgaagtttggaggttatagaaaaaggaaaatgtgacattgtttttccagaaagttctttggcactagtaaattttggggagttggaagctctgatgggtta

SEQ ID NO: 19360 - DNA, 201 bp, Homo sapiens
agaactttctgagatgctagaaatgtttttttatcttgatggggtgtgggttttgtagataatgaaaaataaacagtaaaaaataagtaaaaaaaaaagtragaaagttgccaatacagttttacatattcctgtgatgtttttaatcgacaggcaccttcttactgagatacgtaatgagaagtttcgattatacaaatt

SEQ ID NO: 19361 - DNA, 201 bp, Homo sapiens
tttcagatttttgtactagcaattaaaatatctactggatgtaaatcacatgtgcttaatgctttgcttcataatatctgttgaagtcaattaaaatataragacagatctttaaattgaacatgttttatttgggaagcaagaattaaatttgaggcatatacacagactgggtgtccttggtatctctgaagaacaaag

SEQ ID NO: 19362 - DNA, 201 bp, Homo sapiens
aatagagaggggcgaggattgaattcttcggtaaagctgggtgattttgttttattcaatacagtataataagtataaaaagtagaacctatagagagctrtaatgggggtagttttaaagaaattctgaaaatgaaaaacttaagtaaaggtttagttcattgtttatttcacactgagcatttactacctgaatgtttt

SEQ ID NO: 19363 - DNA, 201 bp, Homo sapiens
taaaatgtgaattcactcttttgtgaggtttatctccaaaaaaggcaatattcacatatttgcaaagcatttagtactataacttcttgaatgtctgagcrgtcctgacattagggtgggatccatcagggcccaagatgagtgtttcatctttgttacttgtggcaaagcagcccttacttcttttactttgtagcattg

SEQ ID NO: 19364 - DNA, 201 bp, Homo sapiens
cttttattagctggccgttctctcattatctcaaatttatttaagtatttatgttctacctgattcactcacattccttgttttatttaattttcacaacrtacctgtgaggcattgacattttttctgttttagagaagagaaaactgaaattttaagaggctaaatgaccaggatatgtactgctattgctagcaggag

SEQ ID NO: 19365 - DNA, 201 bp, Homo sapiens
tggatgaatgtgcagaataaaagatgtgctgtagaagaaagaaaggtatgttgttcattgactattctttcgggtgagaaatttaatttatatttgactgygcaaagagtcagttgttacttgtaaacttcaagtcattgtttaggtcagagttgctgttgtctaaatgcaccaggacctagttgttgaaagggtaaactg

SEQ ID NO: 19366 - DNA, 201 bp, Homo sapiens
taggttgaattccatgtttgggtgctttgtgaatcattctcttcgatttttctgaagatgggacttactgttttatttcggtgatctttagcatacttttwaaatttttctgtttttttataggctggttttattatttaccgaaatttagagattttggatgatactgtgcaaaggtttgctataaataaaggtatgtta

SEQ ID NO: 19367 - DNA, 201 bp, Homo sapiens
atacttacgaagctcatcattgtatgctgggttctttgctaatactttcttataaaaattaaatacctccacaatcatgcatgctagcagaaacagcagasgagtagccttagcctcacttcctgcttatacctgtcatgcaaatatacagaacccagaaccctagctgaaagggagtttgagaactagtatttgtattgt

SEQ ID NO: 19368 - DNA, 201 bp, Homo sapiens
tactttcttataaaaattaaatacctccacaatcatgcatgctagcagaaacagcagacgagtagccttagcctcacttcctgcttatacctgtcatgcaratatacagaacccagaaccctagctgaaagggagtttgagaactagtatttgtattgtcccagattctgcagtggaagaattcatagtggatggaagtta

SEQ ID NO: 19369 - DNA, 201 bp, Homo sapiens
ggaaggctttttcccgtcagctgatcactgagggattcttggtagaagtttctcggtataacaaatttatgaagatttgcgcccttacgaaaaaggtaaayggtgtaggagtctgcctgtttgacttaattttgtttcccactccacattaaaagatcctttttgcttttaatagggtagaaattggcttcataaagctaa

SEQ ID NO: 19370 - DNA, 201 bp, Homo sapiens
gaaggctttttcccgtcagctgatcactgagggattcttggtagaagtttctcggtataacaaatttatgaagatttgcgcccttacgaaaaaggtaaacrgtgtaggagtctgcctgtttgacttaattttgtttcccactccacattaaaagatcctttttgcttttaatagggtagaaattggcttcataaagctaat

SEQ ID NO: 19371 - DNA, 201 bp, Homo sapiens
ctttttgcttttaatagggtagaaattggcttcataaagctaatacagaatctcagagcctcatccttcaagctaatgaagaattgtgtccaaagaagttkcttctgcctaggttcatttttcagtttttttcttgtaacttctgcattttttgttgctatttatgtgattcaaattataccagtttataggcctctcaca

SEQ ID NO: 19372 - DNA, 201 bp, Homo sapiens
tcatttttcagtttttttcttgtaacttctgcattttttgttgctatttatgtgattcaaattataccagtttataggcctctcacaagtaaaatgaattrcctgtttgtttttgtatgcctattttagtcagtttgggggaagggatctgtgaggaaaggataagtcatagagcacttttcttttttaagagacagagtc

SEQ ID NO: 19373 - DNA, 201 bp, Homo sapiens
tacagaacatgccaccatgctcagctaatttttgtattttttgtagagacagggttttgccatattgcctaggctggtcttgaactcctaagctcaagcartcttcccgcctcagtctccaaagttctggcactacaggtgtgagccactgtgcctggcctctttttctcatttaaatacttttcataccttttgtaaaac

SEQ ID NO: 19374 - DNA, 201 bp, Homo sapiens
gcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattac

SEQ ID NO: 19375 - DNA, 201 bp, Homo sapiens
agaatttgtgttggtaatttttaatgcaacttggacaatttctgaaagatgtaactttcttttttttgagacgagtctcgctttgttgcccaggctggagkgcagtgacatgatctcaggtcactgcaagctccgcctcccgggttcacaccattatcctgcctcagcctcccgagtagctgggactaccggcgcccgcca

SEQ ID NO: 19376 - DNA, 201 bp, Homo sapiens
tttcaccatgttagccaggttggtctcgatctcctgacctcgtgatccacccgcctcggcctcccaaagtgctgggattacaggtgtgagccaccgcgccyggcccaagagtaaccttttcaaaagcagctttgctctactgatttgggtaaaagcttagttgcagttggtttgggaggaaatgggagcagaaaatttgag

SEQ ID NO: 19377 - DNA, 201 bp, Homo sapiens
tttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaag

SEQ ID NO: 19378 - DNA, 201 bp, Homo sapiens
ctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaa

SEQ ID NO: 19379 - DNA, 201 bp, Homo sapiens
ctgtgcaaaggtttgctataaataaaggtatgttaagatccataaataaaatgtgaattcactcttttgtgaggtttatctccaaaaaaggcaatattcayatatttgcaaagcatttagtactataacttcttgaatgtctgagcagtcctgacattagggtgggatccatcagggcccaagatgagtgtttcatctttg

SEQ ID NO: 19380 - DNA, 201 bp, Homo sapiens
ttctttttttctttttgagacagagtcttgctctgtcgcccaggctggagtgcagtggtgcaatcttggctcactgaaacctctgcctcctgggttcaagygattctcctgcctcagcctcccgagtagctggcactacaggcgtgccaccacacccagctaattttttgtattttttttagtagagacgaggtttcaccg

SEQ ID NO: 19381 - DNA, 201 bp, Homo sapiens
cctaatcagaatgttagttcctgaaaacattgacacgtaccttatccacatggcaattgagatccttaaacatggtcctgacagcggacttcaaccttcaygtgatgtcaacaaaaggagatgttttcccggttctgaagagatctgttcaagttctaagagaagcaaggaagaagtaggcatcaatactgaggtattaat

SEQ ID NO: 19382 - DNA, 201 bp, Homo sapiens
ctttgaggaattgctacacagttttccacaatggaaagcctttagttctaatccatgtcttggcatagagtttcttttctttttttttttttttttgaggkggagtttcgctcttgttgcccaggctggagtggaatggtgtgatctcagctcactgcaacctccacctcctgggtttaagtggttctcctgcctcaggct

SEQ ID NO: 19383 - DNA, 201 bp, Homo sapiens
ataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataa

SEQ ID NO: 19384 - DNA, 201 bp, Homo sapiens
ttcattgtcagttgtatgtgctccagataacttgaacagtctgtggttgccttttaatttttgaattatgtctttagttatgcagaagtttaaaattttarcataaattaatttacactatttttctcactttagcatgagtctatcagatggggatgtggtgggatttgacatggagtggccaccattatacaatagagg

SEQ ID NO: 19385 - DNA, 201 bp, Homo sapiens
cgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcctat

SEQ ID NO: 19386 - DNA, 201 bp, Homo sapiens
accttcaagagttcagtggaaagtgattcattcagtattagaagaaagaagagataatgttgctgtcatggcaactggtaagttgtacttaagcaaaaccwaatcctttaaaaaaataaaacataaagagtttgaaatgcttaatctttcattaaactctcaaaatacaaatgcaactacaaatgatgtaaactatagaag

SEQ ID NO: 19387 - DNA, 201 bp, Homo sapiens
ccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtccta

SEQ ID NO: 19388 - DNA, 201 bp, Homo sapiens
gcaaaacctaatcctttaaaaaaataaaacataaagagtttgaaatgcttaatctttcattaaactctcaaaatacaaatgcaactacaaatgatgtaaamtatagaagagagtgaacaaagaacagatgctcagatttatgtatcaattagcttttaggaagatagcatactagtattgaccattcatctgtataagtac

SEQ ID NO: 19389 - DNA, 201 bp, Homo sapiens
ggaaacttggcaaagttgcactaattcagttgtgtgtttctgagagcaaatgttacttgttccacgtttcttccatgtcaggttggtatctctacatttcwtttttatatggctgataattgtaatatgtcaactttatccctataaaattaagttcttttattagctggccgttctctcattatctcaaatttatttaag

SEQ ID NO: 19390 - DNA, 201 bp, Homo sapiens
cccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcct

SEQ ID NO: 19391 - DNA, 201 bp, Homo sapiens
ctgtttatgtaggcaagattggccttgttatctctccccttatttctctgatggaagaccaagtgctacagcttaagtaagtcatgttatcattgccacamtatcaccctctttttttcttctgtgggtgaaacatctgatccatcatgcatgttaaaatctagttcacaataacacatttctgcaggtattgctttatct

SEQ ID NO: 19392 - DNA, 201 bp, Homo sapiens
ccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcc

SEQ ID NO: 19393 - DNA, 201 bp, Homo sapiens
agggatatgttctgagaaatgtgttcttaggacattttgtggttgtctgaacatggacttacacaaacctacatgataaagcttactgcacacctaggctrtatgatagagcctattgctcctaggctgtaaacctgtacagatgttactgtaatgaatattgcaggcaattgtaatacaatggtaagtatttgtgtatct

SEQ ID NO: 19394 - DNA, 201 bp, Homo sapiens
gtaggcttaatttaataagacaaagtaaatggcatttggaaacctcatggatttaatgttttatttaaatgatttctgatttttaaaaagtaaatattgtwtccagaaggctgagaaacaagttagtagggagattttttctttgcaaaaaaattttacagttgtgtctttaacattgtaccacaaactgttgtcctacca

SEQ ID NO: 19395 - DNA, 201 bp, Homo sapiens
ggtatgactatggaattgagtggctaaggtctgttgaagaaaagattgtcggaaatgcaggggtcaaggaactggcctgtggatgttgaagtcactggcastgatcaaggaatagtagtggagtgaaagtagttaatgaatcaggcactaagatctccaagggatgaaaggatgcagtttggagatgacaagataactgta

SEQ ID NO: 19396 - DNA, 201 bp, Homo sapiens
taaacagtattattaagtagcagcatacatggtgttatactgacttctgattttgcaatagtacagacaggttcagattctcatttccaccttctccttcygcctaggtgaataactgctgggttatagtacagatgactgcagatcatttggaatttactttaaatgtaaacagtaaaaatttgaaagagagggaaagtg

SEQ ID NO: 19397 - DNA, 201 bp, Homo sapiens
ctgggattacaggcgttagccaccgcgcccagcctgaaagatgaactttaaaatggggaaggatactagtaaagccatttcttactcatgtatacattttyccctccatgaaattagagcagccaccttttacatgacttttacatgcatttcagatttttgtactagcaattaaaatatctactggatgtaaatcacatg

SEQ ID NO: 19398 - DNA, 201 bp, Homo sapiens
cccgacctctacaaaaacaatttcttaaaattagccaggcatggtggtgctagcctgtaatcccagctatttaggatgcttaggcaggaggattgcttgarcccggggatttgaggctgcagtgagccatcattgtgccacaatactccagcctgagtgatagaaaaaaaaaaaaaaagtgtctttgttatattccaaact

SEQ ID NO: 19399 - DNA, 201 bp, Homo sapiens
aattatcttttgtgttgatgtgagagtttagctctgagattcttccacatgtaaaatgtaatcccccaaagtatttggcaagcacattttattgccttggstcagataattgaaacattaggcatcatatatatagcatgtaaaaagtaaaacagaaacatttatgtttctcaccaagcagtaaattagtactcaactaat

SEQ ID NO: 19400 - DNA, 201 bp, Homo sapiens
actagtgcctgtgttacacacctcttgttcaggttttatcatttaaaataaataagaataaacagtccatagcttatcttacttactgaataaatgctctratttgacagtcatgtttcttaaagttccttacaaaggccattgcccaagaaaccaaataattccattatactatttttgaaatagaacacataataaatg

SEQ ID NO: 19401 - DNA, 201 bp, Homo sapiens
attatcagcatgctggatctcattgacctttttagaacattctacccaacaacagtagagtacacattcaagtgcagatgcagtattcatgaacatggatyatattcagagtcataaaacaaaccttaacaaatttaagaatcttgtatttgtatattttttgactagaatggaattaaactagaaaacaataacagaaag

SEQ ID NO: 19402 - DNA, 201 bp, Homo sapiens
ttatttggttgtattttattgtgtgatatggtggtataattatccttacctcccaggagtttgagagggtcttgccagttaaccgcagaattaaacatgcytaggactaattaatcaggagcaatactacaattaattggaggtaatttgaaacctggtttcaaataaccctgatattatgcacacatggtgcacactttt

SEQ ID NO: 19403 - DNA, 201 bp, Homo sapiens
tggtagagacagtctcagtatgttgcccaggctggttttcaaactccttgcctcaatcagtcctcctacttcagcctcctaaagtgctgggattataggcmtgagccatcacgcttgactaatgtttttgtaaataaagttttctcagaacacagccatgccttttgtttatgtgttatgtagggctgcctgagttaagta

SEQ ID NO: 19404 - DNA, 201 bp, Homo sapiens
aaagttataatttaaaaaaattataataaaatcagaaaataaaggtctgagatggaaaattaaaagaccaaagccacccataagcacaataaatccctccycccaaaaaattatatctattaaaaaaaggtgttgcgccaggcactgtggctcatgcctataatcctagcactttgggaggccaagacgggcagatgactt

SEQ ID NO: 19405 - DNA, 201 bp, Homo sapiens
ctctactaaaaataccaaaattagctgggcttggtggcacacacctgtaatcccagctacttgggaggctgaggcaggagaattgcttgaacccccatggraggtggaggttgtggtgagccaagattgtgtcattgtactacagtctggacaacagagtgagactctgtctcaaaaaaaaaaaaatagaatttgtgcagt

SEQ ID NO: 19406 - DNA, 201 bp, Homo sapiens
accacgtttgagagattcttattcactgtattttctttaattatacttgaattttggtttacattgaggagtgccctcaaagatattaacagatttttaaraaatcctctaaaaaactcattcttagggaaatttgttcacttactaggtgaggagcaaaataaaaatccttaatatagaagagctattatctgtcttcaa

SEQ ID NO: 19407 - DNA, 201 bp, Homo sapiens
acagtctctgttgcagtaactcagttctgttattgtagtgtgaaagcagccacagacaaatgtaaacaaatgtgcctgtctttcaataaaactttatctasaaatacagatagtgggccacatttggcttgcgagctgtagtttgctgttcctgacttagtatgatatgcagcattgtgtagtggaaagattttatagtat

SEQ ID NO: 19408 - DNA, 201 bp, Homo sapiens
cttttcctaaatctaaaatagtatagtcttttttatattgtcagcataaatgaatgcacttatgtaaatgaatatttttaggcgttaagtaaaatattctrtggaaattgaacatttaagttgtttatacttctatggaaatcgtttacgcttttaataaagaagcacaagtttctacaaaatacattctaacagatgttt

SEQ ID NO: 19409 - DNA, 201 bp, Homo sapiens
ctctgttttaattctgtttttttttttttttaatgttacttgttttagtttggattcctagttgaaaagggaatatgattcctttaaaacaaagatactcygctttaaagcaaaggtatatcatcctcttcatggtgattgccatggaaacaagacaatgtaaatttattcaaatagtacacagtttttatagttattgat

SEQ ID NO: 19410 - DNA, 201 bp, Homo sapiens
aaaatgtcaggaattcataatgattcatatacccaaggattttcattgatagtgaggtaaggttattcttgagaaagactcaaagtcataaaataatagamtttcgaaactaccagaattatacaagtcaattaaaatgactgatttgttttaagaggaagaaatactaaatgtataattattagatgcagcatattgtat

SEQ ID NO: 19411 - DNA, 201 bp, Homo sapiens
gccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtc

SEQ ID NO: 19412 - DNA, 201 bp, Homo sapiens
ttgataggctttcttcctttagtcttttctttagaaggtagaaaggaagaattaaataagataaaaccaaacgggtctgaagcatgtataaagtatatatrtttgctcttttgttcttctttttctttagttcccactgggaatttgaaggtccaacaatcatctactgtccttctagaaaaatgacacaacaagttacag

SEQ ID NO: 19413 - DNA, 201 bp, Homo sapiens
tgctggcctagaccatggtgttgccatagtggggtgaccagtctgaatagccaacaatgcttcctcagtaaatacccattttgtcttggtgggatttctayaaattgcaaaatgcagctattatgaagctgtaaaagagaaacagaaacatgtaacacctgggactgttttattaggcccaccgtatgctcagaacatgaa

SEQ ID NO: 19414 - DNA, 201 bp, Homo sapiens
tgtcactgtattctttcaaagaagccaatgaaataaactgttttctccctctatgtggtgtttttctacttgaacataaatgcacattttattttatttcmagactttttgtggccagcacccaatgaagagcaagttacttgcctcaagatgtactttggccattccagttttaaaccgtgagtataatctcatttaatc

SEQ ID NO: 19415 - DNA, 201 bp, Homo sapiens
ttctttttctgttaagcctccctgttaagtaatagcagcaagtttagtttggccatgaatatcttctagagattgtatcggggtactgataaacacatttrtagctcagggatactgcatcagccatattttaaaatgggactaacagtttaaaaactataaatattcacagtgttaagaaacaatctcaagatgcattaa

SEQ ID NO: 19416 - DNA, 201 bp, Homo sapiens
tgggaggcggagacatgggacttgcatgaacccaggaggcagaggttgcagtgagctgagattgcgacactgcattccaacctgggcgaccgagcaagackcggtctccaaaaaaaaaaaaaaaaaagaccatatgtaatgtttcttcattgttctaagataaatctttaaggctgttgaggttttttgtatacaaaatgg

SEQ ID NO: 19417 - DNA, 201 bp, Homo sapiens
agtaaagccatttcttactcatgtatacatttttccctccatgaaattagagcagccaccttttacatgacttttacatgcatttcagatttttgtactarcaattaaaatatctactggatgtaaatcacatgtgcttaatgctttgcttcataatatctgttgaagtcaattaaaatatagagacagatctttaaattg

SEQ ID NO: 19418 - DNA, 201 bp, Homo sapiens
catctctgacattatttttcaattatatagagaatgctttttgtaaaatactgatttatttaaagatattacaatcatagtagttttttgcaatctttttwaaatcagtggatgtcaaggaacaactattgttctttgtacggcatttttcaacattgtgaagagttcttatactcaaaaagtttgggagacacagtgtga

SEQ ID NO: 19419 - DNA, 201 bp, Homo sapiens
cagacacacgggatggggtgggggaggggtgttgagaacaatcgcagacgcccctcggcctgaccgccccgccgccgcccgcgacccccacgccgggcccrgctcccccggcgccgcagcgcggggctccagccactgccggccggttggcggccgccgctccggctctgcccgcgctccccgcatccctccgccgccccc

SEQ ID NO: 19420 - DNA, 201 bp, Homo sapiens
attttggtttacattgaggagtgccctcaaagatattaacagatttttaaaaaatcctctaaaaaactcattcttagggaaatttgttcacttactaggtraggagcaaaataaaaatccttaatatagaagagctattatctgtcttcaaaattaagtctttgagtagatttgtgaataaatctaatagttttgctgaat

SEQ ID NO: 19421 - DNA, 201 bp, Homo sapiens
aacattggcaatagactgaataaataacatctctgacattatttttcaattatatagagaatgctttttgtaaaatactgatttatttaaagatattacartcatagtagttttttgcaatcttttttaaatcagtggatgtcaaggaacaactattgttctttgtacggcatttttcaacattgtgaagagttcttatac

SEQ ID NO: 19422 - DNA, 201 bp, Homo sapiens
aaatgaaaggtttataatctttttgtcatattttacagtcgttagcgtttaacaatttatagcataggatttgggtttttttttttttcattttaaagaaraagtttatttaagcaagacacttgactaagggaagactatcttggagttattattactagagtaatttatttctacttaaagacagattgccccacaagt

SEQ ID NO: 19423 - DNA, 201 bp, Homo sapiens
aataattctcatttgaatttatgatagtttcagatctacccaaagggtgacttaggaatttaacttctaaatctatttaaatgaaaggtttataatctttktgtcatattttacagtcgttagcgtttaacaatttatagcataggatttgggtttttttttttttcattttaaagaagaagtttatttaagcaagacact

SEQ ID NO: 19424 - DNA, 201 bp, Homo sapiens
acctgggaggcggaggttgccgtgagccgagattgggccactgcactccagcctggcgacagagcgacactcttgtctcaaaaaaaaaacaaaaaaaaaaacaaaaaaaaaaactagtaagagggcccagtggctcacacctgtcattctagctctttgggagactgaggagagaggatcagttgaggccaggattcaaga

SEQ ID NO: 19425 - DNA, 201 bp, Homo sapiens
tcgcttgaacctgggaggcggaggttgccgtgagccgagattgggccactgcactccagcctggcgacagagcgacactcttgtctcaaaaaaaaaacaamaaaaaaaacaaaaaaaaaaactagtaagagggcccagtggctcacacctgtcattctagctctttgggagactgaggagagaggatcagttgaggccagg

SEQ ID NO: 19426 - DNA, 201 bp, Homo sapiens
gaatcgcttgaacctgggaggcggaggttgccgtgagccgagattgggccactgcactccagcctggcgacagagcgacactcttgtctcaaaaaaaaaamaaaaaaaaaaacaaaaaaaaaaactagtaagagggcccagtggctcacacctgtcattctagctctttgggagactgaggagagaggatcagttgaggcc

SEQ ID NO: 19427 - DNA, 201 bp, Homo sapiens
tgatggggtgtgggttttgtagataatgaaaaataaacagtaaaaaataagtaaaaaaaaaagtaagaaagttgccaatacagttttacatattcctgtgmtgtttttaatcgacaggcaccttcttactgagatacgtaatgagaagtttcgattatacaaattaaagatgatggcaaagatggaaaaatatcttcattc

SEQ ID NO: 19428 - DNA, 201 bp, Homo sapiens
gctgaatttacttagatcttaagacagaataatcatgtagaaaatttaaaatgtcaggaattcataatgattcatatacccaaggattttcattgatagtraggtaaggttattcttgagaaagactcaaagtcataaaataatagaatttcgaaactaccagaattatacaagtcaattaaaatgactgatttgttttaa

SEQ ID NO: 19429 - DNA, 201 bp, Homo sapiens
tattttcttcatgtacatatggatgatattttcgaatgaccacttttctcttttgctttttattattagactgtttttttcttcttgttaaaggataaaargattagaacataaaaggatatttacacattgtttccccattgacttattcccaagatggtagctaataaacaccaaatgatatagtagttaaagatacat

SEQ ID NO: 19430 - DNA, 201 bp, Homo sapiens
ttttgtagagatagtattcgccatgttgcctaggctggactcaagccagcctcctgccttagcctcccaaagtgctgggattgctggcacgtaccgctacrtccagccagggctgagtttctgaatcatcattgcagcaagagaaattggattacctttagaccactggctctactgtgggctgggagtgggacaccttcc

SEQ ID NO: 19431 - DNA, 201 bp, Homo sapiens
tccaggaattacacaatcacaaaattgctgatttttcttcttattcatgttacataaacttatcctgtccgaaaagactgtatttgaacttactatgtaaratttgctttaggtaaatttatggctgcttccagaattgtgtattaattttccagtttcttttttaccagtctccacttttacctttccctcttcccccta

SEQ ID NO: 19432 - DNA, 201 bp, Homo sapiens
taactatacctatcagaagcctatgttttaagtccaatgtataggcactgctctgtttgtctctggtgggaacttaccctgctttacctaatttcatcctrgcttcctttttgtgaaagatcacccttgcttagcctattttttggcaaatctacaccttggaaatagtagtaaatgacataagcatattaatatttatga

SEQ ID NO: 19433 - DNA, 201 bp, Homo sapiens
gtccattaacactcaactcaaataccatcaatttgatttatatctaacaccacaaagttaggtgttgagttacatgtggttatattgtaactaatagtcarcccttcatggacttctattctttgatgagactcttcttgtaggagtagtaggtgccttaaagcaccttttcatagttgtcagattgaaatccttcaccag

SEQ ID NO: 19434 - DNA, 201 bp, Homo sapiens
aaaaattgcgtatatgttgatgggtcttttctggcagaccagtagagaggaaaaagttgatgatgtaggagatgggaaaatgtctttgagtagatgtcttygagaaaatgtctttgagtagatgagaggtttgcacacatggagaggttggatgtaggagtactgatagttcatccatagttacataagaaaaggtagatg

SEQ ID NO: 19435 - DNA, 201 bp, Homo sapiens
caagtacaaaaagcctccttgggaattatgggaactgaaaaatgctgtgataattgcaggtccaggtaaagatttcttattatagatggacattctaaaastctttctttctcttccttttcatgtttaactgaatttttgttgaatgataagtatttcagttttttaaacaaaacaatgaatgtgtttagatatgagaaa

SEQ ID NO: 19436 - DNA, 201 bp, Homo sapiens
attatgcagaggtatttaatcagtcagaaggttgaatagtcaaattattagtgagtgaagtctattttgatgaggattttactaatgctgtcccttagatrttataagtaaatcgttgttttcttttgaaatatctgaaacctagttaacatggactttcatttgttcttgtaaagatatgcaaagctatttgggagattg

SEQ ID NO: 19437 - DNA, 201 bp, Homo sapiens
ttactttttctattggagttttaagtaaattcttgtatattagtgtgatacattttaagttatttttgtatatggtgtgaggtaggggtccaacttcactsttttccatatggagatccagttgtcccagcaccacatgtttaagagtctattctttccccactgaatggacttggcacccttgtcaaaaatcaattggtg

SEQ ID NO: 19438 - DNA, 201 bp, Homo sapiens
atgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcact

SEQ ID NO: 19439 - DNA, 201 bp, Homo sapiens
agaatgagcacgatgggtataacatttttgtaggtttttaaagttgaaatttagtgtaaatccaaagaatcaatagacaagtctgtgttttacttaacctrtatgtttaaattagcatttttagatactgattttattcctaatttcagaattctcagcgtcttgccgatcaatatcgcaggcacagtttatttggcactg

SEQ ID NO: 19440 - DNA, 201 bp, Homo sapiens
tgaacaagccaggcatactctgtttcctgaggggcctacagttttattggggatatagatgagtgaagaaagcaattgcagtgtagggagatgagtcttaygtcatgggaaaacaaggtgctgtagttgacacaccgagaggcatctgacacattgggggaaatattctagaatatttcctggagaaagtgcaggtaaaag

SEQ ID NO: 19441 - DNA, 201 bp, Homo sapiens
tttacaatacactcagcccttgtggcttaagatcaggggctcagaggctgtgacaactcatgatgctgaaaatgtatccaatgaaaacgaagtactagctygtttagtagtaacgaagtactattaatttttaatatagtctgatactttattttctaattgtagaagcaacattcttagctatatctttctagaatgttg

SEQ ID NO: 19442 - DNA, 201 bp, Homo sapiens
taaggtcaacggtatgactatggaattgagtggctaaggtctgttgaagaaaagattgtcggaaatgcaggggtcaaggaactggcctgtggatgttgaastcactggcagtgatcaaggaatagtagtggagtgaaagtagttaatgaatcaggcactaagatctccaagggatgaaaggatgcagtttggagatgacaa

SEQ ID NO: 19443 - DNA, 201 bp, Homo sapiens
tgcactgagtagtaagaatatataatggtgtgtggtatttcccaagttaaaaaggtcagataaggcttccttgtggaagtgatagttcaaatctgaaagartaggaattaattaggtaaaaatgtttgatgcaaattttaagattttccttctgagtagtcagtagcttttccttcttaacatagaagatgacaaaaccat

SEQ ID NO: 19444 - DNA, 201 bp, Homo sapiens
caattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttc

SEQ ID NO: 19445 - DNA, 201 bp, Homo sapiens
tgcccaaatccgtaagctatgttctgtatagcagctttttcatcataggcagtttttactcttatcagtggacaacctacaaaattaactaaacacttaarcaattaacagaggaggccttgttcagagtgagaaatcattaagcatttgttgttgaaatttcttactgtactctgttttaattctgtttttttttttttt

SEQ ID NO: 19446 - DNA, 201 bp, Homo sapiens
tacaatatgaaaaagtatatttttgtagcctacttttaaatccagaatagaggaggttaagaaggttgtgataaccatgagctctttttttttttttttgrgacaaggtcttactctgtttcccaggctggagtgccgtggcacaatcatagcttactgcagccttgaactcttgggctcaagcaagccttccacttcagc

SEQ ID NO: 19447 - DNA, 201 bp, Homo sapiens
tcagataccgttgtaaagactttgcttttaccggaaactgatacgttgggtcatgtaccctggccagtcagttctctttattctaacacttagccgatcarttagatttccacattccatgatatgtcagttttggtgacccttatttttccacctggtttataaagggaaagaatgtgatatgtcacccaggctctggag

SEQ ID NO: 19448 - DNA, 201 bp, Homo sapiens
acataaacatagtaacatagtcatttattatcattttcaagtattatatactgtacataattgtacatgctagacttttacacagctggcagcaaggtgartttgtttacaccattaccaccacaaacacatgggtgatgctttgcattgtgatgttacgatggcatgatgtcactaggtggtaggaacttttcagctcca

SEQ ID NO: 19449 - DNA, 201 bp, Homo sapiens
tataacgtacctgcatatgtacccttgaaactaaaataaaagttaaaaaatttatcttcttttgccaataataaattaaccttagcttactgtaatgattyttctttatgaattaaaatctttttactcttttgtaataacacttggcttaaaacacaaacatattgtacagctatacaaatatattttctttatatcctt

SEQ ID NO: 19450 - DNA, 201 bp, Homo sapiens
cttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgt

SEQ ID NO: 19451 - DNA, 201 bp, Homo sapiens
ataagctgtgatcatgccactgtgctccagcctgagtgacacccagagtgagaacctgtctcaaaaggagaaaaaaaaaaaagtaacagtagacgctgggractactgaggggagggaaggaacaatggttgaaaaggtgggaagggacagtggttgaaaaactacgtgttgggtactatgctcactatctgggtgatggg

SEQ ID NO: 19452 - DNA, 201 bp, Homo sapiens
aaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttctttt

SEQ ID NO: 19453 - DNA, 201 bp, Homo sapiens
tgtgttgtttttaagcttcactctagtttatatattttaaatgtcataaaataccacatacttataagagaaaaggttctattcattgctgaagtggaagyttatcattaatttttatttatttatttttttttccagttttggaattcttattactttgaacccaagaaccactgataactagcacaatccagtgaaaca

SEQ ID NO: 19454 - DNA, 201 bp, Homo sapiens
cttggctcgctgcaacctctatctcccaggttcaagtgattctcttgcctcagcttcctgagtagctgggactacaggcgtgtgccaccatgcccagctaytttttgtattttttgatagagacagggttttccatgttggctaggcaggtctcgaactcctgacctctgatgatccgcccacctcagcctcccaaagtgc

SEQ ID NO: 19455 - DNA, 201 bp, Homo sapiens
tagaattttctcccctcagaaaattaagaggaaataaaagtctgtagcaaatcacttggcaaaataatggctccttttgtaataggaatttttactctttygatttatctgttacataagttcaaatttttacatattttccaccttttttaaaaaagagtgatatgtagtcaatatcaatttgagcaacactgttgcata

SEQ ID NO: 19456 - DNA, 201 bp, Homo sapiens
ataattatccttacctcccaggagtttgagagggtcttgccagttaaccgcagaattaaacatgcttaggactaattaatcaggagcaatactacaattarttggaggtaatttgaaacctggtttcaaataaccctgatattatgcacacatggtgcacacttttctagtagacatttaatgaaagtaatttaaaaccta

SEQ ID NO: 19457 - DNA, 201 bp, Homo sapiens
tctttttctttagttcccactgggaatttgaaggtccaacaatcatctactgtccttctagaaaaatgacacaacaagttacaggtgaacttaggaaactkaatctatcctgtggaacataccatgcgggcatgagttttagcacaaggaaagacattcatcataggtttgtaagagatgaaattcaggtatgaggatcaa

SEQ ID NO: 19458 - DNA, 201 bp, Homo sapiens
gcaccatttcaaatgtaatgttaaaaaataataaatggagaagtagatagctaacaagtaggcttaatttaataagacaaagtaaatggcatttggaaacmtcatggatttaatgttttatttaaatgatttctgatttttaaaaagtaaatattgtatccagaaggctgagaaacaagttagtagggagattttttcttt

SEQ ID NO: 19459 - DNA, 201 bp, Homo sapiens
ggaaaaatacatttaagattataagtctggttataagcttaaaaagtgacccagaaagggatatcattgctaaaaaaaaaaatccccttgtgacctgggtrcattttgcaaagccacaggtttgcagtgttacacaagggccaaaggaggccatgagttgtctttggttgtggggccggagggtaactgttcatgaaaata

SEQ ID NO: 19460 - DNA, 201 bp, Homo sapiens
tcttcaaataatatttttctcagactggaaatttgtattctaaattatttttagaaaaaaaaaatccccaccccctccagaattaaaacacctgtaaaatwcaggattatattggaagtgttgacatggttttaagggtagcaattgcaaaagtgctactaaaatatattattacaggtatatttttatatcagttaattg

SEQ ID NO: 19461 - DNA, 201 bp, Homo sapiens
ggaatggggagcagctgtaaagaaaaatgaagcttcgcttgcttgcctgctgctcacctactgctttgtggcctggttcctaacaggccatggactggtamtaatctgtggccctggggttgggaacctctagccctgaccaatgttagggagcttttttcctgtgttttcttcaagtggtttcatggtttggggtcttac

SEQ ID NO: 19462 - DNA, 201 bp, Homo sapiens
ctggttataagcttaaaaagtgacccagaaagggatatcattgctaaaaaaaaaaatccccttgtgacctgggtacattttgcaaagccacaggtttgcartgttacacaagggccaaaggaggccatgagttgtctttggttgtggggccggagggtaactgttcatgaaaatagtgagtgtctgaagattaagaaaatc

SEQ ID NO: 19463 - DNA, 201 bp, Homo sapiens
gtgggttttcttcactttttgatattgttctttgattcacttttaaatttttatagagtccagtttatctgttttttcttttattacctatgcttttggcrtcatacctaattcccaaatccaatgccatgaagattttctgttatgttttcttttaatagttttatagttttactttttctattggagttttaagtaaat

SEQ ID NO: 19464 - DNA, 201 bp, Homo sapiens
ttgttctttgattcacttttaaatttttatagagtccagtttatctgttttttcttttattacctatgcttttggcatcatacctaattcccaaatccaakgccatgaagattttctgttatgttttcttttaatagttttatagttttactttttctattggagttttaagtaaattcttgtatattagtgtgatacatt

SEQ ID NO: 19465 - DNA, 201 bp, Homo sapiens
actaattcttccctaaaatttcccacaattgtgtaaacttacctcagtatattcatagatatgagacattctatcaattttaccctcttaaagatgcagarataatgcattatgtttcatcccaccatctttaatgagaagcttccatcttagattaatattagagaatgttaaaatactctgcaatcaggtaaggacgct

SEQ ID NO: 19466 - DNA, 201 bp, Homo sapiens
ctgagtgggggcatgattttagggattcattcaggaagttgggctccctaaagacagcactgccaatggtaagctttgccaagtctgatgtcccgaaattrcattcttaataaggagagcattcaggattggggagtggtaaagaagctgaagacttcactataaaagagcaaatggataatgtaaaaagagaactatttt

SEQ ID NO: 19467 - DNA, 201 bp, Homo sapiens
ataaggcattgtttttttttctccccatttcagtgatcttggtatcctgggatattgtttttaaaattatcgttataattcctttgagaatttagtgaaaygttccctttaaccaacttaggaaaaattaatatctttgtacatgattttgagctgtaaaataaacattttaaactgggaataattggagtttagttaaag

SEQ ID NO: 19468 - DNA, 201 bp, Homo sapiens
attctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgc

SEQ ID NO: 19469 - DNA, 201 bp, Homo sapiens
atacttgggttattctgcaaattgaaatgaattatttaaaaaaaaacaactttaatgtttattaagcaagttttgttattcatgagtttcattagcctttwattttttttttaaattttgaagtaaaatttcttgctgtcacaatacacattaaaaattacaaatatgacacatattaaacacattaagatggccgaatag

SEQ ID NO: 19470 - DNA, 201 bp, Homo sapiens
tatgaaacctttatgaaccttctggatagagaagatgactgctgatttctgtgattagaaattatacttgggttattctgcaaattgaaatgaattatttwaaaaaaaacaactttaatgtttattaagcaagttttgttattcatgagtttcattagccttttattttttttttaaattttgaagtaaaatttcttgctg

SEQ ID NO: 19471 - DNA, 201 bp, Homo sapiens
gtaaaacatctcccagaacatgaaagaatacaaactttattcatgttacgttgtgacaggagactttgttggatgcgcctgattttcctgccaattcacarcttcattaaaacagtaatgctttgaaatatggcttaggaaacttcacaatgatcattaattacacctaatttctggaagagtatatgcatgtatgtgttg

SEQ ID NO: 19472 - DNA, 201 bp, Homo sapiens
tttaggcttatgaaacacttagctacttaaattatttaattttttttcatgtgcagatggtattgtacccaaacactacctttgtgtgtgtgtgtgtgtgygcctgtgtgtgtgtttttgagacagggtcttactctgctcaggctggagtgcagtggcgtgattatagctcactacagccttgacctcctgggctccagt

SEQ ID NO: 19473 - DNA, 201 bp, Homo sapiens
ttagagtaaaacatctcccagaacatgaaagaatacaaactttattcatgttacgttgtgacaggagactttgttggatgcgcctgattttcctgccaatwcacagcttcattaaaacagtaatgctttgaaatatggcttaggaaacttcacaatgatcattaattacacctaatttctggaagagtatatgcatgtatg

SEQ ID NO: 19474 - DNA, 201 bp, Homo sapiens
gattaatacataaatatttccttttaaaattcttaaggcttttattcatatatctcccctctccctatttccaataatgatttttggtgttaatatgatgrtatttatgcttctgtttttataggaaccaaatactttgatttggttatttattctcctttggagatgtagatgagtttattttttcctttcgagctttat

SEQ ID NO: 19475 - DNA, 201 bp, Homo sapiens
gaaatggagatgcttaaggtatgtttacaattataaaaacattacttcaagttctttccaaaggacatttaattaagtaaaatattaactaattctaaacyaggttccaccacaatgaaattgctactaattatgtaacattagatttcacattttccaattcatgtttcttttatgtagtctatgaataatgggttagag

SEQ ID NO: 19476 - DNA, 201 bp, Homo sapiens
aatcacatatttagtattctctttaaaacaagggaaaaggcaaataacctgtctgcttaacagcaacagcacaacttcactatagttatacatgccacackgtattttctgtgtgactacaaaattatttcaaagtgatatttatataaaattcatttctgcaaattgtttttataagtgaggaaaaatggttttccttta

SEQ ID NO: 19477 - DNA, 201 bp, Homo sapiens
ccttgtcaaaaatcaattggtggtaaatgtatggatttactcctggaatctcaattctattctattgtatttatatttctgtccttatgcctgtaccacamtgttttgattacagtagctttgtagtaagtttagaaattgggaaacatgagtcctccaactttgttcttcttttcaagattattttggctatttggggtc

SEQ ID NO: 19478 - DNA, 201 bp, Homo sapiens
gatcatcagctaagagtgacgatcggtggaggagatatgaagtttaagtggagaggagaaggtataaaatagtcttaggaggggaggatagtaaatagatkagggaaaagttgtaggattgccaggaagtagtaagggcccacttgaggctggtggtcacaaatttaaggtgagaccagtcaaaatggttgtgcttttcac

SEQ ID NO: 19479 - DNA, 201 bp, Homo sapiens
tgcagtgagccgagattgcgccactgcattccagcctgggtgacagagtgagactctgtctcaaaaaaaaaaaaaaggaagggcttacattttattttggwgctgactgggaatgaaggcaatgagggatgactgttggagaaggctgtgcttactaaacagtattattaagtagcagcatacatggtgttatactgactt

SEQ ID NO: 19480 - DNA, 201 bp, Homo sapiens
ttctatgaaaacaccttcagggtggtttcttgtatgcttgtaagatggctacttgcatcaaccatgaccacatctagcaggagcaaaagcatcctttcccrtaccagaggagagtcccgaaatttgttgcaattggactgccttggaagcaataattatggccaggagatggaggctagagaactgagacctgatcatagc

SEQ ID NO: 19481 - DNA, 201 bp, Homo sapiens
gcaattggactgccttggaagcaataattatggccaggagatggaggctagagaactgagacctgatcatagctcctatccttgaatcagttgtatagcarggggaattggattttccttaagacagttggatttcacctgtagtcttggtgatgaggtcagttccatccataaaactttgctgttacacattttgggatg

SEQ ID NO: 19482 - DNA, 201 bp, Homo sapiens
cagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgctta

SEQ ID NO: 19483 - DNA, 201 bp, Homo sapiens
aataaagtgacttgtccagggtcacatggatactaagtgaccaagtgtcaaagcagaattttccaaataacttaaagataattcttgtacaaatatagaaygaacacatgtcatatgtgttgtgttaatgagggaaccagaaggatgacaacattggttcagagagatgcaaagataaatatagacattggaggaaaaagt

SEQ ID NO: 19484 - DNA, 201 bp, Homo sapiens
ctttttaaaaagagtgggatactttattcagtttagccctcaagcaattaggcaagtcagttaccatggtaacagtaggtattaatttccttacctagttrgaggttttatgaacaaagaaatctctgagttcatccaccaaaacccaactttctcttgagactggcctcttgagactggtgttaaatttgtctattttct

SEQ ID NO: 19485 - DNA, 201 bp, Homo sapiens
gaacaaagaaatctctgagttcatccaccaaaacccaactttctcttgagactggcctcttgagactggtgttaaatttgtctattttctagaagatgacrctattctaagtggaaaatacggttctcttgaggtgaatttctactctatcaagagtgaagtagagtatggcttaaaagttaagtgattaaaaagctaccc

SEQ ID NO: 19486 - DNA, 201 bp, Homo sapiens
tacatattttttcactacatatgacgcatgtggcaaccccaagagttgagttgtacccatcggcaaactttgatcatgattctgtgaatataggcaagcascaattgcaggtagaacattctttttttgagtcccaaaccgtgagaaacaaattacagaaatgtacctttcttttgcattaggacacgttgtagttttgta

SEQ ID NO: 19487 - DNA, 201 bp, Homo sapiens
tgtattagtaattattcatttagagtaaaacatctcccagaacatgaaagaatacaaactttattcatgttacgttgtgacaggagactttgttggatgcrcctgattttcctgccaattcacagcttcattaaaacagtaatgctttgaaatatggcttaggaaacttcacaatgatcattaattacacctaatttctgg

SEQ ID NO: 19488 - DNA, 201 bp, Homo sapiens
tttcttctatcttaatgtattagtaattattcatttagagtaaaacatctcccagaacatgaaagaatacaaactttattcatgttacgttgtgacaggaractttgttggatgcgcctgattttcctgccaattcacagcttcattaaaacagtaatgctttgaaatatggcttaggaaacttcacaatgatcattaatt

SEQ ID NO: 19489 - DNA, 201 bp, Homo sapiens
gtgaatccctagactagtcttgcttaggataattaggaaaagttaactttcattgtatcaagggacaggtagaacaaaattgtccttttgtccaggaaacyattaaattcttcaaggaaaactttagttatagggattattttttaaatgtctaatttcagtaacaatatttgggacatatttatttttccttctgtttcc

SEQ ID NO: 19490 - DNA, 201 bp, Homo sapiens
cattgtcacggatgattttacaataacatccttttctgacatgcattacaacacactattgattccgtttcaatgtttgtgtctggtatgggggcggagtrgagaggctactacaggaagaaagaacaaataacatttcttcttactactttgtgcatcatgtgatttagctcctcccataccattttacattagaaaatg

SEQ ID NO: 19491 - DNA, 201 bp, Homo sapiens
gacgtcattggatcattttcatttcttgggaggattaataaagcacattccttctgttgggcctccagtgcggggagggtgttggccgagcagtggctgaraaaacgtttttcccctggtgttttcaagaaccctctttattagctaagtggtgagacatgccacctggtggttatagtagtatcatttttctcactgttc

SEQ ID NO: 19492 - DNA, 201 bp, Homo sapiens
ttgcattttcttaaattagagccttaatatataggatattacaatatctaggttttgttgagtagttttttcttctttgaaaacatgtttttaaaataagrtttttttttttttttttttgacatggagtcttgctctgtcgcccaggctgtaatgcagtggcgggatcttggctcgttgcagcctctgcctcctgggttc

SEQ ID NO: 19493 - DNA, 201 bp, Homo sapiens
ggcccgagaggttgaggctgcagtgagccttgatcacaccattgcactccagcctgggcaacagggcaaaaccctgtctcaaacagacaaacaaacaaacraaaggcagaggtaggttaagctatttattaatggtcttctactggtatagatataagctagaaataacattcaagtgtttttacttttactacagttatc

SEQ ID NO: 19494 - DNA, 201 bp, Homo sapiens
tgtctgaaaatattatataatgttattttgcccatttaaaaactttaaaaaatgctaacaaactgtgtactctgtaacttgtcttttttactcaacactaygtttttgagaatttttcttgttgatctgtgtagttccattttaactgttatatcttactatgtttcattatgcaacagttggttcaatccattctcttgt

SEQ ID NO: 19495 - DNA, 201 bp, Homo sapiens
tcatggcttctattgcaaatgcccctatttcccaccttcagttggcctaaccaaatttaatttttcaatatcatatgatctttttgtataattatgtattmaaataattccagataggttaggttttcgaattgcaacgtctcatttaatggttactttcatataactgtaggaaagcatttgataatttttccaacaatg

SEQ ID NO: 19496 - DNA, 201 bp, Homo sapiens
gtagctggcactacaggcgtgccaccacacccagctaattttttgtattttttttagtagagacgaggtttcaccgtgttagccaggatggtcttgatctyctgacctcatgatccacctgcctcggtctcccaaagtgctgggattacatacagtttctttaagcaagccttctcttttccttcctcccagttcttggta

SEQ ID NO: 19497 - DNA, 201 bp, Homo sapiens
taattttatttgtggtatgttcatttgatatcatttggtaatacctgaaaacaggaactgattttactgtgttgctttttcatcatttctagctgaaatgyacagagacctggagccttaacagtctggttaaacacctcttaggtaaacagctcctgaaagacaagtctatccgctgtagcaattggagtaaatttcctc

SEQ ID NO: 19498 - DNA, 201 bp, Homo sapiens
ttcttttactttgtagcattgctatgtatttggcttctagagttggggctttgtggctttcttattgcagtgacacaaccagctttctcctagtctggagrttatacatccttgctataagtatttaaaatgctttctatataatgctttaaaacatgtaagatggcttatccccaagatggtagctaataaacactaagt

SEQ ID NO: 19499 - DNA, 201 bp, Homo sapiens
ttgagaccagcctggccaaaatggtgaaacaccatctctactaaaaatacaaaaaattagctgagtgtggtgacgggcacctgtaatcccagcttcttggraggctgaggcaggagaatcgctttaatctgggaggtggaggttgtagtgagctgagattgcaccattgcactccagcctgcacaagagcgagactctgtc

SEQ ID NO: 19500 - DNA, 201 bp, Homo sapiens
gctgaggcaggggaattgcttgaactcgggaggtggaggttgcagtgagccgagattgtgccattccactccagcctgggcaacaagagcgaaactctgtytcaaaaaaaaaaaaaaaaaaaaaaaaagtgaatttttacatgaatattctacatgattggcatatttacatgaatggtttaaaaacccacaataatagca

SEQ ID NO: 19501 - DNA, 201 bp, Homo sapiens
ggaggctgaggcaggggaattgcttgaactcgggaggtggaggttgcagtgagccgagattgtgccattccactccagcctgggcaacaagagcgaaactytgtctcaaaaaaaaaaaaaaaaaaaaaaaaagtgaatttttacatgaatattctacatgattggcatatttacatgaatggtttaaaaacccacaataat

SEQ ID NO: 19502 - DNA, 201 bp, Homo sapiens
agagaaattatggtatctataggtaattgaaagtaattcagtatagtgaacattgaatagggctgggcggatgaaggcaaagcagaaaaaggaaagcagawgggccatggtaaggagtttatatctcctcccaagagcaatcgaagtgactgagagttttaaacacagcagtgaagtgaattacattaaaaaaataagaac

SEQ ID NO: 19503 - DNA, 201 bp, Homo sapiens
ctcacgcctgtagtcccagcactttgggaggccgaggtgggtggatcacctgaggtcaggagttcgagaccagcctggtcaacatggtgaaaccctgtctytactaaaaatacaacaattagctgggcgtggtggcaggtgcctgtaatcccagctacttgggaggctgaggcaggggaattgcttgaactcgggaggtgg

SEQ ID NO: 19504 - DNA, 201 bp, Homo sapiens
ggctcacgcctgtagtcccagcactttgggaggccgaggtgggtggatcacctgaggtcaggagttcgagaccagcctggtcaacatggtgaaaccctgtytctactaaaaatacaacaattagctgggcgtggtggcaggtgcctgtaatcccagctacttgggaggctgaggcaggggaattgcttgaactcgggaggt

SEQ ID NO: 19505 - DNA, 201 bp, Homo sapiens
aaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcac

SEQ ID NO: 19506 - DNA, 201 bp, Homo sapiens
tactggtactgctgaggcagagggcagtaattggttctttgggataggagaaggggcagttgctgaaatacaaaattaatagtcagcatcccaagttcctyaattgcagccaaaatacatgtgttcaggcctttcggcagtaccgcccccagaactaccagctgtagtgtggtctattcccagacagcaacatgcaagaat

SEQ ID NO: 19507 - DNA, 201 bp, Homo sapiens
ggggaaggatactagtaaagccatttcttactcatgtatacatttttccctccatgaaattagagcagccaccttttacatgacttttacatgcatttcaratttttgtactagcaattaaaatatctactggatgtaaatcacatgtgcttaatgctttgcttcataatatctgttgaagtcaattaaaatatagagaca

SEQ ID NO: 19508 - DNA, 201 bp, Homo sapiens
catcgaagtcaatctaaacatattattggccatttagttaaaaaaagaaagaaaagaaaagcaatatgcttgtggacatacaccagttactttatgtgcartaaaagagtaggaaggggaaggtgaaagaatagagaaaactatgtagtcaggatgtggtggaaccaaattgcaactttcttttttttttttttttttttg

SEQ ID NO: 19509 - DNA, 201 bp, Homo sapiens
attaaagagtttaaggatatccaaaatacttggcaaagtaatctgaaataatactcttaggaaggtagggcaagaatgtgattctagtaagcaaaaatgtratcaaatcgtattctagtcccagctactcgggaggctgaggcaggagaatggcgtgaacctgggaggcggagcttggagtaagccgagatcgtgccactg

SEQ ID NO: 19510 - DNA, 201 bp, Homo sapiens
gggaggcggagcttggagtaagccgagatcgtgccactgcactccagcctgggcgacagagcgagactccatctcaaaaaaaaaaaaagactatatgaacwtgtatggcataaatatgtacaaatattatttattttaaaaaaattcaggggtagggacagggtagttagaaaatatctaaggatgttcatgaaataatac

SEQ ID NO: 19511 - DNA, 201 bp, Homo sapiens
ccacgcccagctaatttttgtgtgtttagtggagatgtggtttcgccatgttggccaggctggtctcgaactcctggtctcaagtcttccgcccacctcakcctcccaaagtgctagaattataggcatgagctaccacacctgacctcaaaatacatttaatagagcaagcatgagccactatgcccagcctcaaaatac

SEQ ID NO: 19512 - DNA, 201 bp, Homo sapiens
gttgtctagtatctgaaacagttgttttatatgttttgtccaagtttagatttgtttgtggtgggagggtgagtctggcctcccttgttatatcatgttgkcctgaagcagaagctgagtttcttttattttttaaatatagtttcaatttttaacaactattaaataggcaagtatcaacaacaatagataacaatataa

SEQ ID NO: 19513 - DNA, 201 bp, Homo sapiens
catgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataa

SEQ ID NO: 19514 - DNA, 201 bp, Homo sapiens
gctagttatgaaagaaagaaagagagagagagagaaggaaggaagggagaaaggaaggaaggggctgggagtggtggctcacacctgtaatcccagcactytgggaggccgaggcgggtggatcatgaggtcaggagatcgagaccatcctggcgaacatggtgaaaccctgtctctactaaaaatacaaaaagaaaaaat

SEQ ID NO: 19515 - DNA, 201 bp, Homo sapiens
tgtaaaatactgatttatttaaagatattacaatcatagtagttttttgcaatcttttttaaatcagtggatgtcaaggaacaactattgttctttgtacrgcatttttcaacattgtgaagagttcttatactcaaaaagtttgggagacacagtgtgacattgtttaacctgagttgaacttgtcattttgtattcttg

SEQ ID NO: 19516 - DNA, 201 bp, Homo sapiens
aaagcttctaccaatacaaacacaaaacaagcatagacaaatagagtttaaagaacatcattggtgttttcctctaaagggaatattgatgctaggccaaraaaatcctggagttattcttgaggaccttaaggaataattgaaatgtaggatttgctcctggctttcttgtcctatattcagaataaaacaagaatggat

SEQ ID NO: 19517 - DNA, 201 bp, Homo sapiens
aatcctatgcaaatgtttctttctgtttttcatgttgactctgctaattgaggtctttgttactttttagccgagactattataatttccccaacagatayccctctccccagtgccccttgttgctttctatgcagtttacaaattattgtctgcaaacacatccttaagtctggaatacctttctggaactccttacta

SEQ ID NO: 19518 - DNA, 201 bp, Homo sapiens
tttcctttcagattgttcatttctggtgtataacaacagctgatatttcaacgttgatgttgtactctgaaactttgttgaatttacttattagatctagwagctttctttgagatttttatatgggattatgtcatctgtatatagagatagttttacttcttcctttccattatggatgccttttatttcttttccatg

SEQ ID NO: 19519 - DNA, 201 bp, Homo sapiens
aataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcag

SEQ ID NO: 19520 - DNA, 201 bp, Homo sapiens
aaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctca

SEQ ID NO: 19521 - DNA, 201 bp, Homo sapiens
tgtatcatgtgcaaaagcacagtaaaaacaaaaatgcattggaagctgtgagttgttgcactgcactcatggatgaatagctgttggttcgcattgcgttkttttgttttgttttgttttgtttttttgagatggagtcttgctctgttgcccaggctggagtgcagtggcgtgatctcggctcactgcaagctctgcctc

SEQ ID NO: 19522 - DNA, 201 bp, Homo sapiens
tgagccttgatcacaccattgcactccagcctgggcaacagggcaaaaccctgtctcaaacagacaaacaaacaaacaaaaggcagaggtaggttaagctrtttattaatggtcttctactggtatagatataagctagaaataacattcaagtgtttttacttttactacagttatctggccactttgggactcattata

SEQ ID NO: 19523 - DNA, 201 bp, Homo sapiens
atttgctaagaactaagccttgaactaaggctattttatttgagtatgagtcatatcagggtacggatccattttactattaacaaaacaaatatgttctkttttttttttttaaatgcacacaccacgtttgagagattcttattcactgtattttctttaattatacttgaattttggtttacattgaggagtgccctc

SEQ ID NO: 19524 - DNA, 201 bp, Homo sapiens
caggatacatgtgcaggacgtgcaggtttgctacataggtaaatgtgtgccatggtggtttgctgcacctatcaatctgtcacctacatattaagccccgyatacattagctgtttttcctgatgctgtccctcctccaggacccagtgtgtgttgttccccatgtattctcatcgttcggctcccacttataagtgagaa

SEQ ID NO: 19525 - DNA, 201 bp, Homo sapiens
atgtatatgtatctagatacacaatctgtgtgtgtgtatatatatgcatgtgtgtgtataaatgtataaattagttactagtatatacgtaagtataaaamctcaatgtgcaaggttacattttcagaaaatatgtaatataataaaagaaatcaagcccagaatttttaaaaagtttattgcgctttctgttaaaaatga

SEQ ID NO: 19526 - DNA, 201 bp, Homo sapiens
caggagaataccttataaatgatatcttctgcaataaactatagattgtatatatgtatatgtatctagatacacaatctgtgtgtgtgtatatatatgcwtgtgtgtgtataaatgtataaattagttactagtatatacgtaagtataaaaactcaatgtgcaaggttacattttcagaaaatatgtaatataataaaa

SEQ ID NO: 19527 - DNA, 201 bp, Homo sapiens
catttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaa

SEQ ID NO: 19528 - DNA, 201 bp, Homo sapiens
aaatgttaaatagaaaattccagaaataaacaatttataaattttaaatcagtggtggctttgagtactgtaatgaaattttgtgccatcccactcagtckgcctcgacttcccttagaatcatccctttgtccggtgcattcacgttgtatttactccctgtctgttagtcacttgttgcagtatcacagtgcttgtgtt

SEQ ID NO: 19529 - DNA, 201 bp, Homo sapiens
tcacgcttgactaatgtttttgtaaataaagttttctcagaacacagccatgccttttgtttatgtgttatgtagggctgcctgagttaagtagttggctrcaaagcctatcatggcctataaagcctgaaatacttactatctggtcctttatagaaagtgttttctgaccctgtactagactagcttgtctcaaaattc

SEQ ID NO: 19530 - DNA, 201 bp, Homo sapiens
atgaattgttagtacacagtgtttctcagtaaagtattattaagcaacagttatctagttttcaaatgtacatcttaagaagcttttaagatggaaggatmcactaaatcccccaataccctttttagttggggaaggttagtacttctgtgaattctgagatatcatatttgtgttagtgactgttcataggttccttgc

SEQ ID NO: 19531 - DNA, 201 bp, Homo sapiens
aatgtttctgagattctttcatgctgttgcatgtatcagtagttttttgttttgttttgttttgtttttgttttttcagagtcagggtctccttctgtcayccaggctagagtacagtggcgcaatcatagcttactgcagcctctaactactgggctcaagctatcctcctgcctctcaagtaggctaggctgcaggtat

SEQ ID NO: 19532 - DNA, 201 bp, Homo sapiens
ttctgaatagtataaacagttatgtagcctatctaggagtttgtgaatagagtttaaaattttgttttgaagctgcaaatttgattagaaattaaacagtraagttattacttaaggaacttcgttttagctgtctgaacaacttactgtataaaaatctttaaacattctgtataaatatgtgataagatatgcaatgac

SEQ ID NO: 19533 - DNA, 201 bp, Homo sapiens
tggagatgagattttgctatgttgcccaggttgctctcaaactcctgggctcaagtaattgtcccacctcagccttccaaaatgctgggattacaggcgtsagccactctgcccggcctattatctctgttctgcccacttccaaccactaatctactttctgtctctatgatttgcctattctggatgtttctataaatt

SEQ ID NO: 19534 - DNA, 201 bp, Homo sapiens
tccatatagaaaattaagtttcattacatttgacttgatctaggttttcatttcatagaatggagagcagactctgtaaatattttgccccagacctagcyttattacaaacattgtcttaattaggattctgtctacccagaatagaaattaactcaagctagcatgagtgtatattgaaatttatattaaggataaagg

SEQ ID NO: 19535 - DNA, 201 bp, Homo sapiens
aggagttcaagaccagcctggccaacatgatgaaactccgtttctactaaaagtacaaaaattagctgggcgtggtgttgggtgcctgtaatcccagctaytcaggaggctgaggcaggagaattgcttgaacccaggaggtggaggttgcagtgagtcaagattgtgccactgcacttcagcctgggagacagagcgaga

SEQ ID NO: 19536 - DNA, 201 bp, Homo sapiens
agttttaaagaacaagtttgattgaaatctaaactttgtacaatcctgaattgagaagtttcctgtattttattatgacacaatatttacctaaaaatagrgtaattatgaattgagaaaacatagctattaatttcatactcttatttgttaagtagattttgtctggaaaactgttcatatttaaaggagctttgtacc

SEQ ID NO: 19537 - DNA, 201 bp, Homo sapiens
tgaattgagtgtcaaatatttgatatgttttgtaaattaggtgaagatgagtgagtaggttctaaactgcttgggtttaccgcactctggagcattgcagragaatgtgatgttggaaggaagtgctgaaacataattattggcttgcctataggagggtgctacataattttagaaggtgtcaagaaagtgacacagtct

SEQ ID NO: 19538 - DNA, 201 bp, Homo sapiens
gagcattgcagaagaatgtgatgttggaaggaagtgctgaaacataattattggcttgcctataggagggtgctacataattttagaaggtgtcaagaaaktgacacagtctgaattagttctgttgagttgcaaaaaatgtaaagtttcttgattctgaaaataagaaatatgttcccagaaatctcatctagttaatgt

SEQ ID NO: 19539 - DNA, 201 bp, Homo sapiens; identical to SEQ ID NO: 2998

SEQ ID NO: 19540 - DNA, 201 bp, Homo sapiens
aaatttagtattatgttagatggtacgttttattaaaatcaaatgcttcaaaaataattgctctgtgtatggcatgagataaatagcaatcagatatattrtttaataatatgactctattaaatgatggcataaatttgaaaatttgaccttcggtatcttccgggtctaaaattatatgactccattataaatattttg

SEQ ID NO: 19541 - DNA, 201 bp, Homo sapiens
ggcggggcggagctgagtggcacagggggcgaggcttgtagcagcgagtcccccctcccctcctttcggacgaagaaggaagacttgggccccgcgactgsgcaggaaaaaggggagggagcagcctctccccgcatgcggcccgggagggaagccccgcccccttcccgcgggtaaaggacacccgtctcccaacagaaa

SEQ ID NO: 19542 - DNA, 201 bp, Homo sapiens
agcgccattctgcgccccctacccccggggcacggacacggccacagcacggggggcggtgaggccccggggacacgagacacgggggagggagaggggamcccgcccgcagatgacccgggggaccggcgaccggacgcggcggggcggagctgagtggcacagggggcgaggcttgtagcagcgagtcccccctcccct

SEQ ID NO: 19543 - DNA, 201 bp, Homo sapiens; identical to SEQ ID NO: 3053

SEQ ID NO: 19544 - DNA, 201 bp, Homo sapiens; identical to SEQ ID NO: 3047

SEQ ID NO: 19545 - DNA, 201 bp, Homo sapiens; identical to SEQ ID NO: 3049

SEQ ID NO: 19546 - DNA, 201 bp, Homo sapiens
ggaagaggaggaggaggaggggctggaggaagatgagccccgcttcaccatcatccccaacccactggacaggagagaggaggctggaggtgcctccagcraggaggaaagcggtgaggacacaggtaagtggcctgggctggtgtgggtgggaaggaaccgagtcagcctgggtcactgctgccctcctgtccccgcagg

SEQ ID NO: 19547 - DNA, 201 bp, Homo sapiens; identical to SEQ ID NO: 3054

SEQ ID NO: 19548 - DNA, 201 bp, Homo sapiens; identical to SEQ ID NO: 3048

SEQ ID NO: 19549 - DNA, 201 bp, Homo sapiens
ggaacagtccagagccaagcttggcgcagcgcccccccatggggatgatggcatgttctggtgaaggcaggggcagggctcggaggaggggcatccatgcrtcgtgcacagcctgttcatgcgctcacgccccgccccgcgccccctacctgctcccagctgatctccttggtctcctgacccgttagtaggaagagggga

SEQ ID NO: 19550 - DNA, 201 bp, Homo sapiens; identical to SEQ ID NO: 3050

SEQ ID NO: 19551 - DNA, 201 bp, Homo sapiens
ccacagtcaaacataattcctccgtggacagtgagttcatgcctcttgggtttttttgttagtttatttgtttggtttttatgagatggaatctggctctrtcacccaggctggagtacaatggtgcaatctcggctcagtgcaacctctacctcctgggttcaagcgattctcctgcctcagcctcccaagtagctggga

SEQ ID NO: 19552 - DNA, 201 bp, Homo sapiens
gaaagctgtccaccatcttgagttggccccggagctccttcttgttaaggtgatctaacattcgagcgtccaccagcgactccatgaagtagctgcggtaytggggcagccccaggctgggcagccagtcgttccccacccactcgtggttcatgtcgccatatgccaggatctggggccatgggcaggtgagggaagagt

SEQ ID NO: 19553 - DNA, 201 bp, Homo sapiens
ctccgccccttcctttgactccacccctctccgggtctcacctctcctttaaccccgcccctctcctggccccgcctccaaccgtgaccattaatagtcaggccccgccccctcagctcagcctctcgaggagccgctgggagcagagccctctgagctgttgccgcgcccacctcgtccagccgcctgtctgtgcctaag

SEQ ID NO: 19554 - DNA, 201 bp, Homo sapiens
agagagagagagagagagagagagagaaagagagaaagaaagaaatttaaaaataaatataatgtatatttcgaatcacctgagggtcttgtgaaaatgcmgataccgacttcagtaggtctggagtaaggtctgagattctgcaattccagcaagtccacaggtgatggtgacgctctaggtctcaggacaactgtttga

SEQ ID NO: 19555 - DNA, 201 bp, Homo sapiens
ggtctgcgctccaggtgagcatgggcggggccctggaaaaacctgaggaaggtgccgggcccagcgtggtgaatcctggtgggggcggagcctggcccggwaggctggtggggcggggctaagaggggaggcgtggccaaggctctgagcacgtgggccggggcctggctcgaggaacaccaggtggagttgctggagcca

SEQ ID NO: 19556 - DNA, 201 bp, Homo sapiens
actccgccccttcctttgactccacccctctccgggtctcacctctcctttaaccccgcccctctcctggccccgcctccaaccgtgaccattaatagtcaggccccgccccctcagctcagcctctcgaggagccgctgggagcagagccctctgagctgttgccgcgcccacctcgtccagccgcctgtctgtgcctaa

SEQ ID NO: 19557 - DNA, 201 bp, Homo sapiens; identical to SEQ ID NO: 3052

SEQ ID NO: 19558 - DNA, 201 bp, Homo sapiens
cgtgatcactgagtgacgcctggggcggggaggccgaccgagagtcgggggcgagggctcccccaccgtccccctgcccccacgccacgtcgcccagcggmatcgtggaaagaggattctcccatgcaaaccccggagccagaggagaaggggaagcgccattctgcgccccctacccccggggcacggacacggccacag

SEQ ID NO: 19559 - DNA, 201 bp, Homo sapiens
gtttcttcatccaaagagaacagcaatgacttgaatcttaaatacttttgttttaccctcactagaggtccagagacctgtctttcattataagtgagacyagctgcctctctaaactaatagttgatgtgcattggcttctcccagaacagagcagaaccatcccaaatccctgagaactggagtctcctggggcaggct

SEQ ID NO: 19560 - DNA, 201 bp, Homo sapiens
ccagagacctgtctttcattataagtgagaccagctgcctctctaaactaatagttgatgtgcattggcttctcccagaacagagcagaaccatcccaaayccctgagaactggagtctcctggggcaggcttcatcaggatgttagttatgccatcctgagaaaggccccgcaggccgcttcaccaggtgtctgtctcct

SEQ ID NO: 19561 - DNA, 201 bp, Homo sapiens
gtctctgaatcaggtaagcaaatgactgtaattctcatgggactgctattcttacacagtggtttcttcatccaaagagaacagcaatgacttgaatcttmaatacttttgttttaccctcactagaggtccagagacctgtctttcattataagtgagaccagctgcctctctaaactaatagttgatgtgcattggctt

SEQ ID NO: 19562 - DNA, 201 bp, Homo sapiens
caaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggc

SEQ ID NO: 19563 - DNA, 201 bp, Homo sapiens
cctgcctgtgcttttctacctggatcaagtgatgtctacagagtagggcagtagcttcattcatgaactcattcaacaagcattattcactgagagccttstatttttcaggcatagtgccaacagcagtgtggacagtggtgcatcaaagcctctagtctcatagaacttagtcttctggaggatatggaaaacagacaa

SEQ ID NO: 19564 - DNA, 201 bp, Homo sapiens
tgttgtttttctctttggctgttttctctcacattgccttctctaaagctacagcctctcctttcttttcttgtccctccctggtttggtatgtgacctaraattacagtcagatttcagaaaatgattctctcattttgctgataaggactgattcgttatactgagggacagcagaactagtttcctatgagggcatgg

SEQ ID NO: 19565 - DNA, 201 bp, Homo sapiens
cattcatttgctaagagtctggtgttctaccacctgaactaggctggccacaggaattataaaagctgagaaattctttaataatagtaaccaggcaacaycattgaaggctcatatgtaaaaatccatgccttcctttctcccaatctccattcccaaacttagccactggcttctggctgaggccttacgcatacctcc

SEQ ID NO: 19566 - DNA, 201 bp, Homo sapiens
accttcatttacatctcatatgtttgtaaataagcccaataggcagacacctctaacaaggtgacactgtcctctttccttcctaccacagcccccacctrcccaccccactcccattgattccagaggcgtgcctaggcaggatctatgagaaaatataacagagagtaagaggaaaattaccttctttctttttccttt

SEQ ID NO: 19567 - DNA, 201 bp, Homo sapiens
cagacacctctaacaaggtgacactgtcctctttccttcctaccacagcccccacctgcccaccccactcccattgattccagaggcgtgcctaggcaggmtctatgagaaaatataacagagagtaagaggaaaattaccttctttctttttcctttccctgcctgaccttattcacctcccatcccagagcatccattt

SEQ ID NO: 19568 - DNA, 201 bp, Homo sapiens
tgaatgaagagcctatagcatcatgttacagccatagtcctaaagtgctgtttctcatgaaggccaaatgctaagggattgagcttcagtcctttttctamcatcttgttctctaacagaattctcttcttttcttcataggagatgcctgagatacccaaaaccatcacaggtagtgagaccaacctcctcttcttctgg

SEQ ID NO: 19569 - DNA, 201 bp, Homo sapiens; identical to SEQ ID NO: 3068

SEQ ID NO: 19570 - DNA, 201 bp, Homo sapiens; identical to SEQ ID NO: 3069

SEQ ID NO: 19571 - DNA, 201 bp, Homo sapiens
gacatattaaatgatttactcagatttacccagaagccaatgaagaacaatcactctcctttaaaaagtctgttgatcaaactcacaagtaacaccaaacyaggaagatctttattatctctgataacatatttgtgaggcaaaacctccaataagctacaaatatggcttaaaggatgaagtttagtgtccaaaaacttt

SEQ ID NO: 19572 - DNA, 201 bp, Homo sapiens
agggtgctaagatagagaaaagtgggagagtgctatttagacaaagtggtaaaaacaaagccccttgtgagatgagagctgccgacagagggggcgggtcrtggttgtgggtttttgggtaggacattcagaggagggggcgggtcgtggttgtgggtttttgggtaggacattcagaggagggggcgggtcgtggttgtg

SEQ ID NO: 19573 - DNA, 201 bp, Homo sapiens
cacataagcaacaacaaggataatcctagaaaaccagttctgctgactgggtgatttcacttctctttgcttcctcatctggattggaatattcctaataycccctccagaactattttccctgtttgtactagactgtgtatatcatctgtgtttgtacatagacattaatctgcacttgtgatcatggttttagaaatc

SEQ ID NO: 19574 - DNA, 201 bp, Homo sapiens
aaagatgtatagaattccattcctgacttccaggtatttacaccataggtggggacctaactacacacacacacacacacacacacacacacacacacacmccatgcacacacaatctacatcaacacttgattttatacaaatacaatgaatttactttctttttggttcttctcttcaccagtgaaatttgacatgggt

SEQ ID NO: 19575 - DNA, 201 bp, Homo sapiens
gtctcctaacgtgatgtgttgtggttgtcttctctgacaccagcatcagaggttagagaaagtctccaaacatgaagctgagagagaggaagcaagccagytgaaagtgagaagtctacagccactcatcaatctgtgttattgtgtttggagaccacaaatagacactataagtactgcctagtatgtcttcagtactgg

SEQ ID NO: 19576 - DNA, 201 bp, Homo sapiens
gcaaaggtattgtcctcacatctctggctattaaagtattttctgttgttgtttttctctttggctgttttctctcacattgccttctctaaagctacagyctctcctttcttttcttgtccctccctggtttggtatgtgacctagaattacagtcagatttcagaaaatgattctctcattttgctgataaggactgat

SEQ ID NO: 19577 - DNA, 201 bp, Homo sapiens
tagagacggagtttcaccgtggtctccatctcctcgtgatccacccaccttggcctcccaaagtgccgggattacaggcgtgagccaccgcgcccggcctdttattattattattactactactactacctatatgaatactaccagcaatactaatttattaatgactggattatgtctaaacctcacaagaatcctacc

SEQ ID NO: 19578 - DNA, 201 bp, Homo sapiens
atcccactaatgaaattataagagattcaacacttattcagccccgaaggattcattcaacgtagaaaattctaagaacattaaccaagtatttacctgcytagtgagtgtggaagacattgtgaaggacacaaagatgtatagaattccattcctgacttccaggtatttacaccataggtggggacctaactacacaca

SEQ ID NO: 19579 - DNA, 201 bp, Homo sapiens
gagtctggctctgtcacccaggctggagtgcagtggcgcaatctcggctcactgcaagctctgcctcctgggttcatgccattctcctgcctcagcctccygagtagctgggaatacaggcacccgccactgttcccggctaattttttgtatttttagtagagacggagtttcaccgtggtctccatctcctcgtgatcc

SEQ ID NO: 19580 - DNA, 201 bp, Homo sapiens
acccaataaatgttagctattactatcattattattattattttattttatttttttgagatggagtctggctctgtcacccaggctggagtgcagtggcrcaatctcggctcactgcaagctctgcctcctgggttcatgccattctcctgcctcagcctcctgagtagctgggaatacaggcacccgccactgttcccg

SEQ ID NO: 19581 - DNA, 201 bp, Homo sapiens
agatatgaattactctacctatgtgtatgtgtagaagtccttaaatttcaaagatgacagtaatggccatgtgtatgtgtgtgacccacaactatcatggycattaaagtacattggccagagaccacactgaaataacaacaattacattctcatcatcttattttgacagtgaaaatgaagaagacagttcctccattg

SEQ ID NO: 19582 - DNA, 201 bp, Homo sapiens
tgtgtttgtacatagacattaatctgcacttgtgatcatggttttagaaatcatcaagcctaggtcagcaccttttagcttcctgagcaatgtgaaatacractttatgaggatcatcaaatacgaattcatcctgaatgacgccctcaatcaaagtataattcgagccaatgatcagtacctcacggctgctgcattaca

SEQ ID NO: 19583 - DNA, 201 bp, Homo sapiens
acttatgatctaacaaattacagggtcttatcccactaatgaaattataagagattcaacacttattcagccccgaaggattcattcaacgtagaaaattytaagaacattaaccaagtatttacctgcctagtgagtgtggaagacattgtgaaggacacaaagatgtatagaattccattcctgacttccaggtattta

SEQ ID NO: 19584 - DNA, 201 bp, Homo sapiens
tttccctgtttgtactagactgtgtatatcatctgtgtttgtacatagacattaatctgcacttgtgatcatggttttagaaatcatcaagcctaggtcakcaccttttagcttcctgagcaatgtgaaatacaactttatgaggatcatcaaatacgaattcatcctgaatgacgccctcaatcaaagtataattcgagc

SEQ ID NO: 19585 - DNA, 201 bp, Homo sapiens
cctctaaaacatccaagcttaccttcaaggagagcatggtggtagtagcaaccaacgggaaggttctgaagaagagacggttgagtttaagccaatccatyactgatgatgacctggaggccatcgccaatgactcagaggaaggtaaggggtcaagcacaataatatctttcttttacagttttaagcaagtagggacag

SEQ ID NO: 19586 - DNA, 201 bp, Homo sapiens
taattctcatgggactgctattcttacacagtggtttcttcatccaaagagaacagcaatgacttgaatcttaaatacttttgttttaccctcactagagrtccagagacctgtctttcattataagtgagaccagctgcctctctaaactaatagttgatgtgcattggcttctcccagaacagagcagaaccatcccaa

SEQ ID NO: 19587 - DNA, 201 bp, Homo sapiens
ctgagaactggagtctcctggggcaggcttcatcaggatgttagttatgccatcctgagaaaggccccgcaggccgcttcaccaggtgtctgtctcctaaygtgatgtgttgtggttgtcttctctgacaccagcatcagaggttagagaaagtctccaaacatgaagctgagagagaggaagcaagccagttgaaagtga

SEQ ID NO: 19588 - DNA, 201 bp, Homo sapiens
tcatactaactatgcctccttggtcatgttacataatcttttcgtgattcagtttcctctactgtaaaatggagataatcagaatcccccactcattggaytgctgtaaagattaagagtctcaggctttacagactgagctagctgggccctcctgactgttataaagattaaatgagtcaacatcccctaacttctgga

SEQ ID NO: 19589 - DNA, 201 bp, Homo sapiens; identical to SEQ ID NO: 3066

SEQ ID NO: 19590 - DNA, 201 bp, Homo sapiens
tactaactatgcctccttggtcatgttacataatcttttcgtgattcagtttcctctactgtaaaatggagataatcagaatcccccactcattggactgytgtaaagattaagagtctcaggctttacagactgagctagctgggccctcctgactgttataaagattaaatgagtcaacatcccctaacttctggacta

SEQ ID NO: 19591 - DNA, 201 bp, Homo sapiens
ggttttagaaatcatcaagcctaggtcagcaccttttagcttcctgagcaatgtgaaatacaactttatgaggatcatcaaatacgaattcatcctgaatracgccctcaatcaaagtataattcgagccaatgatcagtacctcacggctgctgcattacataatctggatgaagcaggtacattaaaatggcaccagac

SEQ ID NO: 19592 - DNA, 201 bp, Homo sapiens
catgggggtggggtaaggaaaagaagtggaaagaaacagacagaattgggttatattttggagatagaaccaacagaaggaagaggagaaacaacatttastgagaagggaaaaagtaggagaggaataggtttgggaaataaatcctgctgacattggaaaccccaaggaagcctcaaaagtatatttacttgctttaga

SEQ ID NO: 19593 - DNA, 201 bp, Homo sapiens
agccatgaggatttgtgacgctattgatatgtgccactttgcactctctgtgacatatataattatttttaatgcattctttttttctcagagtgcattcrtttgaaaacatagacgggaaatactggtagtcttccttgtcagttagaaacacccaaacaatgaaaaatgaaaaagttgcacaaatagtctctaaaaaca

SEQ ID NO: 19594 - DNA, 201 bp, Homo sapiens
gtttaaaaagaagcacataagcaacaacaaggataatcctagaaaaccagttctgctgactgggtgatttcacttctctttgcttcctcatctggattggmatattcctaatatcccctccagaactattttccctgtttgtactagactgtgtatatcatctgtgtttgtacatagacattaatctgcacttgtgatcat

SEQ ID NO: 19595 - DNA, 201 bp, Homo sapiens; identical to SEQ ID NO: 3070

SEQ ID NO: 19596 - DNA, 201 bp, Homo sapiens
actagaggtccagagacctgtctttcattataagtgagaccagctgcctctctaaactaatagttgatgtgcattggcttctcccagaacagagcagaacyatcccaaatccctgagaactggagtctcctggggcaggcttcatcaggatgttagttatgccatcctgagaaaggccccgcaggccgcttcaccaggtgt

SEQ ID NO: 19597 - DNA, 201 bp, Homo sapiens
ggagaggtggcttgatttacatttaatctctgcaatttattagagtcctgtagttggatttactttgaagagagtttcccagaagaataaaatttgctgcrttgctttttgggtgtgagctgcttttgtatttgcctaatgcctttaatgcaaatttctttctttctctcttgcttttttttaaaaaaaatagaaatgttt

SEQ ID NO: 19598 - DNA, 201 bp, Homo sapiens
tttcttaagattatctatggatggttctccaactaggattgcgtatgggacacaagggagctctggttactctttgagattgtgtaacactggggacaackctggtgagtaacctcactttttcgtggacctgtcagggatgtctgtcatgttgatagtttgcttagtcttaaggaattatgtgtcttgttctccttggtt

SEQ ID NO: 19599 - DNA, 201 bp, Homo sapiens
taaagcggggatggtattcacaacatttaacttatagggtccaagcactgaccaacctgaccattagaacagagtgtggtctctgtacagggcagatggcrctgagtgggtattctccacagaaagagaaacgaagacagtaccccactcctccaacccaccacccaccaccaatcccaccaccaattccaccaccaatcc

SEQ ID NO: 19600 - DNA, 201 bp, Homo sapiens
gaagattaagtgacacatttaaaatgcttagtactgtgtgtagaacataaacacttcaaaaaatgtaaactgtgatttctatattcaataagaaatgtagmaatggacaaagcatataaaaagcaaaagaaatactagaagacacttgatttttctcaaaaataaacacaccaagtatttttgttttagtgaaattcatgc

SEQ ID NO: 19601 - DNA, 201 bp, Homo sapiens
tttaacttatagggtccaagcactgaccaacctgaccattagaacagagtgtggtctctgtacagggcagatggcgctgagtgggtattctccacagaaasagaaacgaagacagtaccccactcctccaacccaccacccaccaccaatcccaccaccaattccaccaccaatcctgccacccaccaccaatctcaccac

SEQ ID NO: 19602 - DNA, 201 bp, Homo sapiens
tacattttttgaaataaaaatactagattcaaaggtgtgaatatttttgaaggttttgtggtgtggtatcatgaaattaggtttcagaaagtttactccayagttgactttttctaccagctaataagagtgctcatttaccccacttaggccaactctaacaggcttctgttgctttgcatcctgacatatttatctttc

SEQ ID NO: 19603 - DNA, 201 bp, Homo sapiens
caaataagtaatatattttggagcttgctattcttctctttttatggtatttttgtgtgcacattcttatgctcttattcagttatttctgtagaatacawtttttgaaataaaaatactagattcaaaggtgtgaatatttttgaaggttttgtggtgtggtatcatgaaattaggtttcagaaagtttactccatagtt

SEQ ID NO: 19604 - DNA, 201 bp, Homo sapiens
accttgcatgtgactttaaggtggttggcctggaagaaaagtcccaagatgggaaatagtaggtgtcttttttactaaatgcactccaatttgggaccaaraattttcattcttgaaggctcagtattgtgagtttataagagataatagacataaaagtgtaatgatttcattgcaaataaaaaaaggcccctttgcacc

SEQ ID NO: 19605 - DNA, 201 bp, Homo sapiens
cctcccgggttcaagcgattctcctgcctcagcctcctgagtagctgggattacaggcgcgcgccacacctggctaatttttgtatttttagtagagacgrggtttcatcatgttggtcaggctggtctcgaactcctggcctcaagggatccacccacctcggcctcccgaagtgctgggattacaggtgtgggccactg

SEQ ID NO: 19606 - DNA, 201 bp, Homo sapiens
gcgcgccacacctggctaatttttgtatttttagtagagacgaggtttcatcatgttggtcaggctggtctcgaactcctggcctcaagggatccacccayctcggcctcccgaagtgctgggattacaggtgtgggccactgtgcccagctgtatagagatattttaaacaacactaaagtcctcctactttgactaatt

SEQ ID NO: 19607 - DNA, 201 bp, Homo sapiens
ccaactaggattgcgtatgggacacaagggagctctggttactctttgagattgtgtaacactggggacaactctggtgagtaacctcactttttcgtggwcctgtcagggatgtctgtcatgttgatagtttgcttagtcttaaggaattatgtgtcttgttctccttggttagaagggactttgattcacttctaattc

SEQ ID NO: 19608 - DNA, 201 bp, Homo sapiens
atagagaagctctttcattcaatgcgaaaggtcaaaggcacatcagtttctttaataatgcaaacctcagcacacattatcagtgtcctcattattattgscttgtttatttcccactgctcattgataatttcaacgtgaaatttacctgtattgctgcatgcatcttgcagtttaagaagtgaagtaacccaatttcaa

SEQ ID NO: 19609 - DNA, 201 bp, Homo sapiens
ggcacatcagtttctttaataatgcaaacctcagcacacattatcagtgtcctcattattattgccttgtttatttcccactgctcattgataatttcaaygtgaaatttacctgtattgctgcatgcatcttgcagtttaagaagtgaagtaacccaatttcaaagctagtgctttagggaaaatattggattgtattta

SEQ ID NO: 19610 - DNA, 201 bp, Homo sapiens
cccaatttcaaagctagtgctttagggaaaatattggattgtatttacttcaagcagagttcgataatttatgtacataataaaaattttaaatcccttasttaatatagcagttgccaaaactgggctattatcattctaaactaccaacccaaatggtagtgggtatctaatctacctctagaaagaaaatggactgta

SEQ ID NO: 19611 - DNA, 201 bp, Homo sapiens
tggagtggatgtcaggtggatcagagagatacagtcatgggggtgggggccagcctaaaacagtaaggtcaagttgtttgaacagaaaggctacagggcgyggtcctggctcttgtgtaagaattttgactgcgcagccctgcacttcggctgtgtgtaatgaaaagggttgggatgagttagggagagctagtgtgggag

SEQ ID NO: 19612 - DNA, 201 bp, Homo sapiens
attatttatgatatatgtcacaatctatgcatgtgctatttaagaggggcaaatatacatgcaataattgtgctagaatataaaaacattagacttctttrtcattgggatgatgatatcaagatttctttgttagatttatttcagatagaaaaggggatacgaaaaatgcaggcacatgagatacttggagaactttaa

SEQ ID NO: 19613 - DNA, 201 bp, Homo sapiens
ttcaaaatcaattgtctataaatgtaagagtttatttttggaccatcagttctatcctgttgacctatatatgcctatcctaatgccagttacacacagtyttgattaccataactttgcagtaagttttgaactcagacagtctgagtgcttttattttgtcctttttcaagattaatttggttattccggatcttttgc

SEQ ID NO: 19614 - DNA, 201 bp, Homo sapiens
ttggccagatttctggcacttgaaacaagatcctgatggaggaggtcctgtaggaatgcttgaccactgcagtttaggcattttgaagtttttgtgtgtgstggagatgtggctgggttttgtctcacagcagaggcaaggaatcgcaactcagaaatacattgctacttggctgcctctattattgtacaccttgaaggc

SEQ ID NO: 19615 - DNA, 201 bp, Homo sapiens
cctgacttcttgacagttctgaatttagtggagcaatgaggttcagctttggtgaatgagcttaatttttccatgataaactgctagtttcttcccactayagtgtctctcaaaaatgggacagcaacattctttttgttttcacttgcagtaagcatgatgcaattacataaatgtacacttttcaatttgttaaataga

SEQ ID NO: 19616 - DNA, 201 bp, Homo sapiens
gcaacacagtgagaccccgtctctacataaaattagaaaaaaacaattaactgggtgtggtggtgtgcacctgtagtcccagctagtcaagaggctgagayaagaggatctcttgagcccaggagctcaaggctgtagtgagccaagatcgtgccactgcacacaaacaattatgtgacctcgggcaagttgctttacctc

SEQ ID NO: 19617 - DNA, 201 bp, Homo sapiens
ttagagcctttctgtttctctcaatagggttggagagttatccttatcttctttttattggggcttaagaagagagatgaggttccatggagtaaacaatwcaaggatataaggacctcatataatctcacgtatccattttccatgaaagccattcttggcacgaatttgccattctatgtttgagcctcataaaaggca

SEQ ID NO: 19618 - DNA, 201 bp, Homo sapiens
ctcttaatttccttatctgtaaaatgaggatgataatttcttcctgggtctgttgtaataattaatacatcaaagcacttcatgtctggaacagtgaagayaccctgctatgactattaaggatagtatacatggaataagacacaggaacttctaaatgcttttgaccatagatttaggttctgagttttaagaatttaa

SEQ ID NO: 19619 - DNA, 201 bp, Homo sapiens
gtgacaaaatacaagcaaatttagcctcgtgtcatttcctaaggaacatcttctctctgtgagttcacaggttgccacatgaacatcttccagcatcttgmgttctcagatgtggatgttgccagggttctcactccagatgcttttgtgtgtcggaccatctgcacctatcaccccaactgcctcttctttacattctat

SEQ ID NO: 19620 - DNA, 201 bp, Homo sapiens
aaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaatttt

SEQ ID NO: 19621 - DNA, 201 bp, Homo sapiens
tgaatatataaagcaaaaaaatgaaaagtgagaacttccaggctttggattgttgtaggtgataaatataaaatgggatttctggggggctgctactgagwtgaggggatggcagaaaacatggaagcaaggtctctggtcagcccagggtgctgggcttgtcccaacaccacgtaggcaataagaggacagtacagggtg

SEQ ID NO: 19622 - DNA, 201 bp, Homo sapiens
cacgtaggcaataagaggacagtacagggtgccgtctctctccctcttcctctctctgtctctctctctgtgtgtgtgtgtgtgtgtgtgtgtaacactaycttcccaatttttactgtctatttgtattcaaagataaggtccttatgaaaaatacactgctctgattcactttaaaacttatttccatatttattattt

SEQ ID NO: 19623 - DNA, 201 bp, Homo sapiens
tccagcctgggcgacagagcaagactccatctcacaaaaaaataataaaaataaaataaaaaaaaaaaagaaaggctgtctttctcctttcccattggccrtctttctccattccctactcctccaatcccctggcaaccactaaatctactttccatgtctgtggacttgactcttcgggacattttacataaatggaat

SEQ ID NO: 19624 - DNA, 201 bp, Homo sapiens
actgtctatttgtattcaaagataaggtccttatgaaaaatacactgctctgattcactttaaaacttatttccatatttattatttattgtgggaataayaatattcccaatattattatttattatttaagttattattattaacttccctctgaggttatatattggttactcacaggtgaaatccaaaatattctac

SEQ ID NO: 19625 - DNA, 201 bp, Homo sapiens
ctcacaggtgaaatccaaaatattctacaaaaggtaaatattcctttggtaacaaatgaagaatgccagaaaagatatcaagattataaaataacccaacrgatggtctgtgctggctataaagaagggggaaaagatgcttgtaaggtaactcatgagattatgaaaaacacaataggctgcttgagaaaattcatttca

SEQ ID NO: 19626 - DNA, 201 bp, Homo sapiens
ttgtaaggtaactcatgagattatgaaaaacacaataggctgcttgagaaaattcatttcaaaatatattttccaatagcataatttaatcatagtttttwaaaaaattcagagacaaatgatctgataaattgataagcaacttttaacaaattgaatatacataatatatatttatattatttatgatatatgtcacaa

SEQ ID NO: 19627 - DNA, 201 bp, Homo sapiens
gcagtcacttatttgaatcccattgtcgtaactttctactattttatttttccactgtgactcagggagattcaggtggtcccttagtttgcaaacacaayggaatgtggcgtttggtgggcatcaccagctggggtgaaggctgtgcccgcagggagcaacctggtgtctacaccaaagtcgctgagtacatggactgga

SEQ ID NO: 19628 - DNA, 201 bp, Homo sapiens
tattgtacaccttgaaggcgaggttaattaagtcctcttgtggggtttgagggctggaatctaatttttggagttttttgttttttgttttttgttttttkttttttaatgtcaggagctgactgggtgataaaatgcatattgagaataagaggccttctgacccttctgggtctagggctgtaaagcgtctcagggttg

SEQ ID NO: 19629 - DNA, 201 bp, Homo sapiens
ggcacctcagaccgtttgcccattttatgacaagaattatctagatcttgtaggatggaaaaatcgaaagtgccgttttctggctatttggaaccattgtygagtttgtattggggttaagcagcattgcagaagaaaataaggcatttaggttttaggtcaggtgtgagttgaagaggttttaagttcttgagaacatag

SEQ ID NO: 19630 - DNA, 201 bp, Homo sapiens
gagatactttaaaggacattttttcacttaggatgtttagtactatgaataataaatagtcacaatttccttaactatggtgacaaaatacaagcaaattyagcctcgtgtcatttcctaaggaacatcttctctctgtgagttcacaggttgccacatgaacatcttccagcatcttgcgttctcagatgtggatgttgc

SEQ ID NO: 19631 - DNA, 201 bp, Homo sapiens
tttaaaggacattttttcacttaggatgtttagtactatgaataataaatagtcacaatttccttaactatggtgacaaaatacaagcaaatttagcctcrtgtcatttcctaaggaacatcttctctctgtgagttcacaggttgccacatgaacatcttccagcatcttgcgttctcagatgtggatgttgccagggtt

SEQ ID NO: 19632 - DNA, 201 bp, Homo sapiens
gtagaagctagtcattttctattcaaagcctcaaaatgcttgaatatcattgggctaagggattgtctcaagaaagagtctaacaggtgaacatttcatcygaataaagaaacagatttaactgtgtgacccatgatcacattagcggatagcacagtccaaagaaaataacataagacaagcattttgctgagaatgtaa

SEQ ID NO: 19633 - DNA, 201 bp, Homo sapiens
tagtcacaatttccttaactatggtgacaaaatacaagcaaatttagcctcgtgtcatttcctaaggaacatcttctctctgtgagttcacaggttgccamatgaacatcttccagcatcttgcgttctcagatgtggatgttgccagggttctcactccagatgcttttgtgtgtcggaccatctgcacctatcacccca

SEQ ID NO: 19634 - DNA, 201 bp, Homo sapiens
cactcctccaacccaccacccaccaccaatcccaccaccaattccaccaccaatcctgccacccaccaccaatctcaccaccaatcccaccaccaatcctrccacccaccatcaatctcagcaccaatcccaccaccaatcccaccaccaatcccaccacctaccccaccaccaatcccgccacccacgaccaatcccacc

SEQ ID NO: 19635 - DNA, 201 bp, Homo sapiens
tagagctgggaataattccaaacagcaaatagttcaaaatttattttcaatttagcatatgcatgcatttgcttaaactgtcttaaaaatgagtaaaaaayactgtcagtttgtttcaatcatactgagatgaggaacaatgtttagcattgcatgctagaaaaggacacaggattgggagtcagggctgggtgaccgtca

SEQ ID NO: 19636 - DNA, 201 bp, Homo sapiens
gttgaggggatggcagaaaacatggaagcaaggtctctggtcagcccagggtgctgggcttgtcccaacaccacgtaggcaataagaggacagtacagggkgccgtctctctccctcttcctctctctgtctctctctctgtgtgtgtgtgtgtgtgtgtgtgtaacactatcttcccaatttttactgtctatttgtatt

SEQ ID NO: 19637 - DNA, 201 bp, Homo sapiens
tcccatctgatatctttttgtgtttataattgacacagaaccctgccattctaaaatttacccgggagttgactttggaggagaagaattgaatgtgactkttgttaaaggagtgaatgtttgccaagagacttgcacaaagatgattcgctgtcagtttttcacttattctttactcccagaagactgtaaggaagagaa

SEQ ID NO: 19638 - DNA, 201 bp, Homo sapiens
tttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgta

SEQ ID NO: 19639 - DNA, 201 bp, Homo sapiens
taaaacttagtatccaaaggcggaagtacttaaccatacctaggaagaaaaggagttgttttgtagaaggggttggggtttgggagatgagccagacacartcagcagggagagcacatgtgttttcatgaagaattatgccgagataggtaatggatgaggaagaaatttgggcttgactgaagtaatgggggctgtcct

SEQ ID NO: 19640 - DNA, 201 bp, Homo sapiens
aggaatggcaagaggagtggctaaaggatttaggatctttggggtcagctagctttgcttttgtgagtttatataatggtttagtcaggatggtaaaactwagtatccaaaggcggaagtacttaaccatacctaggaagaaaaggagttgttttgtagaaggggttggggtttgggagatgagccagacacaatcagcag

SEQ ID NO: 19641 - DNA, 201 bp, Homo sapiens
tcctgtaggaatgcttgaccactgcagtttaggcattttgaagtttttgtgtgtgctggagatgtggctgggttttgtctcacagcagaggcaaggaatcrcaactcagaaatacattgctacttggctgcctctattattgtacaccttgaaggcgaggttaattaagtcctcttgtggggtttgagggctggaatctaa

SEQ ID NO: 19642 - DNA, 201 bp, Homo sapiens
ggctaagggagaagaaggaggaatggagggtggaaagttgcctatagtgaaggaggcaagcccagagaaaagagagggtagagacatggagagaaggggtsggggggtgcttgcccccaggaaagtggttcttgccactaagggtgaaggatcaaggcaggcattcgcgcggtgatcagatacctctgaaacgtgggtgaa

SEQ ID NO: 19643 - DNA, 201 bp, Homo sapiens
gggaggtcccctgatctgagtcacagcaccaaatatcacgtgtgtccatgcgaagagaccaccaaacaggctttgtgtgagcaagaaagctttttaatcayctgggtgcaggcgggctgagtccaaaaagagagtcagtgaagggagataggggtggggacgttttataggatttgggtaggtagtggaaaattacagtca

SEQ ID NO: 19644 - DNA, 201 bp, Homo sapiens
aggtaagcatgacgctttaaatattgcttctagagtaagtctcacatgttgaaatacatggagtgggtcgttttaatcggtttctgtctgaaattatatckaaactctttatctttcctatctatttattcccaaatatttattcagttattcttaaaaaatgtatttttgctttggcttgaaaaaaaattttagggagac

SEQ ID NO: 19645 - DNA, 201 bp, Homo sapiens
atggtgtgtgtgtgtatgtgtgcttgtgcttgtgtgaatatgtattattaactggaaatttgtaaaagtattggaaaaatagtacttacgattttgtgtgygtgtgtgatggagtctcgctttgtagcccaggctggagtgcagtggcgtgatctcggctcactgcaacttccacctcccaggttcaagcgattctcctgc

SEQ ID NO: 19646 - DNA, 201 bp, Homo sapiens
caagtaattcacatttttagattttttattggtaatctgagacaagaagaaatttaaagtaatcttcactaagccatgaaagctcccaacattgttctccrtgagagatgctggcctgcatttattcaaaaacaaaagacccctctgttgccaaagctcggagggcttttcagaaacgatatagttgtaaattataatttt

SEQ ID NO: 19647 - DNA, 201 bp, Homo sapiens
cttttatctcagtctttgagtattgatcatggggtgttggaacaggactttggaatgcttgcagggtaaacctttggcctctgttagtcagggaatgaccyagtttggcaaaacagaggagagttttgaaatatggaactttcccgaggcatacattgtcattttaaagtggtcaatcaaagcccagtaggactgggctgg

SEQ ID NO: 19648 - DNA, 201 bp, Homo sapiens
tgatatccggttgcttctcactaggagaaggatgaaagatgacagagcatttataaccaccatttgttattttcattatcaactgacactggtgtttctcygcccggagcgattttgtcctcccttcacctcaggaaacattcggcaacgtctagagacacttttggttgtcctaatgggagagggtatgcaactggctgt

SEQ ID NO: 19649 - DNA, 201 bp, Homo sapiens
tccaaccattagcgtcaacgctctcttttcagtctgcacaacaaaaacaagcacacgcattgttggaggaacaaactcttcttggggagagtggccctggyaggtgagcctgcaggtgaagctgacagctcagaggcacctgtgtggagggtcactcataggacaccagtgggtcctcactgctgcccactgctttgatgg

SEQ ID NO: 19650 - DNA, 201 bp, Homo sapiens
ctatgtatttccttcccagttctttgaaagagagtgataggaaaaaggaacactattgaaggaaggactgcccagtttcaaacaggtatttatttttctcycctaggcttcccctgcaggatgtttggcgcatctatagtggcattttaaatctgtcagacattacaaaagatacacctttctcacaaataaaagagatta

SEQ ID NO: 19651 - DNA, 201 bp, Homo sapiens
aacccatctctacaaaaaaatatgaaagtatctgtgtgtgtgtgttgctgtgtagtggactacagaactttagaggcagtcacttatttgaatcccattgycgtaactttctactattttatttttccactgtgactcagggagattcaggtggtcccttagtttgcaaacacaacggaatgtggcgtttggtgggcatca

SEQ ID NO: 19652 - DNA, 201 bp, Homo sapiens
aatccccagggggtaggatagtgcagagaagatggcactctccagtgcttaataaaatgcacgtggtctaagctgcccactccctcaaaggcaataaaaawtaggtactatttaaattgaagagtaactactgccccagggaatggacaggttgtcattggaatagccatggttaatggtcccagttgacaactgaaatga

SEQ ID NO: 19653 - DNA, 201 bp, Homo sapiens
ctccatgttttgtgcatacatgaaatctaggcaatacacttgtattcccaaaagcttccacttgaagagatctgtgctctttccaaatataaaccttaccygagaggtggtcatcttggccacacctcagagagggagagaggcagtcttgttgggttgggtggtcataatggggctcagggccaaatccccagggggtag

SEQ ID NO: 19654 - DNA, 201 bp, Homo sapiens
actttatgagaaaattaatcatttatattctaatttcctgagtatgtagagagtatagataatgttcctttatgtagaaatatttaaatgtaagatgattytaaatcagaaagaatatttgattgatttaaaatttttaaatgggctttaatattttcagaggttttctttacttagggatttttggactgacattattgc

SEQ ID NO: 19655 - DNA, 201 bp, Homo sapiens
gcaaaataaatcatgattatggctaggaaaatcagggatgtaagtaagcaaaaatttagaaactacatattgcatgtagtccccaaattcagaaacagtcrtcgttaaacatcttttatttagtctttcagatatttttctacatatacctatttgcacatttcacaaaaaagagttattaactgtggacactctttgact

SEQ ID NO: 19656 - DNA, 201 bp, Homo sapiens
aactccgtggtttttagtatatccacctgattgcacaacgatcaccactgtctagttccagaacatttttatcaccacaaaagaaaggctgtatccaggcygggcacggtggctcacgcctgtaatcccagcactttgggaggctgaggcgggcggatcacggggtcaggagattgaaaccatcctgggtaacacggtgaa

SEQ ID NO: 19657 - DNA, 201 bp, Homo sapiens
ccactgtctagttccagaacatttttatcaccacaaaagaaaggctgtatccaggctgggcacggtggctcacgcctgtaatcccagcactttgggaggcygaggcgggcggatcacggggtcaggagattgaaaccatcctgggtaacacggtgaagccctatctgtactaaagatacaaaaaaattagctgggcatggt

SEQ ID NO: 19658 - DNA, 201 bp, Homo sapiens
gtgctatttctgattgttgtatcttgtagcaaaatttaaagaaaaagtaatttgtgcctttctcaatattcctgttattgttcatgtattctaaaactcastgttactcacttagcttgcttttaatgttttttaaagtgaaaaattgttcccaagtacataaaatctctacactcaagaacaattctagtcaaaagcatt

SEQ ID NO: 19659 - DNA, 201 bp, Homo sapiens
ctgaggcgggcggatcacggggtcaggagattgaaaccatcctgggtaacacggtgaagccctatctgtactaaagatacaaaaaaattagctgggcatgrtggcagatgcctgtagtcccagctactcaggaggctgaggcaggagaatggcctgaacccaggaagcggagcttgcagtgagccaagattgcgccactgc

SEQ ID NO: 19660 - DNA, 201 bp, Homo sapiens
ctttttaagtaaatgaaagtatttgcaaaaataattaccaattgagaacatagttgcctgaaagtttaagaacacaggaaaaatcattaactctttaatayggttgatttcctgtacttaaaaaatgtgagtgtaaagaaaacgcagtgatggagttagatattatggggtgttataaaattagctctaagagtgttcttt

SEQ ID NO: 19661 - DNA, 201 bp, Homo sapiens
cagttacttcaggccatctggatgtatgcatgtaggcttgggcccagaggcctgacatttaacatggataaatgtaaagttcttagaatcatacatacacwttggaaaagatggggcttaatcgcactttataagacttgaaggatgtttgagaatcactatgaaactgctgaaaataccaagaaaatttaattcttatgt

SEQ ID NO: 19662 - DNA, 201 bp, Homo sapiens
tgtgatgaaacccatctctacaaaaaaatatgaaagtatctgtgtgtgtgtgttgctgtgtagtggactacagaactttagaggcagtcacttatttgaaycccattgtcgtaactttctactattttatttttccactgtgactcagggagattcaggtggtcccttagtttgcaaacacaacggaatgtggcgtttggt

SEQ ID NO: 19663 - DNA, 201 bp, Homo sapiens
ggctaagacaggagtagccaagcaagtggcaccacccctggagaaagctattgaacatacagcttcgggggtggagattgtccctgatgattcaggacacrtgtctatttaatgttccacaacaaggaccacttgtcaggtatattgctgtagacatatgttgcagaccagaggaaggagctcagaagtaggaatgtcttg

SEQ ID NO: 19664 - DNA, 201 bp, Homo sapiens
gcaggcacatgagatacttggagaactttaagaaagagtgagtgtgtgtgtgtgtgtgtgtgtgtgtgtgtgtgtctggcaagcaaggtcttgcacacacrcagcactttgggaggccaatgcaggtggatcacttgagcctaggaatttgagaccagtctgggcaatgtgatgaaacccatctctacaaaaaaatatgaa

SEQ ID NO: 19665 - DNA, 201 bp, Homo sapiens
tctggaggtctcaatttgtatcttgggaagcattataaattttccaactccctagacacaaatgtaccaaaaaaaaacccttgttttctataccagtaatygtgtgctttgtcttgcaattcagacatttacaagaaaatctaaatcaccttaaattaagatttatgttaaatgtggtctaaaaccagcagagttatgtat

SEQ ID NO: 19666 - DNA, 201 bp, Homo sapiens
aatgaacaataaacacaacagtagtctggaggtctcaatttgtatcttgggaagcattataaattttccaactccctagacacaaatgtaccaaaaaaaamcccttgttttctataccagtaattgtgtgctttgtcttgcaattcagacatttacaagaaaatctaaatcaccttaaattaagatttatgttaaatgtgg

SEQ ID NO: 19667 - DNA, 201 bp, Homo sapiens
aatttttattaggtcagagagatgcttattaatcacgagccacagtttcttcttaatgatttttccttttgattaatatccagagtaagcttttctttgttgttcccatttccatgttcataactctttactcatcttcactctatgtgagtttaccaactagaaattggatagtcattctctgatcccacatgttaaact

SEQ ID NO: 19668 - DNA, 201 bp, Homo sapiens; identical to SEQ ID NO: 3072

SEQ ID NO: 19669 - DNA, 201 bp, Homo sapiens; identical to SEQ ID NO: 3075

SEQ ID NO: 19670 - DNA, 201 bp, Homo sapiens
ggagaaaatgtgtcctatgtatttccttcccagttctttgaaagagagtgataggaaaaaggaacactattgaaggaaggactgcccagtttcaaacaggwatttatttttctctcctaggcttcccctgcaggatgtttggcgcatctatagtggcattttaaatctgtcagacattacaaaagatacacctttctcaca

SEQ ID NO: 19671 - DNA, 201 bp, Homo sapiens
gggggaaaagatgcttgtaaggtaactcatgagattatgaaaaacacaataggctgcttgagaaaattcatttcaaaatatattttccaatagcataattyaatcatagttttttaaaaaattcagagacaaatgatctgataaattgataagcaacttttaacaaattgaatatacataatatatatttatattatttat

SEQ ID NO: 19672 - DNA, 201 bp, Homo sapiens
acattttacataaatggaatcatgcaatgcagcacattttgcatctggcttttttcacctggcgtgttttcaaggctcattcgtattctagcatatatcartactttgttcctatttaggactaaataagattctattgtatgaataaaacatattttgtttatatacttagtttgatgaacatttgagttgtttctggat

SEQ ID NO: 19673 - DNA, 201 bp, Homo sapiens
tacatttaggcatttgatgcattttaaattaaattttgtatatggtgtaaagtagcaatccaacttaattcttgcatgtgggtattcagttattccattgycttgaaacccttttcaaaatcaattgtctataaatgtaagagtttatttttggaccatcagttctatcctgttgacctatatatgcctatcctaatgcca

SEQ ID NO: 19674 - DNA, 201 bp, Homo sapiens
gcttgccatcgagacatttataaaggagttgatatgagaggagtcaattttaatgtgtctaaggttagcagtgttgaagaatgccaaaaaaggtgcaccartaacattcgctgccagtttttttcatatgccacgcaaacatttcacaaggcagagtaccggtgagtacaattcaaggtgtgtgttctttgtattggtgcc

SEQ ID NO: 19675 - DNA, 201 bp, Homo sapiens
tttcccagaagaataaaatttgctgcgttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagc

SEQ ID NO: 19676 - DNA, 201 bp, Homo sapiens
ttacacacagtcttgattaccataactttgcagtaagttttgaactcagacagtctgagtgcttttattttgtcctttttcaagattaatttggttattcyggatcttttgcatttccatatgaattttaggatggttgtcaatttctgcaatagaaaagcagcaggattttgatagagagtgcattgaatctgtagacca

SEQ ID NO: 19677 - DNA, 201 bp, Homo sapiens
aatgacaggtggaagacagtctgatggatcatagtcactgttcttaaagaatacataattcaggcttgcatgagacaagatgaaccactgacatcctaatytctcaaagtagtcattggaaatggaaagaagagccaggatttattggagggtatattcacacagaaggggttcatgaaggtgagggaccctttcacctcc

SEQ ID NO: 19678 - DNA, 201 bp, Homo sapiens; identical to SEQ ID NO: 3092

SEQ ID NO: 19679 - DNA, 201 bp, Homo sapiens; identical to SEQ ID NO: 3093

SEQ ID NO: 19680 - DNA, 201 bp, Homo sapiens
ggtccctgccggcgtgcctctagggacgggcgacgctgctgtgtgtggtctcagagcctctgcttccttaggttacaaaacaaaacagggagagaaaaacmaaaaaaaaaaaaagaagtttgaaaagttgggaaacactgggtaaacttatttttaaacagtgtattagtcagcttttcaaataatatggtcagtatcttt

SEQ ID NO: 19681 - DNA, 201 bp, Homo sapiens
gagcagggagaatcacatgagccctggaagctgaggctgcagtgagcagtgatcatgccactgcactccaacctgggtgacagagcaaaaccctgtctcaaaaaaaaaaataaaataaaataaagcaatgaatccgattttaatctttaaaaagtataataaatacactaaaaagtgtccaaaaattctggaaatatagga

SEQ ID NO: 19682 - DNA, 201 bp, Homo sapiens; identical to SEQ ID NO: 3095

SEQ ID NO: 19683 - DNA, 201 bp, Homo sapiens; identical to SEQ ID NO: 3096

SEQ ID NO: 19684 - DNA, 201 bp, Homo sapiens; identical to SEQ ID NO: 3098

SEQ ID NO: 19685 - DNA, 201 bp, Homo sapiens; identical to SEQ ID NO: 3097

SEQ ID NO: 19686 - DNA, 201 bp, Homo sapiens; identical to SEQ ID NO: 3099

SEQ ID NO: 19687 - DNA, 201 bp, Homo sapiens; identical to SEQ ID NO: 3100

SEQ ID NO: 19688 - DNA, 201 bp, Homo sapiens; identical to SEQ ID NO: 3101

SEQ ID NO: 19689 - DNA, 201 bp, Homo sapiens; identical to SEQ ID NO: 3102

SEQ ID NO: 19690 - DNA, 201 bp, Homo sapiens
ttgccagaatctcagaaagaatctctggactctggctcaggacctctgaggtgattatgcatctagaggcatccccaggtgctgcccaatttggggaagcrgcacttcccgctggaagctgggaagtttcccctggctgggggtcctgtgaggatggagaggccagaatgaggaatgggttgtgagtcaagaccaaccaga

SEQ ID NO: 19691 - DNA, 201 bp, Homo sapiens
attttcccatcaaatgttcttccaggaaaagagaaccttttctaatgattttaacaacagccaaaataatttttcgatggtacagaccttcccctggctgkcttttctggtatacagatactgctgctggtgcatacttttccaaacgcgatgcgctagccttcccaatcaaataagcctttttatttccaatgaagtaaa

SEQ ID NO: 19692 - DNA, 201 bp, Homo sapiens
ttggccttggatctgtcttcattaatatttctttctttctttttttttttaatcaaagtttttagcagttcagtgaatatgtcaaaacttgtgggactgtrtggggtgccccaaggaaacacaggctttagagatgaatgtggccagcgcagtaatcaatttatttaattgcttgagatgttatgctagaatgaaaacagc

SEQ ID NO: 19693 - DNA, 201 bp, Homo sapiens
gcaaacaaagttgaatcatgaagtgatgtcactctgaaccaattggagcagtggtgtcatgtgcctggcagctacttcaaatgcccacaaaacaggagtamtggtttaagctgtttccctcttcccctcccaccaccaatcagcagcagactgctagaggacagatgcaaaacagttattagaccaggcttagttagacat

SEQ ID NO: 19694 - DNA, 201 bp, Homo sapiens
gtgggcacagggtttctttttggggtgatgaaaattgttctaaaattagtttgtggcgatggctgcatagctctaaatatacttaaaaccattggattatrtactttaaatcggggactttaatggtatgtgaattatatctcaataaaccctttttttttttttttaaagaaatgtgatcaggttgaaaataacttgtta

SEQ ID NO: 19695 - DNA, 201 bp, Homo sapiens
tgtcttggggtgctgagcctgttcccccctcatttgggggtgtggtgctatgctggcgtttgggtccatgccccgcatttctgatggctgccccatctgcyctgtgtggggtggcagagttctgtgtacacagagttacatttcgttgttcctggcttctctatggatgacagcagcactgataaatgccacacctgcttt

SEQ ID NO: 19696 - DNA, 201 bp, Homo sapiens
gctgttcctctctctttctgtttgaaagtgacttggcagggtgaagttgagaaccccttggaaaggaggaagccgaaatgcaaacaaagttgaatcatgargtgatgtcactctgaaccaattggagcagtggtgtcatgtgcctggcagctacttcaaatgcccacaaaacaggagtaatggtttaagctgtttccctct

SEQ ID NO: 19697 - DNA, 201 bp, Homo sapiens
tagaaacacgcctcctttgggcatatggtgtgaatcagggactctggctataaaaggtggggtctctgagcaccatcctggttggaatgttcccctgactyggaggtagcgagagacagccaaggtgtttgttccagggaggctggtgggtgggagatgggatttttctgtctgtggcacaggcagtattaagtagagcag

SEQ ID NO: 19698 - DNA, 201 bp, Homo sapiens
aatcttgattagacctgccagagctgtgcttattttgtgtccccatccaaatccagaattaattgccgtgctccacatgttttggtcaatggtggacctcrtctgtaacagtagtcccatgagattataatggggctgaaaacagtgctgtcccctagggatatcgtgtctgttgtagtgcaaggcactgctcacgtgttt

SEQ ID NO: 19699 - DNA, 201 bp, Homo sapiens
gacgcccgctccgccggctgtggtgtgcgcccttcctgctctcccctccgaggggctgaggctccttttgtctggcgcgcgcgccccaccccgccccgggygagggaagagggagcgggcaccccgcgcccgcgccgccgccgtggaccaaggttgtttactactttccactccgaataacacgccaatcaccagggccca

SEQ ID NO: 19700 - DNA, 201 bp, Homo sapiens
ctcaaatgatccacgtgcctcagcctcccaaagtgctgggattacaggcttgagccaccatgccctgtccgattatttttcagggaagagccagtgtgctycagccctatgagctctacccttctgctcccacagaagggaagcacaggcctgtggggtggagggggctctgccctaagcgcagcccctgtgggccacggg

SEQ ID NO: 19701 - DNA, 201 bp, Homo sapiens
ttggatcccctctgctaagcccctctgtgcctttgttcctgcattccctccacccccagtcccctccccacatcagtgtccacctgccaagccaggccagygccactccctccccgaagctttcctgccccactccagtagctatctcctctgctaacttctcgatgcgcttgactcacatcctcgtatgtgttctctctc

SEQ ID NO: 19702 - DNA, 201 bp, Homo sapiens
agcaggccgagaaggaggaggctgaataccgcaaagtctttgagaatttcctgcacaactccatcttcgtgcccaggtacccagctcatgtgaaatttcakttggcaaaacccactgctcaggccggttctgttgcctttctccccaccaggtagtgtgtaagtcagcagctggggggtacaatacagtagccactgagac

SEQ ID NO: 19703 - DNA, 201 bp, Homo sapiens
tctttgtctttactgacactcaggatcattgttaggtgggaggtcagatcaggcagctggagtccccagtgtggtgagtttagttggcaggccccagattyctcctgcattcatgggaaattgacatgtatgttttatttccccaggatcagcgagaatgtgtgtccagacaggaatacaggaagtatggaggggccaagc

SEQ ID NO: 19704 - DNA, 201 bp, Homo sapiens
atccatctgatcatcgctctgcccgtcgctgtcctgttgatcgtgggagggttggtgattatgctgtacgtcttccatagaaagaggtcagtgatgtgcaragttatgacactttctgtggctgagtggtttgatgatttgaatgtgagtgaaggtgatatttttgaagatttcaaggaaatattttatggactggaaaac

SEQ ID NO: 19705 - DNA, 201 bp, Homo sapiens
ttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagca

SEQ ID NO: 19706 - DNA, 201 bp, Homo sapiens
taatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgct

SEQ ID NO: 19707 - DNA, 201 bp, Homo sapiens
ttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgact

SEQ ID NO: 19708 - DNA, 201 bp, Homo sapiens
tgcttatttagtctttggctttcccttgttgttagacactgcctgtcactcgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagt

SEQ ID NO: 19709 - DNA, 201 bp, Homo sapiens
aaaagaagggccagagcggtgtcctgcagagggtggtgtaccttgggagggaagtgtgtagggttgttgaggaacagtgtgctgcacagggaggaaagacrtggggcagcattgtgggaagagcaaccaagattctcataggcttgggagcggaagccctgaggtctgttgctggactagatatgtgaggtgtgagaggag

SEQ ID NO: 19710 - DNA, 201 bp, Homo sapiens
ccagagtaaacattgcccctcaagatcaactcctggagtagcctctggtcttgcttatttagtctttggctttcccttgttgttagacactgcctgtcacycgggcattcatccatctttgaaggtgggtgccttcaaagacagaacaagagctgccctgtcctttagtaggcctcaggtggtagaaagagcacggaggtg

SEQ ID NO: 19711 - DNA, 201 bp, Homo sapiens
atcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcactcgggcattcatccatctttgaaggtgggtgccttcaaa

SEQ ID NO: 19712 - DNA, 201 bp, Homo sapiens
aacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaat

SEQ ID NO: 19713 - DNA, 201 bp, Homo sapiens
tggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttg

SEQ ID NO: 19714 - DNA, 201 bp, Homo sapiens
gttctttcagcatcgaactcctcttctcagttaatcgtgaagtggaaccctccctctctgcccaacggcaacctgagttactacattgtgcgctggcagcrgcagcctcaggacggctacctttaccggcacaattactgctccaaaggtaagggtgcagcagcggcctggacggagggtgtgaccgttcattcctgtggt

SEQ ID NO: 19715 - DNA, 201 bp, Homo sapiens
caagtgagatcttcttgtcagtgcttaatccagcctcccgttgtttgtcagccctagctggaggcctcacaggagttcctgtgtccttccagtttgatacsaagtttagaccaagaaaagttcctttctgtggcacacctgtagtctcttacctgtctttggtggttgtacacgaacaggcagatatccacaactgcagaa

SEQ ID NO: 19716 - DNA, 201 bp, Homo sapiens
gactttgtttgaagagtcacccaggtttttgtaaagaagtgtttcagatcagtatgcaatggatgactgtaaatttctcttcagatctaagaatctgtgaytggatgaaagggagaaaggactgcataagtgcttgttgcttgtaaactgggccaggtggatgtcatggccctaggagcttcttgcctgcctttgcatgcc

SEQ ID NO: 19717 - DNA, 201 bp, Homo sapiens
gcctggcacagggcagggcctctccagatggcagttcctgtctgtgtcttattcccaccctccgggcacatggggggaactcagtttctccccactgcgcrtcaccctgggagaggtgttttttgtgccaattgccattttaaatccaaatcagcagggatcatgtttgctgttcaaccatgtggcatatttatagtgatt

SEQ ID NO: 19718 - DNA, 201 bp, Homo sapiens; identical to SEQ ID NO: 3130

SEQ ID NO: 19719 - DNA, 201 bp, Homo sapiens
gtgtagacaagagctgctgtagacagtaagctctccccattctgttctgataccgtgtgagagaggataaatgaaactgttgtagcgaagatgaaagtatwtacaggaatgtatggaggtggggttttgttaacgtgaatttaatctttttgacagaaataacagcaggctggggaatggagtgctgtatgcctctgtgaa

SEQ ID NO: 19720 - DNA, 201 bp, Homo sapiens
gaggccgcaagcatgcgtgagaggattgagtttctcaacgaagcttctgtgatgaaggagttcaattgtcaccatgtggtaagagaaagttcctgaaaagycaaaatgcagcacagggagagggtatcacacaagcctcccagtatgttcttggctgcatgtacccgtgggtttggtgtcttgcctttgccttctggatag

SEQ ID NO: 19721 - DNA, 201 bp, Homo sapiens
cactttccaccagctcagtctctagggctttatctttctctgttcattgttacccgttgccagctttagctcagtgttgtgtgagccacacttcttcatcrttgaggtgttcctgttgtcagtgggctagctaagggcagaagggcattcgtgggattttaaagaatttatgggaccaacattctttccgccttcagcaga

SEQ ID NO: 19722 - DNA, 201 bp, Homo sapiens
atcaatttgtacaaaaatctttgattcaccgaaagtagctgaagcagcgaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgc

SEQ ID NO: 19723 - DNA, 201 bp, Homo sapiens
ggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcaaggtcccaagagctcttggttggaaatctcctgccccaggtttttcc

SEQ ID NO: 19724 - DNA, 201 bp, Homo sapiens
agtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaa

SEQ ID NO: 19725 - DNA, 201 bp, Homo sapiens
gcatgggtgacagcaggcagactgctcgggtggaatgggcatcagctgcagggaagccgggggaagaacagggcacaaatcagagttcagtgtgagacgcrgtgagtttgtgggtagcccagtaactgggaacttggaatggagcagttgggccgggagggccagggtgggagccgtgccgtgagaactggctgcctgcaa

SEQ ID NO: 19726 - DNA, 201 bp, Homo sapiens
ctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaaga

SEQ ID NO: 19727 - DNA, 201 bp, Homo sapiens
gcttctgctaagaggtttccttccagggactccatgttcactgcctcacaaaggcaggccagcctcatgctttagacatccttgctcttaacaaatctttygtgttctgctacgtcagcctctgtgtgacacccattggaccttctctctgtagcacaattgcataccttgctctgttcttgataagataggtctaggagt

SEQ ID NO: 19728 - DNA, 201 bp, Homo sapiens
ctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggtt

SEQ ID NO: 19729 - DNA, 201 bp, Homo sapiens
gtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcattt

SEQ ID NO: 19730 - DNA, 201 bp, Homo sapiens
actgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttggg

SEQ ID NO: 19731 - DNA, 201 bp, Homo sapiens; identical to SEQ ID NO: 3119

SEQ ID NO: 19732 - DNA, 201 bp, Homo sapiens
accccattagctaacttccagcaaggctgtgttaggaatgtggaatcaattagatgaattttgaaaataacttggtctgttctaaaaggccctatgagatycaaactgttgtggcctggtgcctggtaactttgatggccattttgaaatgttaccgtagtgataattcttctggaatctcaagtcattaaaagtgatatg

SEQ ID NO: 19733 - DNA, 201 bp, Homo sapiens
cccacggttttgctggttgacagtgatttgtcttgttccttgcttgtaattttattaggaccatggagccaaagtggctggtttgaatctcagctcttcastagctaagctctcaggcaaataatttaatcttcttgtgcctcagtttcctcatctgtgaaattataattttaatagaatctactttaaacattcatagaa

SEQ ID NO: 19734 - DNA, 201 bp, Homo sapiens
tccttatagttcaaaggtctttttctcaacttagttgatgatcatgctgtaagttgttttcttttgctttatcaacttttaaaaacgtttattaacttttwaatttgaaataatttcagacttgcataaaggttacaaagagtaccaggagttctggaacaccctccacccagcttccacagatgttaacatcttacataa

SEQ ID NO: 19735 - DNA, 201 bp, Homo sapiens
taataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttg

SEQ ID NO: 19736 - DNA, 201 bp, Homo sapiens
ccaaatcagcagggatcatgtttgctgttcaaccatgtggcatatttatagtgattttttttgtaatcatggtttttctttctggaatttcaagtttttcrtttgtgctgaggaaggtcgtttgtgttttttaataggattccttcttttccaccttgtgcaagtaaaggcaaatcccctatttgcatgtcactgtattaa

SEQ ID NO: 19737 - DNA, 201 bp, Homo sapiens
acgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatc

SEQ ID NO: 19738 - DNA, 201 bp, Homo sapiens
aatcattttgactttcacagagtgatagtgtctagagagggtttttgttgtactaagttattggttccaaagaattcattttaagaggagtaaagaactaytatagtatgccgcttactgagacaaaaccgacttctcacataagcccaaaggttttgttatgttggattttaccattagagttaaagatgatgattggtt

SEQ ID NO: 19739 - DNA, 201 bp, Homo sapiens
atgtatctagacattgacagatgttaacctgggattagggggtggggagaccaaaattgtaccctgttgagaaccactggaccagagtcatagcaatttgyagtggatagatttaggaatatttgaagacttgtaaaatatagcctgaagggaatggagactgggagagtgaaagatacctctgagacattttggcttgga

SEQ ID NO: 19740 - DNA, 201 bp, Homo sapiens
tttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaccagcttgccctctggcaagctcctttaagagttagctgtaatttcaccc

SEQ ID NO: 19741 - DNA, 201 bp, Homo sapiens
ctgtgctgtggctgggagacctgtttggtcttggaagctgggtcctggatgagcagaatgaggcaggcatagaggtgatgttggctacgggcaggggagcrtttgctttgccttggagtagtgccatttccatgtagaggggcaagatttaccaccctgttgtggggatttgagactttgggttttgttttcctttacacc

SEQ ID NO: 19742 - DNA, 201 bp, Homo sapiens
ccttcctcccagacattttgaacagttcaggctgtactcattcgtgtctctttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcc

SEQ ID NO: 19743 - DNA, 201 bp, Homo sapiens
cgctggatgtctcctgagtccctcaaggatggagtcttcaccacttactcggacgtctggtatgagaacctttactgcattgccagcctggagcccccagyctctgcactttccaccagctcagtctctagggctttatctttctctgttcattgttacccgttgccagctttagctcagtgttgtgtgagccacacttct

SEQ ID NO: 19744 - DNA, 201 bp, Homo sapiens
cgggaaaccactgcaggcggcccatgaagcctcctggccatgtgcgccctcccggtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctcctt

SEQ ID NO: 19745 - DNA, 201 bp, Homo sapiens; identical to SEQ ID NO: 3132

SEQ ID NO: 19746 - DNA, 201 bp, Homo sapiens; identical to SEQ ID NO: 3134

SEQ ID NO: 19747 - DNA, 201 bp, Homo sapiens
tgttcccctctccagttccttccattcccttggacgttctttcagcatcgaactcctcttctcagttaatcgtgaagtggaaccctccctctctgcccaayggcaacctgagttactacattgtgcgctggcagcggcagcctcaggacggctacctttaccggcacaattactgctccaaaggtaagggtgcagcagcgg

SEQ ID NO: 19748 - DNA, 201 bp, Homo sapiens
ttatatctcaataaaccctttttttttttttttaaagaaatgtgatcaggttgaaaataacttgttatgctaccttaaattacgttaaaattattacatayatttgacaggctgatgtctctctctcttttcatttatgagtttttcagatccgtgagttgcagcaatacaacaaactgataattgaagcttagcaacagg

SEQ ID NO: 19749 - DNA, 201 bp, Homo sapiens
ggttttgtaggatttggagacagagacaaatttggagtgtttggatgttcggggacctgcaggaggtatgtgaggtgtgtaaaatgcagcccctgttttawaaagagcttacattgtctcttgagaagataaggtgtgcccagctgtggaatggaaccagatgcttttatgagtgaggatggagtgagcacactgggaaag

SEQ ID NO: 19750 - DNA, 201 bp, Homo sapiens
gccaggcgcagtggctcgtgtctccaatgtcagcactttgggaggccagggcgggcagatcgcttgaggtcgggagttcgagactagcctggccaacgtgrcgaaaccccgtctctgctaaaaatacaaaaattagatggttgtggtggtgcatgcctgtaatcccagctactcagagaagtgtttgaacccgggagttgg

SEQ ID NO: 19751 - DNA, 201 bp, Homo sapiens
cttatggtttccactggctcggctccgtgcgtgtgcggattgggcttcctgagagcctggttagccccttttatctgctctctgaaacctgcgcaagggtktttagcatgcaccttgaaacctctgctgcctgaagacagtgtgcttaaatgaagggtatacaaacccatgtgaggttttctcttcccttttccatgaact

SEQ ID NO: 19752 - DNA, 201 bp, Homo sapiens
cacacctgtagtcccagatacttgggaggctgagatggaggtcaaggcttcagtgagccatgatggcaccactgcactccagcctggacaacagagtaagmccttgtctccaaaaaaaaaaaaaaaaaaaaaaaagccaaatctgttgggtttttttttttgggggggggggtcctttagaatggccctgacagatcttta

SEQ ID NO: 19753 - DNA, 201 bp, Homo sapiens
ttggacttacttgctttccatttatatgttgtctaattccaaagagatttcgagacagctttcaattaaaaaaaacaaacaacaacaacaacaaaaaaaamcaccacataccgcatgggtattacacaggacctgtatggtcaaattggcaacgaccacaccacatgagaaggaagattattcttcctggaacctggctcc

SEQ ID NO: 19754 - DNA, 201 bp, Homo sapiens
aaagaaaagaaaattggagaatttataacgtctgatgtgacctgttctttaggtgttgaaattagaacggcctcactcacctgggacattcttcagctcaygccctgtacctggcttacagttgctcagtgaaatgctttcttgattgtagcatggtgggatttttataaatccaaatgacttagaggtaggtgtcacatt

SEQ ID NO: 19755 - DNA, 201 bp, Homo sapiens
gccaaaaggctgggcccttgtctcccaccccactgctgttactcatgtgttctcccacttgctcggcattctttcccatgctttttccttgatcatcactyactagctaacatctattttttcctaaacactctgttgcagttgtagtctgcagtcactctcctaagacttgatcatctattacgctgtttcgttctttat

SEQ ID NO: 19756 - DNA, 201 bp, Homo sapiens
ctgtgcacagggagcaaaccccaagccgactgcttgtctgtgccaccctcaaacaatgatttccccaaattggacagcctgggtttgtatccttgagcacrgttttgggaagagcattctgcatgaggcattgtagctatgtatatggagtataattctgttttcaggttgctctgccacagaggttaagaactccctctt

SEQ ID NO: 19757 - DNA, 201 bp, Homo sapiens
tggtttggtccagccttagagcgggtttgcaggtagacaccttcctaatgtttgttccacgtaagcccccggagcacagtatttccatcagctattttgtrgaagtgagcgattctcttttggttgtaaaccttcactatttcatgtgggtgacttgacaatggctccatttttgaatggcccattgatagttgtagtcta

SEQ ID NO: 19758 - DNA, 201 bp, Homo sapiens
cacatgggagcatctttttattttattttacttttttttaaaaaaatgaggtctttattatcctggctggagtgcagtggtgtgatcatggctcactgtarccttgaactcctgggctcaagtgatcctcttgcctcaacctcccaagtagttgggctgatagacatgagctactgtgccacgtagcattcttggggatta

SEQ ID NO: 19759 - DNA, 201 bp, Homo sapiens
ttgaacacttgattgaggtggtgcctgccaggtttctccagtgtaaattttctgcttttcgcattgttactgatatcttagggctgatactcacagtatgyagatgtctcgtttctcttttttcatatttcttttcttttttctttttttgagacagtcttgctctgttgcccaggcaggggagtgcagcctcagacttct

SEQ ID NO: 19760 - DNA, 201 bp, Homo sapiens; identical to SEQ ID NO: 3133

SEQ ID NO: 19761 - DNA, 201 bp, Homo sapiens
gctctgcagtgaacaattgaacctcatttctttaataataatacaggattcctgaaaaccaactgtattattgtttggaaaatagtttaaaaattatttcyttctaactgagacgtttaccctcttgtctcccttcagtctgcgggccaggcatcgacatccgcaacgactatcagcagctgaagcgcctggagaactgca

SEQ ID NO: 19762 - DNA, 201 bp, Homo sapiens; identical to SEQ ID NO: 3137

SEQ ID NO: 19763 - DNA, 201 bp, Homo sapiens
tggccattgaaagaaaaaataaatagcaaaatccccatcccagaagttctacttcctgttgttgtactattgagctctgaaaaacagctttgtaagtttargctcttgtttggactatttcagtggaattcttgagatctttttgtttggacaggcaagtatgaaggcgataagtcgaaagaactacagcttactcagcac

SEQ ID NO: 19764 - DNA, 201 bp, Homo sapiens
aattctaaagcttaagtaaattcagtaataataaactgtcaattatccaagcgatgaatataaatccataaggtttttcaaatccccagaaatccctttcrtctcccacctggttttgctgagcgcctgtctcttctgtctcttttctgattcccacctttcacttttcctccatttttcgcttaatggatttatacttta

SEQ ID NO: 19765 - DNA, 201 bp, Homo sapiens
ataagaagctgctcaagacatttacctatcctgaatgtttcaggccctcaaggtgccaggtagctgcaatatagttctagtgtagaaaagaaaaccctgaygaggtctatatattccaggactctgtctgaggccctttgacactccgggggcaccctgccgtgaccctgactctttcctgcatgtactgaggatggaggt

SEQ ID NO: 19766 - DNA, 201 bp, Homo sapiens
atcaggcctttctctgaaattcccatcaataactacaagatctgcccagtaccttgtgcatatcaggtctcaggaaattgtgagtttcttgtttcattaarcatttttctttccaggaatcatcattcatcgcattgccatatgtgtccagatcccccttttcagggagccagtaattcgaaagcacttgcctgtgttgaa

SEQ ID NO: 19767 - DNA, 201 bp, Homo sapiens
ggtgtggctttcatagctttggttctctggtcttcactttatctgccaagtgaagacatttgactggatgtcgtgatcttgagttgctttcagctccagawttcgaagaccccttccattgggcattcatctaatttcaaagatgctccctggctccagctctgcagtgaagcagaacaaactgatacagcctagcttggg

SEQ ID NO: 19768 - DNA, 201 bp, Homo sapiens
ttgaattgcactgaaaacgaaatttcataggtacacgatacagtagttagttttaaaagtttttaaaatattaaaaaattgaaagtatttaaaatattttwaaaatattttaaaatctgctgtgtgagatagataggagacctagcttttcttccttcttaccttgatccatagagaaagcaaccctgaaagaagaaaaac

SEQ ID NO: 19769 - DNA, 201 bp, Homo sapiens
gcagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtacc

SEQ ID NO: 19770 - DNA, 201 bp, Homo sapiens
tacgtggtgccaggcaggtatccgggtacctttttacgtagggtattcagagaaggtctctagagaggtgacatttggacgaagacctaaaggaaagggargggaaaggcgaggagcttggagagcttggtgcatcttggtgggggatggggtaaactgagtcagttatgtagggccctggaggccacggtgaggacttcg

SEQ ID NO: 19771 - DNA, 201 bp, Homo sapiens
agaccccatagtcctgtggtttaccttctaatgagcatacttttgtcgatcaaacagggtgacctctctggtgtctctgcacactacctgtatggtctttscgtagctgatggggtctcctgactagtgattggtgattttaatctggattttgccacagcacttattttctaacatatgacttaatttacttaataattg

SEQ ID NO: 19772 - DNA, 201 bp, Homo sapiens
gcaagaactcagtgggtgagcacttccatttcttcaacaaatgcttctgagtccctgacctgtgccaggtgctcttcttgagctgagaatcctgcagggaraaaagagataaagaccccatagtcctgtggtttaccttctaatgagcatacttttgtcgatcaaacagggtgacctctctggtgtctctgcacactacct

SEQ ID NO: 19773 - DNA, 201 bp, Homo sapiens
cttgctttccatttatatgttgtctaattccaaagagatttcgagacagctttcaattaaaaaaaacaaacaacaacaacaacaaaaaaaaacaccacatrccgcatgggtattacacaggacctgtatggtcaaattggcaacgaccacaccacatgagaaggaagattattcttcctggaacctggctcccttgagatt

SEQ ID NO: 19774 - DNA, 201 bp, Homo sapiens
gtgccttttgatttgatacctatttatttgtttggaaagaagcttttaaaatcaaaaccatgaatctgtggttatcttcaaaggataaattatgataggtrgttgttacccaggttaccattttaagatgattatggctggcccaaattaggggatcttttcatatatgtattatatattttaacttcagtcttttaaaaa

SEQ ID NO: 19775 - DNA, 201 bp, Homo sapiens
ttcaagatttctctttaggtaaatagatttgtatttttgatggccatcctagtccagtgtaaagatatggacaagaaaccccacataaaggaagcaagatygctggctgctttctctaggtagcttgagttgtatactaatttgtagattatttctcttcatcgaaaaaacaaaacattctgcagagggcagtcatgtgtc

SEQ ID NO: 19776 - DNA, 201 bp, Homo sapiens
taaagtgtgccttttgatttgatacctatttatttgtttggaaagaagcttttaaaatcaaaaccatgaatctgtggttatcttcaaaggataaattatgrtaggtagttgttacccaggttaccattttaagatgattatggctggcccaaattaggggatcttttcatatatgtattatatattttaacttcagtcttt

SEQ ID NO: 19777 - DNA, 201 bp, Homo sapiens
gcagtactgccagactcagggacccagttcatcgagaggggcagtgtttctcttatgctgccttaaaggcattggatgccttttggaaagccagtggacarctcctgcatccacccaagattaatgttaacagcttaaagaatcattgcaatcaagggaaattttgcaacactttgttgggatatttttaaataaatgtgt

SEQ ID NO: 19778 - DNA, 201 bp, Homo sapiens
ccaaatacataaccattattatatgacttagcatttataaggcatttctatgcatcctgagagactagagcactctcaaatgaggtttcagagtaagattmatctttgcaaatgaagacaaattagcaaaatcttcctatttttaaagtgtgccttttgatttgatacctatttatttgtttggaaagaagcttttaaaat

SEQ ID NO: 19779 - DNA, 201 bp, Homo sapiens
ttcttaccttgatccatagagaaagcaaccctgaaagaagaaaaactcacccatttgagctttcttttgtttccactgagcaatacggaagaaattcaccrctggttataggtcttcagtgctttcttcagagtgggattgttttttgtttcaccataagtagtagtctattaaattaacagttgctagagaagaagctgc

SEQ ID NO: 19780 - DNA, 201 bp, Homo sapiens
ttctggcattgggaaagaaagaaaaatggcactagcagccttttttttttttttttttttttttccccaaaaaatttgctactcttgaggttctgtcaaaraatgtgctgtggcctctagaagcatttttaaaaagagactttcacaagtgattgtgcaaaattgtgaggtcactgaataggtgtgtatcctcctaaggag

SEQ ID NO: 19781 - DNA, 201 bp, Homo sapiens; identical to SEQ ID NO: 3135

SEQ ID NO: 19782 - DNA, 201 bp, Homo sapiens
ctgggacagatctgcttcttgatactgcagggctccagccttccttccagccagctcatttctcagggaagccttgttttcctttttcagaaaatttaaaygtatatttaacgcacaatttaactccctttcctgttgataatttttttcttcttcatattttgttattaataatagcttacagaatgggatcagtatcag

SEQ ID NO: 19783 - DNA, 201 bp, Homo sapiens
ctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagaggtcagtcgcggccacacgtgtggtcactaccc

SEQ ID NO: 19784 - DNA, 201 bp, Homo sapiens; identical to SEQ ID NO: 3123

SEQ ID NO: 19785 - DNA, 201 bp, Homo sapiens
ctgggggtgtgtgggggtggttggttggggtttgcttgttagtttgttgtaaaagcccagcttttcattcttggaaagatttcagccaactcgagagggtkacctgccaggaatgctgcagaagcaagaactcagtgggtgagcacttccatttcttcaacaaatgcttctgagtccctgacctgtgccaggtgctcttct

SEQ ID NO: 19786 - DNA, 201 bp, Homo sapiens
tacaggcatgagccaccacacctggcctgggttgctttttaaattcatacctactgtcttatttgggtctcaaatgtgatcagtggttatacttttcttgstatgcatttaagttggagcaggctccggggcaccacttccctccctagagttgatgaacccctcatatcagtgacctccccatgtcacagtgtatctcgt

SEQ ID NO: 19787 - DNA, 201 bp, Homo sapiens
tagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgatta

SEQ ID NO: 19788 - DNA, 201 bp, Homo sapiens
atgcattgtttgtatgaataatagcttctaaaaagaaaatcagtaaggaagggagtcatcccagatgatggaattgatagaacaaggcaagaccactttcyccctctgtgagggtggactgtgactctacgagagaagctattctgctttgaaatgcggcactagaggttggtgtgtgtagcttttgactgtgaagtgtcc

SEQ ID NO: 19789 - DNA, 201 bp, Homo sapiens
aggcagcctgttgacccaacccatgcatgccggtctttgggactcctagatgtggaccctggagtgaatagggatcaggtgggaaatgagttcctttgatsaagatccttgtaccagtgaactgaccccactccccgtctggattcctgtggtgattaccctctgtattagtctgttttcatgctgctgataaagacgtac

SEQ ID NO: 19790 - DNA, 201 bp, Homo sapiens
gagatactgtatgcaaagaattgtcatgaagacataaaatcaagtcttggtgtaaaacttttaataaatttaaaggcatgtctctgtttttctcctcctcyatggggattttcatgtggttagtaataaaactgtaggcagttgtatgtctagatttctatgtaatttgtttgtgttcgtatatgcacacctgtatacatg

SEQ ID NO: 19791 - DNA, 201 bp, Homo sapiens
acagcaactgtctgttctcctatagtgttaataactaaatctcttattggcaaaggaaatgtattgtggagcaggtggcaaagaggacctgtgttacgtgrccagcaggctagaggggactgtggccaagggcaggtgcgctaacatcgatttctgtgcttctaggaattactccttctacgtcctcgacaaccagaactt

SEQ ID NO: 19792 - DNA, 201 bp, Homo sapiens
gccccttgttttcaggttaggaaacccaggttcatgtccaagtccctgggcaagtagccagcgtaactgattgacctaaaacaaaggatggagcccttggrgctctgcatagtgaaatgtatgatttcttagtggaaaacgagaaagccactgaggaagcccagaagggaacttagcatatacagccagctttggggaagg

SEQ ID NO: 19793 - DNA, 201 bp, Homo sapiens
tgctcttctgagttctcttctcaaatacctgttttcttgggtcacaggagattaggagattaaagccattctctctggtcctgcacctcccttgccaggcrtggctaagaggtttgtccttgtggaaggagctgagtgggttggtcgacctgtgcttttccgtgggtaccttaattctaccccatattccgtaatgctttc

SEQ ID NO: 19794 - DNA, 201 bp, Homo sapiens
tgccgtctctgcctgctccatctggctgatcccaggcaggcagctcagctctcagcagacacagatccccagcacatatgaacgtgaaagaggcttctccrtgggagcgaagtggccagcaggtgtcacaggctgtgtgggcccagcatcgtgtgggcactgctgggggaatcccatcacagcatgtgctggcgttagtag

SEQ ID NO: 19795 - DNA, 201 bp, Homo sapiens
ttttagtttgttcaccacgcttgatggcagatttgcctctggatcctcaggccacgttcctatggtgggtagggatctctctctctctctctctctctgtstgtgtgtgtgtgtgtgtgtgtgtgtgtgtgtaaatagtgatttctctaagttaataaagaatgtggggtgacctcctacacatgcccgtatgctattgtg

SEQ ID NO: 19796 - DNA, 201 bp, Homo sapiens
ttgggcttagtagtaaaaagggggaacaaaataaaagaagatcaggagacaaagagcctacagtacaaaaaaggaaagacgaaggttgatattattagaartacttcctgggcagccttactgtttgaattaggatcacccccacccccacctcccagaggtattagttgtaatgcagagacaaatggaaactagtcagat

SEQ ID NO: 19797 - DNA, 201 bp, Homo sapiens
tttttgagggggaaaaatacagcaaggggaaatgttttattaacaataaatatgcggcttaccatatctgtagggcacagatttggttagtagtattttgraggcaggataaaggaagatcctaaaatctctgtgctgtgtagcttccattcgagctgcacatgttaaaaacattctaggatccacacagtttaaacaagg

SEQ ID NO: 19798 - DNA, 201 bp, Homo sapiens
tcaaagagaacaacaattcaccacaccccaacatggtaacagtctttttgttttagaagcatctgtgaattgccaagactcgtagaactaagatgtattcraagtcagtcgattttctggaaacgacccagtccctgaagatagtcttttggggagttgagtgttttgagagggacaccccctctacagggacttaaaatg

SEQ ID NO: 19799 - DNA, 201 bp, Homo sapiens
tcctgcatagaaatatttatttattcattcattcatttttttgagacaggttctcactctgttgcccaggctggagtgcagtggtgcagtctcagctcccwgtagcctcaacctcctgggctcaggcgattctcctgcctcagccccctgagtagctgggattccaggtgtgtgccatcacacctggctaattttttaata

SEQ ID NO: 19800 - DNA, 201 bp, Homo sapiens
tgtgtgatcgcattggagctacttcaaagagcaaacacaccactttgatttatttctcttagtgatacagtatttagagagggagatactttttatcttcrtgggatacttacagtggtgctctagaagccatgtactgcttctggcttctccttcctttcctccaaggctcctcctgcctcctcccaaagctctgtgccc

SEQ ID NO: 19801 - DNA, 201 bp, Homo sapiens
ttagtatcctcaaattatcttgaaatcctcagagatctgaaatactagtactgactgtacagttttcttactcaaatctatagcatgtggaaagttgacakcaagccatgccatcgcctcctggtattctctgtgggtttaaggaagcagcatcttatattctttggcttagagttcccccaaagcacgttctgtctaagg

SEQ ID NO: 19802 - DNA, 201 bp, Homo sapiens
aatgtttggccagagtaatccatccttactcatcctctccatgtgaggtttttgtttctttttaaagaaggctacaacacaacacatactactctgaagtygaattcaagagccccgcgccccacctgtggcaggcctgagggagccgccgcagtgagtgtgcacacagctgcatggccaggactccggcatgcaccacgt

SEQ ID NO: 19803 - DNA, 201 bp, Homo sapiens
gcgaagaaaagtggagagagaacaaccttcatgtcttgagccttttgtgacttctcctagactctgttgggagcttttcctgtgtgatcacatgacattcmcccatctaagcagccgaggcttattcctcccgactgcagccctctttgatctccctcttccttcctttgccttctatatccaggtggctaccccggtcta

SEQ ID NO: 19804 - DNA, 201 bp, Homo sapiens
tgcctcatctgccctttttggtgagaatgtcctttttgtgatgactttatgcactcccttttgcttttcggttgttccaagccccattcaaatccatgacraggactctgctctctgatgggcaggaccttgatgaggccacaggtgctcactgctgagtgggaggaagcctgggtgggctccagggacctgcagagtgta

SEQ ID NO: 19805 - DNA, 201 bp, Homo sapiens
gaggaagtgacggggactaaagggcgccaaagcaaaggggacataaacaccaggaacaacggggagagagcctcctgtgagtgacagcatccaaaacaccrtgggcccaaccatcatgataacagcagaccctcctcccatgtgtgatggcagctttcctctgcggcccctcctggtttcacatgggggaccactagacca

SEQ ID NO: 19806 - DNA, 201 bp, Homo sapiens
ttttgtggttggtgtattctgaaccctccgctgtgtgagcagcccgctcaggggcagtgtacgtggctgatctccactgtcctgcccgcgtggatgggggsgttattctcagtgtacgtggctgatctccactgtcctgcccgtgtggatgggggggttattctcaggtcagcccagtgttggcctccctccctgggaacc

SEQ ID NO: 19807 - DNA, 201 bp, Homo sapiens
agtccctgggcaagtagccagcgtaactgattgacctaaaacaaaggatggagcccttggggctctgcatagtgaaatgtatgatttcttagtggaaaacragaaagccactgaggaagcccagaagggaacttagcatatacagccagctttggggaagggggaagcagtgccaagcaagacaggtgcttttcagagaca

SEQ ID NO: 19808 - DNA, 201 bp, Homo sapiens
catatacagccagctttggggaagggggaagcagtgccaagcaagacaggtgcttttcagagacacatgaatctctgtcactcacggatgtactctttgcmccaggtgaaagtgacgtcctgcatttcacctccaccaccacgtcgaagaatcgcatcatcataacctggcaccggtaccggccccctgactacagggatc

SEQ ID NO: 19809 - DNA, 201 bp, Homo sapiens
gagcagatttggggagatgttagtcaaaggatacaaaatttcagttagataggaggaataagttcaatagatatattgtacatgatgacagtaataatgakgtattcttaaaaattgctgagacaatagattttaagtgttctcaccacacacaaaaaaatgtgatgtaatacatatgttaattaggctcattcagctgtt

SEQ ID NO: 19810 - DNA, 201 bp, Homo sapiens
gaaggaggccagttactagagcagagtggccgtagaggctgcaacacggtggccaaagcatgaagctgctgtatagtggcaaggtcacagtgatttccccrcagcctcggtttagagggagacggggtgtgctgagctgtgcctgcttctgtagaaggggccttctccaagtctgagtagccttaagccattaggactgct

SEQ ID NO: 19811 - DNA, 201 bp, Homo sapiens
atgcatccttttttacttcagagtaagtcggccttggttaagtcttaatatttctcatgcctatttttttttcttcaaatgaaaacatacggagagaaaayagcatgtttatgccttttggttgtacccagcactgcccagaatggcttacagagtttatacccatggaggtttcgtaaaggtgacattaacttcgcagta

SEQ ID NO: 19812 - DNA, 201 bp, Homo sapiens
cttcagtgcagtggcataatcttggcccacttcagccttgacctcccaggctcaagcagtcctcccacctcagcctccctggtagccgggaccacaggtgytttgccgccacacccggctaattttttattttttttgtagtttttgtagagatggggttttgccacgttgcgcaggctggtctagcattactgggctcaa

SEQ ID NO: 19813 - DNA, 201 bp, Homo sapiens
tgaaaggttagatctttgttctgagataaattaagtggaaaaaggtgtagagcattatatgtactctgattcttcagggcttaatttaaaaagagcatgtwtgctggtgaatgctggttcaatcattaagaagtttttgagaaggaatcccagaaagtaataagcacttatttttcatggaaaggaaccggaagtgcttgg

SEQ ID NO: 19814 - DNA, 201 bp, Homo sapiens
gtagaaagcaagaggattttccttgcagtcactgaaggtaccttgtgtacacagaaagaagacagagggagccccggatgcctcggtatccctcagagccrgatccttcagacctgtgcagtacctgtggatttggttagtcgatgatgcgctgccattaaaacaaaggcatcggccctggaatagagaagttcagtgaga

SEQ ID NO: 19815 - DNA, 201 bp, Homo sapiens
gaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcg

SEQ ID NO: 19816 - DNA, 201 bp, Homo sapiens
gaaaagcatctaacatgtttccaagcacataggtttttggtaaatggtggcagctgctgctattttttttttaaattaaactatctaagagttgcattctragaccatctaaaattctgagtcttaagctgtgttgactatatatgttcactaccataactaaatggtccttctgtattgcttttctaaattgtagaattt

SEQ ID NO: 19817 - DNA, 201 bp, Homo sapiens
gcagaagaacagaacagtccttggagcttggtaggaggtgtgagggcttatgggggacagttgtcttttcaagtcaaggaggaataagggcttctggggcsggtggaaagggtgagtcttaggcagggaagggtgaccatccaggttagatcacttcttctgcggggtcagcttggccgctgttaggttttcaggatgtca

SEQ ID NO: 19818 - DNA, 201 bp, Homo sapiens
tggggaagggggaagcagtgccaagcaagacaggtgcttttcagagacacatgaatctctgtcactcacggatgtactctttgccccaggtgaaagtgacrtcctgcatttcacctccaccaccacgtcgaagaatcgcatcatcataacctggcaccggtaccggccccctgactacagggatctcatcagcttcaccgt

SEQ ID NO: 19819 - DNA, 201 bp, Homo sapiens
cctaaggggtgtaaggaactccagaggtcatctggttcagcctgctacagggcaggaatctccacggtagcatcgcagaccctccactgtccttttaaagyccccacatgcattggaaatgtacggtgctcaccctttggtacagagactgaggaatgtgagtttatgctcaagtcattaacaagacagaattcttaggct

SEQ ID NO: 19820 - DNA, 201 bp, Homo sapiens
ttttaagtgttctcaccacacacaaaaaaatgtgatgtaatacatatgttaattaggctcattcagctgttctacaatgtatgcatatttcaaaacaataygttgtacatgataaatatacaatttttatttgtatattaaaattaattaattttaaaaaagatctccagtagtcacctggtcagcaccagatattctaat

SEQ ID NO: 19821 - DNA, 201 bp, Homo sapiens
attgattatttgtttatttagacctcccattatagaaagtgtgacatgctgggcctctggggaagatttttgagggttttgatgtcagagccccgaacttyctctgaacttaattgtctttcagaccctttaagaatgtcacagagtatgatgggcaggatgcctgcggctccaacagctggaacatggtggacgtggacc

SEQ ID NO: 19822 - DNA, 201 bp, Homo sapiens
tggtcttagacttgtagcaggactcaaatgtctgcagcggcattggaaaggggtgccgtccagtgtgtgcatgtgtgtgtgtgtttattttaaattgtctrtggaactatctcaaagattgaggccagcaggacttgacctatacatagatgtagactgtacatagatgtaagaatttctattcattttatgaaaatgaat

SEQ ID NO: 19823 - DNA, 201 bp, Homo sapiens
ggatctgggagcacggtgctaggactctctaagcgtgacctccttcagtttggcccagagtggtcagatagtttgccggggcataggatggatgacaggcytcatacgcatcacgtctgaagggaaagcccttgaattttccacgctactttttagtaacagtaggctttgtcataattggcttcatgttccagctttcct

SEQ ID NO: 19824 - DNA, 201 bp, Homo sapiens
ttaagtgttctcaccacacacaaaaaaatgtgatgtaatacatatgttaattaggctcattcagctgttctacaatgtatgcatatttcaaaacaatatgytgtacatgataaatatacaatttttatttgtatattaaaattaattaattttaaaaaagatctccagtagtcacctggtcagcaccagatattctaatct

SEQ ID NO: 19825 - DNA, 201 bp, Homo sapiens
agaaagaattcggggatgatttcagagtacactagaatattttttaaaagaatattttataaaaatacagtgatagtaaaagaagtagaaggccaaattcygcccccagccccttcttaatattggactttattcctttgcttttttcccttgctgccatctaaggaggctttctgtgctatagcatccagttcctctgcc

SEQ ID NO: 19826 - DNA, 201 bp, Homo sapiens
atataaccatatgtaagtgactgtgctatcaggagacagaacaacaagacccagaaagactcagtgacccacagagccagttccacccaaacaagtcttastaatgagattagataatgagagtgtattttcttcatcaattcatgtagctcagcaaggctggaaactgcttgcacacttctgcagagaaaaaaaaaagtt

SEQ ID NO: 19827 - DNA, 201 bp, Homo sapiens
ttttacagatgggaagagagaggatcaagatcacagaagctaatggtttgtcccagaccaaacaaggagttcctaggagagactgaactttaaagatatcractctctgcaggtctaagtggatgaaaggacagtggtgggggtgaggatttcgtagtgtgtttttgcattgtctcctcaatgagtgatctggtgctggtg

SEQ ID NO: 19828 - DNA, 201 bp, Homo sapiens
agctttgtgcacactgaacttggagaaccactgtgttggactccgagtcctcttgcctggatgagaggcccaagagcactgcatgttagtggctcttcctyctcccccacacctccagggactggagctggggctgctcagaatgaaagatgaatgggggagggagaaggcccagggttgaccccccacaagcttgtctcc

SEQ ID NO: 19829 - DNA, 201 bp, Homo sapiens
gagcactgcatgttagtggctcttcctcctcccccacacctccagggactggagctggggctgctcagaatgaaagatgaatgggggagggagaaggcccrgggttgaccccccacaagcttgtctccctgtctcatgctgtctcctatcccatcatgctgctgattgggcaggatttacttccatggataatgggagact

SEQ ID NO: 19830 - DNA, 201 bp, Homo sapiens
ggctaacatatggctttaagctggatgttacaatgagagctggagtttcgtctgattgcacatagccttgcttttctgtctttggaaaagtagctcactgyagagccctggtaaacgtttgaactgcattgcgggagtaggcagaagaacagaacagtccttggagcttggtaggaggtgtgagggcttatgggggacagt

SEQ ID NO: 19831 - DNA, 201 bp, Homo sapiens
gagcaggctgtttaaatcacattttaagtaaaaaccaaagtgcacagatgatctgcagaacttctgggggataagaagctgctttcctcgaagaagttcayctccaaaccagcgcccatggctcagcagccagcatggcagccccaggggtacatgggacttgggcatgtgaggctggtgagggacagggacagctgggtc

SEQ ID NO: 19832 - DNA, 201 bp, Homo sapiens
tggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagca

SEQ ID NO: 19833 - DNA, 201 bp, Homo sapiens
aagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctc

SEQ ID NO: 19834 - DNA, 201 bp, Homo sapiens
aagctttcagaaccactgacttgtggtgatttttgcatgccaagtatttggaaaatatctggagccccttcagctctcaccagttaaacctatttgtacawttgttctggtttcttcctgtgcttgaaaagcctctttctttgttgcgttaatacctctgtcttgctttcctcatgtgtatgccagtgtgacattctcggc

SEQ ID NO: 19835 - DNA, 201 bp, Homo sapiens
ttgctgtggaggctttctggtatttcatttcaggtgcagatgccttcactttcccacaaaaaaaaccccaacaaaacctaagaccttactgcaactaagtytccaagtactttttaacccaatgggatgaacagcctgtggtctgctcagatcaccctgagtgcgtgtgagaaggcctgggctttgccaggaaatccagga

SEQ ID NO: 19836 - DNA, 201 bp, Homo sapiens
tctgggggataagaagctgctttcctcgaagaagttcacctccaaaccagcgcccatggctcagcagccagcatggcagccccaggggtacatgggacttsggcatgtgaggctggtgagggacagggacagctgggtccagcagtgcctttcctagggacggttgccacgtcacctgtctgccctgtacttccatttcct

SEQ ID NO: 19837 - DNA, 201 bp, Homo sapiens
tgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagta

SEQ ID NO: 19838 - DNA, 201 bp, Homo sapiens
cttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgcc

SEQ ID NO: 19839 - DNA, 201 bp, Homo sapiens
gtgagctggccctgacttctctccagtatcatcattttctaggaaagccatttccccacaacccccaaggaaagcatatcataaacaagttttcccttggrgaggttccctcgactcccttctctcctctcccttcctctctgaattgttgccatatgtgaagtccacttttctagttgtcatgctacctgttgacactaa

SEQ ID NO: 19840 - DNA, 201 bp, Homo sapiens
ccggcattgttggcggtccttgtctttgccactgggaatctggtttcctcagactctacgtccacgtttcaggattgatccagagtcagtgtcctgcttaygcttttgaatgaatgatcccacctcagctgcaggatttctgcttagtttcctaaaaatttcactttgggttatgagcttccaattctaaacctgctaaag

SEQ ID NO: 19841 - DNA, 201 bp, Homo sapiens
tgggagataaatgctgagacataaagccagcaagaactgagttttcatttggttgcctccgtgggtctgaagtctttgacccttactttgctgcttactgrgtaagcagtgtgtctgcttttattccttagaagcagtgacttccccttctcggcccctttggaaattcttttgctgttcttcatttgggcttaatttttt

SEQ ID NO: 19842 - DNA, 201 bp, Homo sapiens
gcctgagtcatgaaaccggaccacattaagggcgacacatggtccaatcactgtttgtaaaagtccacgtatttcaaactcctctctcctgccactgctgrgctgtttccctctttgaggacctggtctccgcagcatttattcattagatggcagtcctaggggagtctcgctttggggaaacctctcctcctgcacatt

SEQ ID NO: 19843 - DNA, 201 bp, Homo sapiens
ctgccactgctgggctgtttccctctttgaggacctggtctccgcagcatttattcattagatggcagtcctaggggagtctcgctttggggaaacctctsctcctgcacattcaagaaaacaaccgcggagacttagggtcggtactggtttccagtcacttacgtagcaaacgaagcaagaggaacgtgcctgggagga

SEQ ID NO: 19844 - DNA, 201 bp, Homo sapiens
tatttgtctagcatcattgaaagagttttttgcttgagttgatttcccaggtaattgaagcttacttctcaaagcacaagatattttttctcatatattarcggtcttaagtgagtgagacccctaagaattcttaattcctttatcttacttttcctacaggaaacttattatgttttcctagataggaattgtgctacc

SEQ ID NO: 19845 - DNA, 201 bp, Homo sapiens
acatgccgtttgaatgtataccatgaagaccccttagctcagggagctttgctctatttaagtaatgtttatattcttaatgaaccaaagaggaagtggtyatgggaaaagagccaggactagatttcattctaatgcttataaggagagttctaggaaaccctcagacttggtaaaccaaggcatttggagatactatga

SEQ ID NO: 19846 - DNA, 201 bp, Homo sapiens
gaaaagcttgatgaaataggtgactggagatctggcagagtatttcttgccagcatcgattgaggcacctctgaaaagtccaaaactcactcccttcctcyccagtttcaggcacagaataaaaattcagaacacatggccttggtcctggctctgtggctggctgcctgtggtcctcagacagctgctgcaggttcctgg

SEQ ID NO: 19847 - DNA, 201 bp, Homo sapiens
ctgggtttgtgcccttcgtgctgcactgacaggtcaaagccgactcaggcctttgatgtctgctctaggagcaaaagtgattcctggtcccgcagccgttyccactgccttgtgtatgaaggtctgctgctctgaggtggatggtggctctaggcaggctgtttccgctgggtgcggttgttgctgcaggtttttctatat

SEQ ID NO: 19848 - DNA, 201 bp, Homo sapiens
gtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactga

SEQ ID NO: 19849 - DNA, 201 bp, Homo sapiens
ccaccatgttggccaggctggtctcaaactcctgacctcagatgatccgcccgcctcagcctcccaaagtgttaggattacaggtgtgagccaccatgccygactctttttaattcttaatgtggctacttgaaaatttaaaattacagatgtggcttgcattctgtgttggtaagctgctttagagcatttcttttaaca

SEQ ID NO: 19850 - DNA, 201 bp, Homo sapiens
gcgaaggtgagtctgggagagacgccatggagtcagtgtgagttctgcagcctcccaagttccgctggcgtgagaggcttgcctggtgccagggctctggrcattgggaacattgcctggtctaccgggcaagaaacgtgaaccaccgcagtgaactggcagcgcgttggcatttttccctccatgtttttataaaaccgc

SEQ ID NO: 19851 - DNA, 201 bp, Homo sapiens
gtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagta

SEQ ID NO: 19852 - DNA, 201 bp, Homo sapiens
aggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaattttttt

SEQ ID NO: 19853 - DNA, 201 bp, Homo sapiens
ctcgacaattcacaactcttttattagctatcttaaaaaaatttattactggcatcaattagcctgagtcatgaaaccggaccacattaagggcgacacayggtccaatcactgtttgtaaaagtccacgtatttcaaactcctctctcctgccactgctgggctgtttccctctttgaggacctggtctccgcagcattt

SEQ ID NO: 19854 - DNA, 201 bp, Homo sapiens
ttaaatttcacctgcctgtttcctttttattcttttttttttttttttgaggcggagtttcgctctcatcacccaggctggagtgcagcggcgcgatctcrgctcactgcaacctccgtctcctgggttcaagcgattctcttgcctcagcctcccaagtagctggaattacaagcatgtgccaccatgcccgtctaattt

SEQ ID NO: 19855 - DNA, 201 bp, Homo sapiens
tttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattggg

SEQ ID NO: 19856 - DNA, 201 bp, Homo sapiens
atagagcagtcccttgattctgctttgtccccattaatgacagatctgagggcatccagaaggaatctccacaagcccagcctccacagtggctgcttccyctacatggtagagtggtgctcacctccactcctccatagatgccaagtcatctgtggtatagatgtggatgtctttgttcaaatggtccttgagtctttg

SEQ ID NO: 19857 - DNA, 201 bp, Homo sapiens
ctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagc

SEQ ID NO: 19858 - DNA, 201 bp, Homo sapiens
ctgctgcgggataagggccagggcagaggtgtgaacgcagccgtggaagacttgggccaggaagccatttgttctgctgctaacacttccacagctccacrtgtccagactgttgccagagacgtctttggtctacaggattcaggagggaatctgaactttagcctggagcattatcaactcatagatgagtctgaaaca

SEQ ID NO: 19859 - DNA, 201 bp, Homo sapiens
cgctgggcaccaccgggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcatttt

SEQ ID NO: 19860 - DNA, 201 bp, Homo sapiens
ttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctc

SEQ ID NO: 19861 - DNA, 201 bp, Homo sapiens
catgcctgcacccccatccccgagggtctggaaaagaattgatttgttctgaggaaggaacatatatttggaatataaaatggttagtaaacaaaggatctttaaaacaagttagattgttatctcaagagaagcatacttcctcggcatgatgttttcttttgttaaattgctttggttttatttgactcaaagtattaa

SEQ ID NO: 19862 - DNA, 201 bp, Homo sapiens
gcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaa

SEQ ID NO: 19863 - DNA, 201 bp, Homo sapiens
ttgcttttgggcgtacgatttggaaatgtagttgtttaccaaaaaaaatgatgtatgggccattgtgcttcccctgttcctgccttccagataatgttctstgtcacctccctccccttgtcactgccttgatgtcatcagcattgagagctgtgcagtccctaaaagtgtgatgttgataaacaagtaaactactgagta

SEQ ID NO: 19864 - DNA, 201 bp, Homo sapiens
cgtacgatttggaaatgtagttgtttaccaaaaaaaatgatgtatgggccattgtgcttcccctgttcctgccttccagataatgttctgtgtcacctccstccccttgtcactgccttgatgtcatcagcattgagagctgtgcagtccctaaaagtgtgatgttgataaacaagtaaactactgagtatacttcatgaa

SEQ ID NO: 19865 - DNA, 201 bp, Homo sapiens
tgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctc

SEQ ID NO: 19866 - DNA, 201 bp, Homo sapiens
tgttggctttgaagaagaatgatgctgtgcttgcctttgcagtcctgtcaccatacttcctggaaagtgggtggacacgctggatggtagatgttgagttstttagatgcctggatgcttacatgctttgtgtgggttcttactggggctgtaacttactagaggacagactccaacttctgcttacttagtctggggagg

SEQ ID NO: 19867 - DNA, 201 bp, Homo sapiens
cccaaatctctacccattggtcaaggtccctgagttcacagagcccaggccagagccctggaaacgcctctgcccgtccgctgcctaattgcctgtccacrctgggcaccaccgggtctctccctcagtctcagagctcagttgcttctgcacctcatcagggatccagccatcaaagccaaggctgggggacacttggac

SEQ ID NO: 19868 - DNA, 201 bp, Homo sapiens
aactcctggactcaagcagtcctctccctccagcctcccaaagttctgggattacaggcatgagccaccatgcccggctggaactgttggctttgaagaaraatgatgctgtgcttgcctttgcagtcctgtcaccatacttcctggaaagtgggtggacacgctggatggtagatgttgagttctttagatgcctggatg

SEQ ID NO: 19869 - DNA, 201 bp, Homo sapiens
tcaaactcctggactcaagcagtcctctccctccagcctcccaaagttctgggattacaggcatgagccaccatgcccggctggaactgttggctttgaaraagaatgatgctgtgcttgcctttgcagtcctgtcaccatacttcctggaaagtgggtggacacgctggatggtagatgttgagttctttagatgcctgg

SEQ ID NO: 19870 - DNA, 201 bp, Homo sapiens
ggtggtggacgggctgtgtggtctcccctcagctgtccacttgcacttgtgttaaaatgcggcagaactttccctctatacttaaattgtggtgaaatacrtatgacataaaacttaccatcttaacttttttttattgagacaggatctcattctgtcacccaggctggagtgcggtggcgcgatctctgctcactgcaa

SEQ ID NO: 19871 - DNA, 201 bp, Homo sapiens
ctacaggttttcaagtcatctcgtgtggtgcacagtcctcgccctacctcgaaggcccgggcgaagttttcctgagtgtgtatactcatctctttgtgttrtctctggcagggagcaagtgagtacaggattggagtaataggcatttttaggcttgagatggctttgtgtgtttggttaatgtcactacatttcctaggg

SEQ ID NO: 19872 - DNA, 201 bp, Homo sapiens
gcttgcctgccttttgggtcgtctccacctcccagggatgtttttgttccctgatcgaatgacctcctgttttgtttgttttttgagacggagttttgctytgtcacccaggctggagtgcaatggcatgatctcggctaactgcaacctctgcctcccgggttcaagtgattcttgtgcttcagccttctgagtagctgg

SEQ ID NO: 19873 - DNA, 201 bp, Homo sapiens
gcaagtccctataggataggcatgtggtacagtgtgaagctcctgagtggtcaacagctaccccgtgacaacatgccacactccatgtgccactccctccygcctgcctgctgtgtccttggccccagtggtgctctcccgtgctgaccagccggcacggctcacctggccgaactctagccttgccttttcctctcaagg

SEQ ID NO: 19874 - DNA, 201 bp, Homo sapiens
ccattggtcaaggtccctgagttcacagagcccaggccagagccctggaaacgcctctgcccgtccgctgcctaattgcctgtccacgctgggcaccaccrggtctctccctcagtctcagagctcagttgcttctgcacctcatcagggatccagccatcaaagccaaggctgggggacacttggactagagtaatccta

SEQ ID NO: 19875 - DNA, 201 bp, Homo sapiens
tactgggtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttca

SEQ ID NO: 19876 - DNA, 201 bp, Homo sapiens
cttagcattggttacagaaataattaagacaatgtcttcaggagattttgacttgggaataaaactcactgtccaaccttgcattcatccctccaattttyctagcttttaaggagcattgctccccttccagggacccacattggtttctaagaggcaagctgccctaatgacgaagcctctgcacggagcaggagcagt

SEQ ID NO: 19877 - DNA, 201 bp, Homo sapiens
gtgttgtcaataaacaagtccattttaaaagcatctttgaaggtgtgtaatgaaaatggaggccttaggttgtatcagggtttatgaggagccagcttatmtgtaatcagatgttcctgttactgttatcactgtagtatagggcttagttctgccctttaagtcacagactcaagttactcctgattttaccagcagtca

SEQ ID NO: 19878 - DNA, 201 bp, Homo sapiens
agttggaatgcagtggcatggtcatggcttactgcagcctcaacgtcccaggctcaagggatcctcctgcctcagcctcctgagtagctggggtcacagakgtgtgccatcacgcctggctaatttttaacattttttgtagagatgggagtctcactatgttgcccaggctgcactcaaactcctggactcaagcagtcc

SEQ ID NO: 19879 - DNA, 201 bp, Homo sapiens
gacttgggaataaaactcactgtccaaccttgcattcatccctccaattttcctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctca

SEQ ID NO: 19880 - DNA, 201 bp, Homo sapiens
ggaaaaaaaaatgtattcagccagtactctttccaggttatagctaaacgtcagttggcaacctctatgctgtggtttattgagtaacacttaatacttarcacagccctcagtgaagatcttttatggccttttctgaatgttatacaaacataactaaagcttatccagatgaggacagggacctttctttccttcctt

SEQ ID NO: 19881 - DNA, 201 bp, Homo sapiens
agtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattt

SEQ ID NO: 19882 - DNA, 201 bp, Homo sapiens
ggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttatt

SEQ ID NO: 19883 - DNA, 201 bp, Homo sapiens
tccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttctttta

SEQ ID NO: 19884 - DNA, 201 bp, Homo sapiens
gcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacac

SEQ ID NO: 19885 - DNA, 201 bp, Homo sapiens
agtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgat

SEQ ID NO: 19886 - DNA, 201 bp, Homo sapiens
ctgcaagagacttcctgggagggtggtatcatttggcctgtgggcttttgtaacactttcctgctattaggagagtgaattctgaattttcaatcacgttsacctgttggagcaagtagagtttcagacggtctccgcttttctcgactagaaagcaggccttctcccttttccccccagtcttgtttcatgacaccattc

SEQ ID NO: 19887 - DNA, 201 bp, Homo sapiens
ccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttcacctgttggagcaagtagagtttcagacggtctccgcttttctcgactagaaa

SEQ ID NO: 19888 - DNA, 201 bp, Homo sapiens
ggggtgcagtggcatgatctcagctcactgcaacctccaccacctgggttcaagcgattctcctgcctcagtctcccaagtagctgggattacaggtgtgyaccaccatgcccacctaatttttgtatttttagtagagacggggtttcaccatgttggccaggctggtcttgaactcctgacctcaggtgatccacccac

SEQ ID NO: 19889 - DNA, 201 bp, Homo sapiens
gtggcatgatctcagctcactgcaacctccaccacctgggttcaagcgattctcctgcctcagtctcccaagtagctgggattacaggtgtgcaccaccaygcccacctaatttttgtatttttagtagagacggggtttcaccatgttggccaggctggtcttgaactcctgacctcaggtgatccacccacctcagcct

SEQ ID NO: 19890 - DNA, 201 bp, Homo sapiens
ttttcacctttggcttttaataagggaagggtattagaaaaaaagtaatttgtatgatgaagggtgatttgtgcgtgtgtgcagacagacacacatgcagrgaggcaaatcagaaccgatgcgtgtttggctttggcttgtttcgctggtgtctggatttacctggcgacacttgttgctctgggggatcttagagggaag

SEQ ID NO: 19891 - DNA, 201 bp, Homo sapiens; identical to SEQ ID NO: 3128

SEQ ID NO: 19892 - DNA, 201 bp, Homo sapiens
accataattctgtgctaagtcagaattaatgttattttgttaattcaggttattgtgaaaatctccacaggaggttatttaagcaagtcacaaattgatgwttctgtttgtagaaaaactccagctcatccagccagccacattattccagggctgcatggtgtcagcgtagggaccaggctcggtgtagagaccaagggt

SEQ ID NO: 19893 - DNA, 201 bp, Homo sapiens
ctgtggaatcatttgaaaatttctgaaaacatgaaacaggtgtttataaggagttttctgacttaacaaaattggtgaaataccaactttactaaaaactrctaattcataattttttgattaataatttctagtctggaaaagaggaattttttgaaaatcactgatatttttgatatactgttgttttcaaattgagtt

SEQ ID NO: 19894 - DNA, 201 bp, Homo sapiens
gaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgcgcatgtgctggcagtataaccccaagatgaggccttccttcctggagatcatc

SEQ ID NO: 19895 - DNA, 201 bp, Homo sapiens
ctaagaaggtgggactccagcggcaatgccttgtccatgtgctaagccagccgagggcgcacgaagtgctgtgtggtgtccaagctgacttgggagggacmagtttggggccagccccccagcctcacttgtcatgtcccacctctgctggcatctgtgggcttaaagtgccttcactcccatccttttcaactatttctt

SEQ ID NO: 19896 - DNA, 201 bp, Homo sapiens
accatagataacagctgtcacgatggacagtgtggacctggattagtccttcttgggaaaggagagtttgggttttgtaccgtggtggttctgggttctgrgggaagagaatggaaccgtacgaggtaaaacaggagactctgaaggccacttggccatccaggcagaaagccagggatggagaggggcagcagggctgtg

SEQ ID NO: 19897 - DNA, 201 bp, Homo sapiens
tgccttgtccatgtgctaagccagccgagggcgcacgaagtgctgtgtggtgtccaagctgacttgggagggaccagtttggggccagccccccagcctcmcttgtcatgtcccacctctgctggcatctgtgggcttaaagtgccttcactcccatccttttcaactatttcttgattaaaaaaaaaaaacaaaaaactg

SEQ ID NO: 19898 - DNA, 201 bp, Homo sapiens
tagcactgccaccatagataacagctgtcacgatggacagtgtggacctggattagtccttcttgggaaaggagagtttgggttttgtaccgtggtggttytgggttctgggggaagagaatggaaccgtacgaggtaaaacaggagactctgaaggccacttggccatccaggcagaaagccagggatggagaggggcag

SEQ ID NO: 19899 - DNA, 201 bp, Homo sapiens
tttgtttcttagcactgccaccatagataacagctgtcacgatggacagtgtggacctggattagtccttcttgggaaaggagagtttgggttttgtaccrtggtggttctgggttctgggggaagagaatggaaccgtacgaggtaaaacaggagactctgaaggccacttggccatccaggcagaaagccagggatgga

SEQ ID NO: 19900 - DNA, 201 bp, Homo sapiens
aaggaggcaacttggtttcatagggagtgtcatgttgtccttctgagtttactgatgagcttacctgagaaaggagggttctagcatgggagttctgttgytacaagacatgaaagaatggcctccgtttatcccggagaggagagtccctgagcccttgggagttgccttgaaacctctgccgggtcccaggtgagaaag

SEQ ID NO: 19901 - DNA, 201 bp, Homo sapiens
ggagccccggccacagccggcaggactccctttgctccatgtgactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggct

SEQ ID NO: 19902 - DNA, 201 bp, Homo sapiens
gcccactgatccaggaagagattcctttgacctgggaagtcataatggcagatatttagacccagctctcaagcaagcctccaagttgttccggtgaaccygtaactttgagtaacctctgattgaaccagagagtaggaactaggtgcagaaccttgttgaatagaattgtttagcatcgtccatttgttagagcatttc

SEQ ID NO: 19903 - DNA, 201 bp, Homo sapiens
aggagagtccctgagcccttgggagttgccttgaaacctctgccgggtcccaggtgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtg

SEQ ID NO: 19904 - DNA, 201 bp, Homo sapiens
gttagggtattctccttgaggagctcagaataaccaaaggtaaagcatttggtggtataagatatattcatcttaaaaataagttgaaaataataagataytgggagatgttagccaccgaagtaaataactacagtgaaatagctctttattaattttgaaacctaaagttgaaagagttccgtattatttgtcagtatc

SEQ ID NO: 19905 - DNA, 201 bp, Homo sapiens
cctggctttcaggaaacgtagtgacgtaaaaggtcccggctgctgcgggataagggccagggcagaggtgtgaacgcagccgtggaagacttgggccaggragccatttgttctgctgctaacacttccacagctccacgtgtccagactgttgccagagacgtctttggtctacaggattcaggagggaatctgaacttt

SEQ ID NO: 19906 - DNA, 201 bp, Homo sapiens
gaaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagact

SEQ ID NO: 19907 - DNA, 201 bp, Homo sapiens
agaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaa

SEQ ID NO: 19908 - DNA, 201 bp, Homo sapiens
tatcataatatgccacctactctggttgtgtcttacaactgtagctctgtggggttttttttgtttgttttatgcttgctaatgggggaggtggggggtgkgggcggatgaatataaatgatacctagaaattgaaattggaaaaaaaaatgtattcagccagtactctttccaggttatagctaaacgtcagttggcaac

SEQ ID NO: 19909 - DNA, 201 bp, Homo sapiens
tgggatcctcctggaggcttagtagggctgccctgagcagtattgtcttctccagctgggcctctgagctgtaccatgtgcccgtgctcagcctcagtccmtccctcagccagttgttaaatcactttggacgtgtgacagcctcaacatgtcacagctttaaaagttcagattttaaaaaggtaaggaaatgatctccta

SEQ ID NO: 19910 - DNA, 201 bp, Homo sapiens
tggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcct

SEQ ID NO: 19911 - DNA, 201 bp, Homo sapiens
tctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacataggctgggagtctgctctcttccagcctggtccctctcttctttcagccc

SEQ ID NO: 19912 - DNA, 201 bp, Homo sapiens
aataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgta

SEQ ID NO: 19913 - DNA, 201 bp, Homo sapiens
ggtttgactatcgagtttagattttaaagttgaggattgtttctttaagaagaaatatagaatattattcagtcctaaaaaggaaggacattctgacacawgcaacagcgtgaatgaaccttgaggacattatgccaggtgaaatcagccagtcacaaaaggacaaatactctatgtgatttcatttagatgaggttccct

SEQ ID NO: 19914 - DNA, 201 bp, Homo sapiens
gcccagccagattttatttctttaaaaaagaaacttactagttatcaggacacttgtgttcttggtacttgattttgtcagcattatttttaagagcctcktccctccttccccctacctccctgttgagcccaggctctgaaataacataggtgcatgtgaagttcccctacctgccattaccagacattggtgctgggc

SEQ ID NO: 19915 - DNA, 201 bp, Homo sapiens
tgtaacatgggggtatattatagtcagtagcacctgcttcacaaactcgtgaggacttcagcagttcacacacataactgcctcgctgcctggcacctagygtgcacatggcattctaccgtggggtagacttttaaaattctggctacagagatacttttccataaaagtggccacatggaactctccaaatctaagaag

SEQ ID NO: 19916 - DNA, 201 bp, Homo sapiens
tgcctggtcatgcagagacggagctgggagcagctgcatgacttttcagagaagtggcacacgtttactgtaagggtcccaaatgtagaccactgcagatsgtaaggtctagatggagggaccaatagtagggaagtaggggagaagaaagtaaaaccttacagtataaagacccatagatgctcttttgtttttgatgtg

SEQ ID NO: 19917 - DNA, 201 bp, Homo sapiens
gagggaccaatagtagggaagtaggggagaagaaagtaaaaccttacagtataaagacccatagatgctcttttgtttttgatgtgtgtacgggggttagrtatttattgagcacctactgcatgacagagtgttcagcaatgacaatgcagagcttaataagaacaggttctagactaatcttttagggggtgaggatag

SEQ ID NO: 19918 - DNA, 201 bp, Homo sapiens
ccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaa

SEQ ID NO: 19919 - DNA, 201 bp, Homo sapiens
aaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagg

SEQ ID NO: 19920 - DNA, 201 bp, Homo sapiens
cagcaagggcataggtacctgccattgtgcaccaaagtccctttcctcatggccctggctgttctcctgcatggggtcatgtgtgtcccgttaccaagttrtggccccttttcaaccttgagtgccacatctgggctgttgtaggcatgggtagtacaagctgggtttgttactctaaaaatgaaagggaggatcagttgt

SEQ ID NO: 19921 - DNA, 201 bp, Homo sapiens
gctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtg

SEQ ID NO: 19922 - DNA, 201 bp, Homo sapiens; identical to SEQ ID NO: 3121

SEQ ID NO: 19923 - DNA, 201 bp, Homo sapiens
gtctagtgttcttagctgtcacgttggctccttccagggtggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtctt

SEQ ID NO: 19924 - DNA, 201 bp, Homo sapiens
tagattttaagtgttctcaccacacacaaaaaaatgtgatgtaatacatatgttaattaggctcattcagctgttctacaatgtatgcatatttcaaaacaatatgttgtacatgataaatatacaatttttatttgtatattaaaattaattaattttaaaaaagatctccagtagtcacctggtcagcaccagatattc

SEQ ID NO: 19925 - DNA, 201 bp, Homo sapiens; identical to SEQ ID NO: 3122

SEQ ID NO: 19926 - DNA, 201 bp, Homo sapiens
taacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggc

SEQ ID NO: 19927 - DNA, 201 bp, Homo sapiens
tttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcat

SEQ ID NO: 19928 - DNA, 201 bp, Homo sapiens
agatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgc

SEQ ID NO: 19929 - DNA, 201 bp, Homo sapiens
ttaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccc

SEQ ID NO: 19930 - DNA, 201 bp, Homo sapiens
gtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattg

SEQ ID NO: 19931 - DNA, 201 bp, Homo sapiens
agtggccacagtcatgtcactgggtaaagtgcttattgaaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagatt

SEQ ID NO: 19932 - DNA, 201 bp, Homo sapiens; identical to SEQ ID NO: 3129

SEQ ID NO: 19933 - DNA, 201 bp, Homo sapiens
aggagaagccgatgtgtgagaagaccaccatcaacaatgagtacaactaccgctgctggaccacaaaccgctgccagaaaagtaagaatgatgctgactgytgctttctctctgcctctctctctcctctcctcctccttgacctcccttctcttctgagtgcacgagttccgctgggcagggtgcagtcgtgttgcattt

SEQ ID NO: 19934 - DNA, 201 bp, Homo sapiens
tttgcctatccttccacttcacagatgagaagactgagacccagagagggtcatggttttcattagccaaatggtgcagaaacccagtggtcacagtggcyctctagctctttgtcacccacagggcccttgataagagtacggtctttctccaggggagcagggttgaggagtgggggcagccctggcctgggtggccat

SEQ ID NO: 19935 - DNA, 201 bp, Homo sapiens
ggacattccgtctgcggggagccgagtccgaggctggagcaactctggaaccacagccctccagtagagggcacacgagagcaggctatctgtggagatakcctgttggcacaggggtgaagatgacagaggcgaacccaagcaaagagagttaattagcagagtttgccctccaggctcggagggcaagtcagcctgggg

SEQ ID NO: 19936 - DNA, 201 bp, Homo sapiens
atccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgc

SEQ ID NO: 19937 - DNA, 201 bp, Homo sapiens
tccatcagcataattccttatagattcattcaggttgctgtgtttatcaatagtttgtttctttttattgctgaatggtattctgtggtgtaaatgtactrcattccatgagcatggcatgtccctccatttatttagtttttctttgatttacttcattagcattttgtagtttttgtagtcctgtgtatgttttggtag

SEQ ID NO: 19938 - DNA, 201 bp, Homo sapiens
tgagactttgggttttgttttcctttacaccttgagctttgttctacagcaggtccctgggaagactggtccacaaagctgctgaatggggctgctgtccwtcagccctgcctcctgctgcagaatgcagaggacgctgtagacttgcttggtgggtgcctggggttttctgcctccctggtgcactgggcacagcggctt

SEQ ID NO: 19939 - DNA, 201 bp, Homo sapiens
taaacagcagaatattccaggaaaccttaagtgataactgagttgaaagagtcatattttttaagcaatacaatttaaataatttttaaaggaaacatttmtaaaggacgttttacattgcttgcattaaaaagaatataatgaacataatccaactttttctcaatactcagggtcatcactgtgaaagtaacttcattc

SEQ ID NO: 19940 - DNA, 201 bp, Homo sapiens
gagactttgggttttgttttcctttacaccttgagctttgttctacagcaggtccctgggaagactggtccacaaagctgctgaatggggctgctgtcctkcagccctgcctcctgctgcagaatgcagaggacgctgtagacttgcttggtgggtgcctggggttttctgcctccctggtgcactgggcacagcggcttg

SEQ ID NO: 19941 - DNA, 201 bp, Homo sapiens
ggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcc

SEQ ID NO: 19942 - DNA, 201 bp, Homo sapiens
aagtctgtgcttgcattatgtatcaaaacttagtgctatctcctcaggtgcagggttctctggaactctgtctaggttggtctcttggatggcattcttgsagacttgccggaaaaccaaacaaaaggtgtgagtgcatgcctcctggatagatgtctttttagtgtaacttagcacaccttgtacactgtcagggcgcct

SEQ ID NO: 19943 - DNA, 201 bp, Homo sapiens
gcttctatgacttataatattcacttgtagaactcactggcctttgtcagctttcagagtatgtgaacactttttgccatgtaagtagttagtccattggyaatggatatatgtaagttggtatcttcactgcaaacatttagttaattgcgtttattcttgagccattcttgctctacccttaggacttgattttcagta

SEQ ID NO: 19944 - DNA, 201 bp, Homo sapiens
tatcgtataacctggagcaccctcaagctgtccgcccttttcaagttttaaaaatggcttaggcaaacatattgcttaagtgatatccagtgaaggtgtcycctgtgctttgaaaaaccatcaacattgatgcttttttgtgacccaataaggacaagatttcagtggttctgggatgcatttgatctttatgcacacttc

SEQ ID NO: 19945 - DNA, 201 bp, Homo sapiens
gttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataa

SEQ ID NO: 19946 - DNA, 201 bp, Homo sapiens
gtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaa

SEQ ID NO: 19947 - DNA, 201 bp, Homo sapiens
attattacaatttgatttgaaatgtctagagaaagtgagagattatggaaattaccataaatgctccctttttcatagatttagatctgttaattgcaagmaatctttttttaagtgaatcaatgggaactttttatttcttccctaagattcatttagccttgaaaaggccaaaagttgaatgaagcttctaaatgccaa

SEQ ID NO: 19948 - DNA, 201 bp, Homo sapiens
cggtttatgtgaaatgtctagaataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattat

SEQ ID NO: 19949 - DNA, 201 bp, Homo sapiens
tttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtggagaaataaagacag

SEQ ID NO: 19950 - DNA, 201 bp, Homo sapiens
tctgaaattcaaaacagcagggatggccttcgccgacgcaggagtcgggcattttaaaataggctgtttttcttttggagcgttcttcttgaaggatattstttgtgcaagacggcgatttttgagaacacaggcaggagggagggggtgttttaatgtatgtttttactccatgataccaaagcttccccccaggatccc

SEQ ID NO: 19951 - DNA, 201 bp, Homo sapiens
tcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacatga

SEQ ID NO: 19952 - DNA, 201 bp, Homo sapiens
gggctagggttaaaacccgtggagtaatacgccctcctattgtgttcctctcctctaaaaatgaaggtgaaactgtttcaggtgagcgctgttgttgttcrtttgctggggcactgctttctgatttttagaggagtccaggctggagactgacccctgcctttttctgagttgggccggctgggcccgaggctggttctg

SEQ ID NO: 19953 - DNA, 201 bp, Homo sapiens
caaattttgtgagttccctggtaactgactgtatggaagacagaaataaaaatcagaataaacttttattttctgaatcagaaagcagttgctccagcttytggtggtcacattgctaagatgtaaaaaacagaagttaggtgaaataaattaagaataattattttggagaaagagagggtagtgtttgactaaattaga

SEQ ID NO: 19954 - DNA, 201 bp, Homo sapiens
tcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctgtctccgtgagtctg

SEQ ID NO: 19955 - DNA, 201 bp, Homo sapiens
tctttgtttacagggaaaatgctcttgagaaaatggaggtcattaaacactccagcttcagcaatatcatcagagctttccgtcacgtgagttatctcacmaaagggtcagattctggtaaaaactcttgccttcacacttacttctgttttattttgccttatttgacatttcaccagaattgatccataggttcaataa

SEQ ID NO: 19956 - DNA, 201 bp, Homo sapiens
tcaatctctagaacacttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctc

SEQ ID NO: 19957 - DNA, 201 bp, Homo sapiens
gcttaaggaacatcatcctctgttgggcagaattcttccatggccaccccagcattatgccccacaccatttgacttactcatttgtgaatgccaactcaraatgtattgctttgattcttgattaggatctcaacctctatttattgttaagactatcaccctttgattcccccccatcccattgtgtccttctaaaggc

SEQ ID NO: 19958 - DNA, 201 bp, Homo sapiens
gtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactgg

SEQ ID NO: 19959 - DNA, 201 bp, Homo sapiens
aggaaagacgtggggcagcattgtgggaagagcaaccaagattctcataggcttgggagcggaagccctgaggtctgttgctggactagatatgtgaggtktgagaggagagaagaatcaggaatgactctttgattcttaacgtgagcaactcagagaatgagagtgctgcagtttacaagcttggaaggtggattatgt

SEQ ID NO: 19960 - DNA, 201 bp, Homo sapiens
ccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaa

SEQ ID NO: 19961 - DNA, 201 bp, Homo sapiens
atttcatttcaggtgcagatgccttcactttcccacaaaaaaaaccccaacaaaacctaagaccttactgcaactaagtctccaagtactttttaacccawtgggatgaacagcctgtggtctgctcagatcaccctgagtgcgtgtgagaaggcctgggctttgccaggaaatccaggaaggcagggccgggctgtgttg

SEQ ID NO: 19962 - DNA, 201 bp, Homo sapiens
tctcaccgtggccattacgggctgctgtttacaaaaatcctgcaggcctttgacaccccgtcctcccttcccccggcatccctgcccttattctggctttyttctcttccatctcctggtgagcacagcatactgttctcaggcttgttttccttttattgctctccatgtgggacaggtcatgctttatcaacatgtacc

SEQ ID NO: 19963 - DNA, 201 bp, Homo sapiens
ggtgaagttggaagcatcacttagaaacacgcctcctttgggcatatggtgtgaatcagggactctggctataaaaggtggggtctctgagcaccatcctrgttggaatgttcccctgacttggaggtagcgagagacagccaaggtgtttgttccagggaggctggtgggtgggagatgggatttttctgtctgtggcac

SEQ ID NO: 19964 - DNA, 201 bp, Homo sapiens
cttcctgggccctccgtgctcttctgagttctcttctcaaatacctgttttcttgggtcacaggagattaggagattaaagccattctctctggtcctgcrcctcccttgccaggcgtggctaagaggtttgtccttgtggaaggagctgagtgggttggtcgacctgtgcttttccgtgggtaccttaattctaccccat

SEQ ID NO: 19965 - DNA, 201 bp, Homo sapiens
attatttgtttatttagacctcccattatagaaagtgtgacatgctgggcctctggggaagatttttgagggttttgatgtcagagccccgaactttctcygaacttaattgtctttcagaccctttaagaatgtcacagagtatgatgggcaggatgcctgcggctccaacagctggaacatggtggacgtggacctccc

SEQ ID NO: 19966 - DNA, 201 bp, Homo sapiens
tgctgtcctctgcaaagaggaatgcttatccctgttacttattcctggtttcctccaagactagtttcagctggacttcagttgccaaggacttgtcttcygtaatgcccacagaaaataataatgccacattgtaaggtgaaaacagtaatcctggtatttttgtattttagaagaaggttgaagggaaagaaaaggatt

SEQ ID NO: 19967 - DNA, 201 bp, Homo sapiens
aggggagagcacacctgcagtgaggcaattcacatagcaaagttctccggaaactgcagtgttcaacttttttaaagaatagctggatgttagaaaagtgraggaactgtcacctttattaggggcatcatggatacctggtagcatcaagggctagggttaaaacccgtggagtaatacgccctcctattgtgttcctct

SEQ ID NO: 19968 - DNA, 201 bp, Homo sapiens
tgcacatgttaaaaacattctaggatccacacagtttaaacaaggtggctggcttaggaaatgcttctccccattccttggcatccccacaaccctattcycctactttctcttatgtatctggactggcttttaaaagatatttagtgaaatttaattttctagggaaactccactttgtcaaaagtgtagtattcctca

SEQ ID NO: 19969 - DNA, 201 bp, Homo sapiens
ctgatgccgaatccacttggcagcactgagttacaagaaggttaagtagatgaactagaagatggataaacgaagatagataaaatgaagaaaaacaaaartcaaggagaactcaggcgtccaagagtgtgtaaacaacttctggtgtgagacgcgctacattgcgctaaatggcctgtgcgcttctggtttttcccttcc

SEQ ID NO: 19970 - DNA, 201 bp, Homo sapiens
atccagtatgactgctcttccatagatgatgaaaccaaggcagagaaataagatgtaactctcttaccttgattagtgatgagaatgggacagctttattyatgaaacccggaaaccactagcccattcttgggatgattgatatctgcaaggatcttcaggaatagagtacctggggctcaggagccaagactagaagtg

SEQ ID NO: 19971 - DNA, 201 bp, Homo sapiens
aaaacagcctgcgtatgttcttgcttgcaactcagatatccagcccactgatccaggaagagattcctttgacctgggaagtcataatggcagatatttaracccagctctcaagcaagcctccaagttgttccggtgaacccgtaactttgagtaacctctgattgaaccagagagtaggaactaggtgcagaaccttgt

SEQ ID NO: 19972 - DNA, 201 bp, Homo sapiens
ccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattct

SEQ ID NO: 19973 - DNA, 201 bp, Homo sapiens
ctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacagttatgaagcaggggttactaaagtgggagagagca

SEQ ID NO: 19974 - DNA, 201 bp, Homo sapiens
gtgggtcccagaaatgagtttcatggaggggagagcttgtctctctgggtgggtaatacaggggccactgggggctcactgtggctttctggcacagacakttatgaagcaggggttactaaagtgggagagagcagccagttctccagcagccccagtgagagctctcatggatctgcctattgcactggggtaggagcc

SEQ ID NO: 19975 - DNA, 201 bp, Homo sapiens
agtttcatggaggggagagcttgtctctctgggtgggtaatacaggggccactgggggctcactgtggctttctggcacagacagttatgaagcaggggtkactaaagtgggagagagcagccagttctccagcagccccagtgagagctctcatggatctgcctattgcactggggtaggagccatcaccgtcagctttt

SEQ ID NO: 19976 - DNA, 201 bp, Homo sapiens
gaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctac

SEQ ID NO: 19977 - DNA, 201 bp, Homo sapiens
atcagtgacatatgtaaatgttttagggagctgtttactgtaacattacctactttagctctgtgcagttgtctggcaaccaatgtgataaagacagaggraagtgctgtattttgttgctgacaagtatatcttaaaagtgcaggtgcacctgaataggcaataaagtattaagagctgctcctggagcagtttgctctc

SEQ ID NO: 19978 - DNA, 201 bp, Homo sapiens
acatggtggcagcaagagaaaatgtggaagaagcaaaagtggaaaccctgataaacccatcagatctcgtcagacttattcactatcatgagaatagcacrggaaagaccagccctcatgattcaattacctcacctgggtccttcccataacacatgaaaattctgggagacacaattcaagttgagatttgggcgggga

SEQ ID NO: 19979 - DNA, 201 bp, Homo sapiens
gctcctggagcagtttgctctctgtgacgtgtgaaaagtctacggggtttataattggtctggccatacggctgcctaggattagactcttttcatatccyactaaacactctccttagaagcaagcacaaggagatagtttattttaaaatgtaattgctatgttactaagatttgaatttgagtaccgagaataaacca

SEQ ID NO: 19980 - DNA, 201 bp, Homo sapiens
aaaccctgataaacccatcagatctcgtcagacttattcactatcatgagaatagcacaggaaagaccagccctcatgattcaattacctcacctgggtcyttcccataacacatgaaaattctgggagacacaattcaagttgagatttgggcggggacacagccaaatcatatcaccctcttagcaaggactgtgttcg

SEQ ID NO: 19981 - DNA, 201 bp, Homo sapiens
tacttcattccatcctgggagacagagtctcactctgtctccaaaaaaaaaaaaaaaaaagagaagttcgttataacaaatgccatatgcccttttgtacrtgtcaactggacttctataaatttgtcattggtttatgcttttgaaaataagatgttagcattgtttaaaaatgtgataactataactttgaaagcaaaa

SEQ ID NO: 19982 - DNA, 201 bp, Homo sapiens
ctcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaag

SEQ ID NO: 19983 - DNA, 201 bp, Homo sapiens
gaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgt

SEQ ID NO: 19984 - DNA, 201 bp, Homo sapiens
gtgcagttgtctggcaaccaatgtgataaagacagagggaagtgctgtattttgttgctgacaagtatatcttaaaagtgcaggtgcacctgaataggcartaaagtattaagagctgctcctggagcagtttgctctctgtgacgtgtgaaaagtctacggggtttataattggtctggccatacggctgcctaggatta

SEQ ID NO: 19985 - DNA, 201 bp, Homo sapiens
acagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtc

SEQ ID NO: 19986 - DNA, 201 bp, Homo sapiens
tcaatcacgttcacctgttggagcaagtagagtttcagacggtctccgcttttctcgactagaaagcaggccttctcccttttccccccagtcttgtttcmtgacaccattcccctctgagatgagggttggagaattagaagtctactgatgcattgtaccggggcacgttattgaccctctctgctctcctttcctcat

SEQ ID NO: 19987 - DNA, 201 bp, Homo sapiens
tcttctgaattcgttgatatcccttgttgctgttcacaatacacccactcccagccctccgtgatggagataactctgttccccacaactagggcttgccsactctcatggtacttctgatgtttaattcttttggctgtgtctgcatttcctcatttacttttaatttgcttatccctagaacataccttttgagtgcct

SEQ ID NO: 19988 - DNA, 201 bp, Homo sapiens
ctgttcacaatacacccactcccagccctccgtgatggagataactctgttccccacaactagggcttgcccactctcatggtacttctgatgtttaattmttttggctgtgtctgcatttcctcatttacttttaatttgcttatccctagaacataccttttgagtgcctaaacttttttatcttcctgtcctgaagac

SEQ ID NO: 19989 - DNA, 201 bp, Homo sapiens
ccctccgtgatggagataactctgttccccacaactagggcttgcccactctcatggtacttctgatgtttaattcttttggctgtgtctgcatttcctcrtttacttttaatttgcttatccctagaacataccttttgagtgcctaaacttttttatcttcctgtcctgaagacaaaaatttaatctgtgaattaaacc

SEQ ID NO: 19990 - DNA, 201 bp, Homo sapiens
ggtggggctgagggcagccagtgtgactgaggctcgctggcccaccctgagctgcttgtgcccatggggcccctggggaggagggcccagctgcagtgcgsatacatctgcccttggcagcagatctgtgaacccaggctgccattctggatttccggatagatgcaaagtgcttggacgtgttttagcagctgctgagac

SEQ ID NO: 19991 - DNA, 201 bp, Homo sapiens
aacttaaaaaagcaacaactaacttatttgtatcttttcctctaatatttagtttttacttcacttgtaacttattacatgtattaaggagtttatttttwtatgacattttactcataaaaggatgaaaccaagattggtgatctgttcacatagattaaaatcctgtttgtgaccacttaggtgtgtaatgtgtgactt

SEQ ID NO: 19992 - DNA, 201 bp, Homo sapiens
caccctcaaacagttacccagtgagtctcctcaaagcaagtggcactgagatacaaccttcctacaggttttcaagtcatctcgtgtggtgcacagtcctsgccctacctcgaaggcccgggcgaagttttcctgagtgtgtatactcatctctttgtgttgtctctggcagggagcaagtgagtacaggattggagtaat

SEQ ID NO: 19993 - DNA, 201 bp, Homo sapiens
agaatttaaaataaaatacattttgacccattgtattgagagctggtataatttaatatagtgagcccctcggcttctggttggttgggttataaagcttsttattcattcgctcatccattaatgcatttctcctatgaggaagctttttcctttgagctgaacacacaaaattaatcgtgctcgaactctccaaatttt

SEQ ID NO: 19994 - DNA, 201 bp, Homo sapiens
ttttgagaatgtgttttccttaatatttgttaaatgagtagactgtattcttaaggtttagaaaggacagaaacaagtttgtgcttagttcttctgaattmgttgatatcccttgttgctgttcacaatacacccactcccagccctccgtgatggagataactctgttccccacaactagggcttgcccactctcatggt

SEQ ID NO: 19995 - DNA, 201 bp, Homo sapiens
gccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgccatgtgcttctggcaggcctggataaggtttgccctgcataacccttggaaagcaca

SEQ ID NO: 19996 - DNA, 201 bp, Homo sapiens
gaagagccctaacagtaggtcctggctggggtctggcatagaatgcccttggcacgatgtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgta

SEQ ID NO: 19997 - DNA, 201 bp, Homo sapiens
caagatttcagtggttctgggatgcatttgatctttatgcacacttcagctctgggtttcagttcaggggtcagcataagtaaagcttgatcagataactrtgctttgcctataatcggcattcattctgctggtgacagagtcctttgctcaaaatgaggcttccatgcgtttgcagttctaaactgcttttcagagtca

SEQ ID NO: 19998 - DNA, 201 bp, Homo sapiens
gcttagttagacatggaggatgcatcttaacaagttagtacctttttgcaaagcatgaagactaattcaaagtctattttctggttttgctctaccagtayggccaaaaccatttctttttaagtgagaagtggggatatggtcaggtttgattccagttgaagttgtgagctgcacagggctggtctgagcccagtggca

SEQ ID NO: 19999 - DNA, 201 bp, Homo sapiens
ccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataac

SEQ ID NO: 20000 - DNA, 201 bp, Homo sapiens
gaaaataaaccccacataactagtgctgctattgatcattcatatagccagcaggagtggtgagaggcttggtctgcctgaggtgtggagatgcttgtggyggggggcaaggtggacgagggctggggctgctcctggagcatctttacgcgggtggaggagctctgacacagtggcagtgtttgtaacactttccaaagg

SEQ ID NO: 20001 - DNA, 201 bp, Homo sapiens
gaacgaccatatccgtggggccaagagtgagatcttgtacattcgcaccaatgcttcaggtatccatgcctagacaagcccccagcatccacacttcttcrcaagctcactggccttgcttgtaccaggtgtcattgtagggttagcagtgagctatgcctgttgtctttcttgtcaataggtaatactgtgtcatattca

SEQ ID NO: 20002 - DNA, 201 bp, Homo sapiens
cacagcccggattcaggccacatctctctctgggaatgggtcgtggacagatcctgtgttcttctatgtccaggccaaaagtaaggcttgtggagggagamgaaacgtggtaaaactgaaagcagggtggtccaggatcaggacagcccgagtgttcatggctgtcttattttctgttaaaatggagttggccagcttcca

SEQ ID NO: 20003 - DNA, 201 bp, Homo sapiens
gtagaaacacacacgagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagcca

SEQ ID NO: 20004 - DNA, 201 bp, Homo sapiens
tcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccagg

SEQ ID NO: 20005 - DNA, 201 bp, Homo sapiens
tagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgg

SEQ ID NO: 20006 - DNA, 201 bp, Homo sapiens
aaatttctctttgtccctgcagggactgttgcagagcattagagccaccctcaaacagttacccagtgagtctcctcaaagcaagtggcactgagatacarccttcctacaggttttcaagtcatctcgtgtggtgcacagtcctcgccctacctcgaaggcccgggcgaagttttcctgagtgtgtatactcatctcttt

SEQ ID NO: 20007 - DNA, 201 bp, Homo sapiens
ttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctactt

SEQ ID NO: 20008 - DNA, 201 bp, Homo sapiens
tttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtcccc

SEQ ID NO: 20009 - DNA, 201 bp, Homo sapiens
cgatctcaaaagttatctccggtctctgaggccagaaatggaggtcagttttcatttccaccggtattgcatgttgcctggcctgctctcttttcctttayaatctccctgcaaggaaatgctgtgtctttaaatcagtttactttccagcatccagtgtttcttactgcatgctcagttgtaggtcatttatgcaaagga

SEQ ID NO: 20010 - DNA, 201 bp, Homo sapiens
ttcttctcaagggctcaagatgttttcccaatgcccagcgtctcatggatgacaaatatgacaagtaattttaccagaggcagtttgagggctcttagcayagcacaagtaaattatgttggttcaagtccaaggaactttgttctctttgtgtttgcttttgtagccttacctctttggggcatgagttagagacataca

SEQ ID NO: 20011 - DNA, 201 bp, Homo sapiens
agtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagccgtg

SEQ ID NO: 20012 - DNA, 201 bp, Homo sapiens
tgctggttgagcttctgctaagaggtttccttccagggactccatgttcactgcctcacaaaggcaggccagcctcatgctttagacatccttgctcttarcaaatctttcgtgttctgctacgtcagcctctgtgtgacacccattggaccttctctctgtagcacaattgcataccttgctctgttcttgataagatag

SEQ ID NO: 20013 - DNA, 201 bp, Homo sapiens
gtgtagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttc

SEQ ID NO: 20014 - DNA, 201 bp, Homo sapiens
caaactaacggtaggactttcctcagggatttaacgtttgctgtagaagactgaatgatagaatatataagctgtatttttcttgtgattctacacattgyccatgttgcaacttaaatatttttggaatgcaatgtaaaagtgatttactgtcctataattgttttcctgaaagcaaaatgatatttaagtgaactgcaa

SEQ ID NO: 20015 - DNA, 201 bp, Homo sapiens
ggttaggtgataccgccttgccagataaatggccgggactaggtagatgctgaacccagtatgctctgcgttcaaagcacagatcaggggcttcctgaccrtgcaagggatgccggaagcgccctcaccaccttccttagctccaccaccggggctgaatttagtttacggggaacattagcagcaacagagggaggatga

SEQ ID NO: 20016 - DNA, 201 bp, Homo sapiens
tttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctcctgcctgtaatcccagcacttt

SEQ ID NO: 20017 - DNA, 201 bp, Homo sapiens
tataaatctagacttcctttggaatttgtttcctttttctcagccaggtgtatgaagattttaagttcttaggcctcagtgggaagaagatttaaggttcyaagagtacatttgtatctcttttaaattttctattgtttatcagtgacatatgtaaatgttttagggagctgtttactgtaacattacctactttagctc

SEQ ID NO: 20018 - DNA, 201 bp, Homo sapiens
gtcctgctgtctggggagtcgttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaat

SEQ ID NO: 20019 - DNA, 201 bp, Homo sapiens
caccctctggtccagcgtgcctgttacagtgatcactccatagtggttttgcatgaacaagactgcccagtttgcttaggaagaaaacaaaggacataagktagttctcatgtcttcccagcaccctaaatactcgggctaaacttccacagtcagaccgtcagcttcaggaagggctgctgttgggaactttttttttag

SEQ ID NO: 20020 - DNA, 201 bp, Homo sapiens
aggagcttggaggtcagcttgtagtataataaaatagaaaactatacagccggggagaacagaagcagaatagaaggataaagtgttgttcatatctctcrggcaaattttacccaaattctgacgagcagttactgcacaagcaacaacaaagggacctagagtgtgttcattgccaattctgtccatttggctacataa

SEQ ID NO: 20021 - DNA, 201 bp, Homo sapiens
tctgacattacttagaagtatgtctgtccttgaatttttcttttgcttaccttttgatattgtttatatgatttatgaatgcagctctgaggtatctgagrggatttattaacgtttacttgcgtccaagtacatgattaagttttaattgctttgtggacattaaaaaattatgcccttggtaaaatgcaaaggttttat

SEQ ID NO: 20022 - DNA, 201 bp, Homo sapiens
gagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgtttttgtagagatggagtgttgccatgttggccaggct

SEQ ID NO: 20023 - DNA, 201 bp, Homo sapiens
ggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaagg

SEQ ID NO: 20024 - DNA, 201 bp, Homo sapiens; identical to SEQ ID NO: 3141

SEQ ID NO: 20025 - DNA, 201 bp, Homo sapiens
ggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggtgt

SEQ ID NO: 20026 - DNA, 201 bp, Homo sapiens
gaacttaaatattaacgtgtatataagttaatagtaagtagaccgtgaatttagaagagtaaaacagaatcatgagtacgtagtcactgtggccccttttytgctggatttcaagttcgtaagcatttttggaagagagtcgaaggggaaggggtggcttgccagtcagttgagtgatgcgtgagggaggcgttaaatgtg

SEQ ID NO: 20027 - DNA, 201 bp, Homo sapiens
ttagaatttaaaataaaatacattttgacccattgtattgagagctggtataatttaatatagtgagcccctcggcttctggttggttgggttataaagcytcttattcattcgctcatccattaatgcatttctcctatgaggaagctttttcctttgagctgaacacacaaaattaatcgtgctcgaactctccaaatt

SEQ ID NO: 20028 - DNA, 201 bp, Homo sapiens
accccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggttt

SEQ ID NO: 20029 - DNA, 201 bp, Homo sapiens
ttgacccattgtattgagagctggtataatttaatatagtgagcccctcggcttctggttggttgggttataaagcttcttattcattcgctcatccattmatgcatttctcctatgaggaagctttttcctttgagctgaacacacaaaattaatcgtgctcgaactctccaaattttgtgagttccctggtaactgact

SEQ ID NO: 20030 - DNA, 201 bp, Homo sapiens
tttctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaa

SEQ ID NO: 20031 - DNA, 201 bp, Homo sapiens
gcataaagctggaatgatggacatgatttctttaatcactccaaattagtcatttagttgtttccagttttttagtattacaaataactctgcaataaacrtgtcttgggtatgcattcttttagtttaaaatagtcttgttccttcagaaagttgctcaataatagacttagaaattcttttgtgctaattactgtaatt

SEQ ID NO: 20032 - DNA, 201 bp, Homo sapiens
acctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttc

SEQ ID NO: 20033 - DNA, 201 bp, Homo sapiens
ctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgt

SEQ ID NO: 20034 - DNA, 201 bp, Homo sapiens
taaatgtagggaaggtgaagtgttcaccttcagatggtagctatttatctcagcaagaagagcagatgactaacacccaaatacataaccattattatatracttagcatttataaggcatttctatgcatcctgagagactagagcactctcaaatgaggtttcagagtaagattcatctttgcaaatgaagacaaatta

SEQ ID NO: 20035 - DNA, 201 bp, Homo sapiens
tgtttctcccaccccaacatgaaaaagatggagtgagcctgcagccctgagttgatattgctttttaaattgagaacaatataattacagccttgtactgkttataaaactttaaggtctcatatcagagatacagcagtgcctttctcatctaaccctgtgtagaatacggctgttgagaatggcgtggctctctggctg

SEQ ID NO: 20036 - DNA, 201 bp, Homo sapiens
ggtccacttaatggaagagtctaagagtggcttcaggaagtccactgggggctccccgtgactctgcccacctgcatattgtcttcattctaaggatccakgtggtagcaaaagggttgttacaactttaaccctgcatccccaccttcaggttcagtacccaagggtgagcaatctgttccagtggcacagacctgtttc

SEQ ID NO: 20037 - DNA, 201 bp, Homo sapiens
caactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattg

SEQ ID NO: 20038 - DNA, 201 bp, Homo sapiens
tcttttcacctttggcttttaataagggaagggtattagaaaaaaagtaatttgtatgatgaagggtgatttgtgcgtgtgtgcagacagacacacatgcrgggaggcaaatcagaaccgatgcgtgtttggctttggcttgtttcgctggtgtctggatttacctggcgacacttgttgctctgggggatcttagaggga

SEQ ID NO: 20039 - DNA, 201 bp, Homo sapiens
ccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgctttttccagaattaggtcagtccagactcatgaacgatgatgggggacttcactgaaatatc

SEQ ID NO: 20040 - DNA, 201 bp, Homo sapiens
agtaatttgaaacacccgtgtaaactacctttggcaaataggatagctaaatcaccgctaagatttataatttactttttggatatctgaaacatcaacartatagccatccatggcgtgttcctctggagtgtggtccgtgccgtctctgcctgctccatctggctgatcccaggcaggcagctcagctctcagcagaca

SEQ ID NO: 20041 - DNA, 201 bp, Homo sapiens
atgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccgttgtacat

SEQ ID NO: 20042 - DNA, 201 bp, Homo sapiens
tgacagccatgattgggaaagtgttagctcgaggcctgtcattctttagtgagtgattagagatgtttgaataaaataaacccaaaatggggaaagcttgytttttccagaattaggtcagtccagactcatgaacgatgatgggggacttcactgaaatatcgtttcagcctccttacctactaggcctactccaggaac

SEQ ID NO: 20043 - DNA, 201 bp, Homo sapiens
ttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgct

SEQ ID NO: 20044 - DNA, 201 bp, Homo sapiens
caactacttaggatttttgttgttgttgttgttttcctgtacattgtcttcctatctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctg

SEQ ID NO: 20045 - DNA, 201 bp, Homo sapiens
ttgctccctgttcagatcatagtaaaatcggatgtatccgagtatttcagagtgcttgtctccttagagtcagccagtctgacctgtcagatcataatacrtagtagccgtttattttcttttgaaagcaaaatcatggtttcctctctaaataacacttcagcaggaactgtgacatttcccaatctcagttgcgcacat

SEQ ID NO: 20046 - DNA, 201 bp, Homo sapiens
agtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttacc

SEQ ID NO: 20047 - DNA, 201 bp, Homo sapiens
acaaggcattttaccaagtccggctgaaagagcttcttaccacatctggcatgtagaatggcagaagactatttttgctagattccttgttgctgcagccrtttctgatgtccttttccccttcacacctttcgtgttacacatgtctgagatgacatgatgctaagtaaccaaagtactgctgcgatggaattgctctga

SEQ ID NO: 20048 - DNA, 201 bp, Homo sapiens
aaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttt

SEQ ID NO: 20049 - DNA, 201 bp, Homo sapiens
tgttttggtgaaacctgataaccttgcttttctccgtgtaccttgtttttcattgtaaaactatttaattatgaaaatgagagtgtgaaaggcaaagtatrattgaatttagggggcagttccatatagttgtaacaaactgattatcaaatgtccaccattagtatgttaaaatacggttttctaatactgagacaacag

SEQ ID NO: 20050 - DNA, 201 bp, Homo sapiens
gtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaatcagatcaagttctctctctcctg

SEQ ID NO: 20051 - DNA, 201 bp, Homo sapiens
tcattttgggttgaggtatcccctggtaccctctcctgaacttcaatagaataacatgatgtggtgaatgaaccatattagaaaaaccagccaatcagccragattcttgtattgactcttctgatctccctctacctctcctttccccatctgccaaacaaagggtttggaacagttaaattctaaagtggtgtcattga

SEQ ID NO: 20052 - DNA, 201 bp, Homo sapiens
tggcacagagatttgctgtctggctagcagtacttcagggtactgggtggcttgaggacctcctgttagaagcttggattcacttttcccaaggcaaccasgattggattctattagttctgggtcttgagagcctgcaagggcttccttctgcgaaggtgagtctgggagagacgccatggagtcagtgtgagttctgca

SEQ ID NO: 20053 - DNA, 201 bp, Homo sapiens
gtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctgt

SEQ ID NO: 20054 - DNA, 201 bp, Homo sapiens
tttcttatactcagtcatttgtgaatgatgtggttcaaacaaaactgaaacaaaaatagtttttctcattaaaaatatgtttgtcgcatagccagcactcrgaactagggagggtaacatggaagtattgtcattctcggggctgactggttgacagcagcctatacaggagtggagaatattgacagggctgcccgttct

SEQ ID NO: 20055 - DNA, 201 bp, Homo sapiens
aggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagc

SEQ ID NO: 20056 - DNA, 201 bp, Homo sapiens
agaatgggagttggaaagaaatgttttctcccacacctgtcccgctcctgtctactgaaagctgattaatcagtcagatagtgagttcctattggtagtamgcctccaaaatttggaagaggggaggtggcgtgatgtgaaaaagcaaggctttagggagagattcccgctgggggcattcaccctctggtccagcgtgcc

SEQ ID NO: 20057 - DNA, 201 bp, Homo sapiens
ttactagttacgtagctcaggaacctggaaccagactccttctccagctgggcagtcccaggtttgagtcctggctccactggaggttgtctgacttggakgttaataataacctgccttagtcccagagtccttagagggaaaataggttataatacctgagtccatgtgtatcaagccattgctggttccaggcccctg

SEQ ID NO: 20058 - DNA, 201 bp, Homo sapiens
gatgttcagaaccttgtgtgtatcgtataacctggagcaccctcaagctgtccgcccttttcaagttttaaaaatggcttaggcaaacatattgcttaagygatatccagtgaaggtgtctcctgtgctttgaaaaaccatcaacattgatgcttttttgtgacccaataaggacaagatttcagtggttctgggatgcat

SEQ ID NO: 20059 - DNA, 201 bp, Homo sapiens
ctctcttaagaagtttcagggcagcctaaaggctcaccttcaccctaccaggccccctttcatagccaggatcttagggatggagaagaaagataagttcrcctcgttcactgaagtcgccccttgttttcaggttaggaaacccaggttcatgtccaagtccctgggcaagtagccagcgtaactgattgacctaaaaca

SEQ ID NO: 20060 - DNA, 201 bp, Homo sapiens
caagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtct

SEQ ID NO: 20061 - DNA, 201 bp, Homo sapiens
gagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaa

SEQ ID NO: 20062 - DNA, 201 bp, Homo sapiens
gtaaaatgaagcctctgcatccttcagtaacttacttaaaattttgttagggctgcattttcttcaaagccaagttctgaataagaagtatttgttttggrctctagccagattactgaagtattgttgagggagatttgctgtggaaggtgttgggggtacagggattgtgaagataatgtaaaatatttaacattttaa

SEQ ID NO: 20063 - DNA, 201 bp, Homo sapiens
ttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaa

SEQ ID NO: 20064 - DNA, 201 bp, Homo sapiens
tagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacatta

SEQ ID NO: 20065 - DNA, 201 bp, Homo sapiens
ctaatacagtcagcccagccaagatagtgccatcctccgcaagcatccactaaggcatggagtcagcttccgtcattgttagatcagtacttgtttctttsccttgcttatttttcctaacctctctgaacctgctgtgttggaagcttaaggaacatcatcctctgttgggcagaattcttccatggccaccccagcatt

SEQ ID NO: 20066 - DNA, 201 bp, Homo sapiens
tgctgggattataggcgtgagccactgcacctggcttatttaaatttttatgggtatgaattcacttaaaagctgaaggttttgagaggagagggagcatrtgaaaaaacctaaaggttttgggaggaggaggagaaggaagagagggagcatgtgaacaagagcaactgattacttccttgtcattcatttgcccagtgt

SEQ ID NO: 20067 - DNA, 201 bp, Homo sapiens
cccaaagtgctgggattataggcgtgagccactgcacctggcttatttaaatttttatgggtatgaattcacttaaaagctgaaggttttgagaggagagrgagcatatgaaaaaacctaaaggttttgggaggaggaggagaaggaagagagggagcatgtgaacaagagcaactgattacttccttgtcattcatttgc

SEQ ID NO: 20068 - DNA, 201 bp, Homo sapiens
ttcactcccatgacccaatcacctcccaaaggccatgcctcctaattccatccccttaggggttaggattttgacatgtgagttttggtaggggacacagrcattcactctatagcactgataaacattctttgataatagccattattttagtgggtaaggtgtttttaaatacccataagcgagcacaaaatcagttta

SEQ ID NO: 20069 - DNA, 201 bp, Homo sapiens
tggtggacttccgtgttctttgcattgcctctcccccatccctcttacacacagctgtgacatgggcatgcacactccttcacacacacagactctccagscccctttccacttcctctttccatttggcttcatgacatttttatcagagattcaaaatctcagatgaaatccaagtcagcctgttttaccagttgtcga

SEQ ID NO: 20070 - DNA, 201 bp, Homo sapiens
gaccccagccgaaggcctcagccctgttttctcaccattcgtccatggctgacctgagggttgccctttctccatctgggtgctcctctcgtattctgttygtttttgttggttcctgtaaacattagaattctgttttaaggtttctagggggagccacaaagcccatttcttcatatttgaccaaagcagcaattagag

SEQ ID NO: 20071 - DNA, 201 bp, Homo sapiens
ggctgcattttcttcaaagccaagttctgaataagaagtatttgttttgggctctagccagattactgaagtattgttgagggagatttgctgtggaaggkgttgggggtacagggattgtgaagataatgtaaaatatttaacattttaaaaattttcagtaagttctctttccccaatgtcagcatgacttcttcattc

SEQ ID NO: 20072 - DNA, 201 bp, Homo sapiens
aaattacttaacctctctatgcctcaatgttctcatctctaaagtatggaaaataattgcatctgtgtgaaaactgagttactatacgtaaagtttttagratagtacctgacatacagtaagtgctgaataagtatcagctagagagagagagagttagtttccagcagcctgtttctgtttggggtcacatgtggtctc

SEQ ID NO: 20073 - DNA, 201 bp, Homo sapiens
ccaccctcaaacaatgatttccccaaattggacagcctgggtttgtatccttgagcacagttttgggaagagcattctgcatgaggcattgtagctatgtrtatggagtataattctgttttcaggttgctctgccacagaggttaagaactccctcttccaaggtagacattgagaacagagacgaccacactgggtttt

SEQ ID NO: 20074 - DNA, 201 bp, Homo sapiens
aactatctcaaggtaattacccttttgaatacttgaggacatcttttctgtgccctctgaatatttccttccccagataaaatatttctagttcttttacytgttctttgtttcagagttttaagtctccatttgataaagtatagtttaatagccttcgaaaccacatcgttgagatttaaaaagccctccttgagagac

SEQ ID NO: 20075 - DNA, 201 bp, Homo sapiens
ttacccttttgaatacttgaggacatcttttctgtgccctctgaatatttccttccccagataaaatatttctagttcttttacttgttctttgtttcagrgttttaagtctccatttgataaagtatagtttaatagccttcgaaaccacatcgttgagatttaaaaagccctccttgagagacatgaccagtagaaatc

SEQ ID NO: 20076 - DNA, 201 bp, Homo sapiens
ggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgccc

SEQ ID NO: 20077 - DNA, 201 bp, Homo sapiens
tcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccag

SEQ ID NO: 20078 - DNA, 201 bp, Homo sapiens
cagagagcttattagtgtcttggccatttggaattccatttcacttaaattagaagagtgaaagagaaatgaatggaagaccaaaaatggggagaagaaaytgtatctgatataagcgtggctctacctgggagaatggccattccgaattactggaaacaggaagaagacttgctatgatgcttccttatatctgtgggg

SEQ ID NO: 20079 - DNA, 201 bp, Homo sapiens
acaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaac

SEQ ID NO: 20080 - DNA, 201 bp, Homo sapiens
cttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaa

SEQ ID NO: 20081 - DNA, 201 bp, Homo sapiens
gaccgcttaggaagctgctgggaccgtgcatatgagagatgttggtggcttgaaccagtgctgggtttctcagcattggcagtattgacgttttgggtgarataattagttggggagtggcagggcggggggtaggggtgcagtcctgaaccagtgccaggtttctcagcattggcactgttggcattttgggtgagataa

SEQ ID NO: 20082 - DNA, 201 bp, Homo sapiens
gaaataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctag

SEQ ID NO: 20083 - DNA, 201 bp, Homo sapiens
aggctgatctaatcagggtattaaccttgccccactcatcttgatttattcctagatcccagttcccagagcatccctttagagcctcagaaatggaacamaagacagctgaaataagcccgtggccaaaaggcactctgagcatgagggaagtaagcaggcttccctgtcactgctgaggctctgtcatccagccccagc

SEQ ID NO: 20084 - DNA, 201 bp, Homo sapiens
ccctgcctttttctgagttgggccggctgggcccgaggctggttctgggctgggccaggctgatgcagtggccttgggcttcccgaggctgggagagggcrgtggcccccgctaccctgaagagctggccaacgcggcagggctctttccagtccttaccatgcaagtgaagaggaacagtttgtttaaagaggggtgcca

SEQ ID NO: 20085 - DNA, 201 bp, Homo sapiens
tgacacttgcagagtagagaaagcaagataatgaggaaggacatccctgtgttattcatgagttcttacctaagggggctcaatagctccttctattccayggttaagattcttctgttactcttactcaagtcatagaaaagacaaaagaggtaaaagtacttaaaagccacatttctctcctccttgcagacctgaaag

SEQ ID NO: 20086 - DNA, 201 bp, Homo sapiens
ggaggttaccaggggctgagggtgagggagcagatttggggagatgttagtcaaaggatacaaaatttcagttagataggaggaataagttcaatagatayattgtacatgatgacagtaataatgatgtattcttaaaaattgctgagacaatagattttaagtgttctcaccacacacaaaaaaatgtgatgtaataca

SEQ ID NO: 20087 - DNA, 201 bp, Homo sapiens
gccagctttccgttggtaatgatcacctctgagtgtttttaggaattgcaaaatgctggagcctgcatccattttgagagctacaatatcaataaaaatayttctttcttcgattaaaatacttctaattttaaaaattaaaatagctgtagtagtctttaaagagtaaccatgatcacagttttccatggcaaaataatc

SEQ ID NO: 20088 - DNA, 201 bp, Homo sapiens
tgccagaaataacatacaaatttatcatcatacaactgtacaatatgcaaataacttgctagatgatattactgaagattctacatccaattaaaataaaragagaaaacaccttaagataaccatactattaaaagatacagaagacaactggaataaatggaaagacataccacatttattagacaggaataatcatca

SEQ ID NO: 20089 - DNA, 201 bp, Homo sapiens
aagatgcggagcggagtttgcgtggcccggagcagctccagtgtctgaggcttctctgtgtcacaggctccaagcaggaagcgcaggcaaaatggcaaaayacagcatgtggcattcagttcaaaaatgcccttttttagaagtcggtattctaaatgacatccagtcttgcttagttttttaagagaaaggaaaaataat

SEQ ID NO: 20090 - DNA, 201 bp, Homo sapiens
caaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgaggg

SEQ ID NO: 20091 - DNA, 201 bp, Homo sapiens
gaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctc

SEQ ID NO: 20092 - DNA, 201 bp, Homo sapiens
gaggtggccgagcttgtctggcttccagaggagctttctctgtcccgcccgggggagtggctcaccttggtctgagaccaatgggaggaagcctgctgcgrgcaactggtctgtgcctggaagttggacttgcattttctctggacctccaaagcaaacccgaatgaccactctcatcctccccttttgcttgtttgtgta

SEQ ID NO: 20093 - DNA, 201 bp, Homo sapiens
ccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagatt

SEQ ID NO: 20094 - DNA, 201 bp, Homo sapiens
gcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatcttt

SEQ ID NO: 20095 - DNA, 201 bp, Homo sapiens
aaagtgccagtctctctatgggttttagagctgatttagatacatgcattgctaatacagtcagcccagccaagatagtgccatcctccgcaagcatccamtaaggcatggagtcagcttccgtcattgttagatcagtacttgtttctttcccttgcttatttttcctaacctctctgaacctgctgtgttggaagctta

SEQ ID NO: 20096 - DNA, 201 bp, Homo sapiens
tttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtct

SEQ ID NO: 20097 - DNA, 201 bp, Homo sapiens
ccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcct

SEQ ID NO: 20098 - DNA, 201 bp, Homo sapiens
ttttattttcaagacaggttctcactctgtcacccaagctggagtgcagtgttgtgatcatggctcactgcagcctcaacctccagggctcaagtgattcytccaccttagcctcccaagtacctaggaacacaggcgcacaccaccactcacaactgactaatttttaaaattttttatacagacagggtcttgctgtgt

SEQ ID NO: 20099 - DNA, 201 bp, Homo sapiens
attaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtccttta

SEQ ID NO: 20100 - DNA, 201 bp, Homo sapiens
acccaagctggagtgcagtgttgtgatcatggctcactgcagcctcaacctccagggctcaagtgattcttccaccttagcctcccaagtacctaggaacrcaggcgcacaccaccactcacaactgactaatttttaaaattttttatacagacagggtcttgctgtgttgcccaggctgatcttgaattcctgggcaca

SEQ ID NO: 20101 - DNA, 201 bp, Homo sapiens
acacttctcatttttctggttagactacttaaccataacattcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccaga

SEQ ID NO: 20102 - DNA, 201 bp, Homo sapiens
accaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgt

SEQ ID NO: 20103 - DNA, 201 bp, Homo sapiens
agcaaatactctgcatgttgagtgctttcaaaatacagaaacaaacaacttgtggaggcattggaaaagtgtgtttgagaaacaagcagcctcaccatgartgggagtttgtttccctttctcgtctttctggtcatctgctgcacgggcaggaggagctgtgggttgcttttcttccttggaacatggagcaccactctc

SEQ ID NO: 20104 - DNA, 201 bp, Homo sapiens
aatgttctcatctctaaagtatggaaaataattgcatctgtgtgaaaactgagttactatacgtaaagtttttagaatagtacctgacatacagtaagtgytgaataagtatcagctagagagagagagagttagtttccagcagcctgtttctgtttggggtcacatgtggtctctgtccacctggctttttaggcctct

SEQ ID NO: 20105 - DNA, 201 bp, Homo sapiens
tgccccagggaggagtttgagttggtacatcctgactgggtactctgcctgtggttagcaaatactctgcatgttgagtgctttcaaaatacagaaacaarcaacttgtggaggcattggaaaagtgtgtttgagaaacaagcagcctcaccatgaatgggagtttgtttccctttctcgtctttctggtcatctgctgca

SEQ ID NO: 20106 - DNA, 201 bp, Homo sapiens
gtgctgggattaaggtatgagccaccttgcccggctaccggacagtccactctttacaggggggcgtcttggtataagtatggaaagctccgtagatgccrtgtcagtccataccctcaccaccttcttgaccctgtgccgataaactaagagatgtgggcagtgtaccatctggaaaggaaaaggctttggagccaggta

SEQ ID NO: 20107 - DNA, 201 bp, Homo sapiens
ccaggttcaagtgattcttgtgcctcagcctcccaagcagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattaca

SEQ ID NO: 20108 - DNA, 201 bp, Homo sapiens
tcatggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatga

SEQ ID NO: 20109 - DNA, 201 bp, Homo sapiens
catggggaagggtgtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaa

SEQ ID NO: 20110 - DNA, 201 bp, Homo sapiens
ctttaaccagagagttggaggttgcagggagccgagatcgcaccactgcactccagcctgggtgacaaagcgagactccatctcaaaaaaaaaaaaaaatrcccacaactgggcatggtggctcatgcctgtaatcccagcactttgggaggctgaggcgggcagatcacgaggtcaggagatcgagaccatcctggctaa

SEQ ID NO: 20111 - DNA, 201 bp, Homo sapiens
agctaaatcaccgctaagatttataatttactttttggatatctgaaacatcaacaatatagccatccatggcgtgttcctctggagtgtggtccgtgccrtctctgcctgctccatctggctgatcccaggcaggcagctcagctctcagcagacacagatccccagcacatatgaacgtgaaagaggcttctccgtggg

SEQ ID NO: 20112 - DNA, 201 bp, Homo sapiens
tggtgacagcaggttaaggagagtgtcagagctggtgcagagttttgccccggggccatgaggttctgggcatcatgactctcttatgaagttacaaaackgggcaagtgattgaaggcagaaagacactgtaataaagtgtgctccagtgatgtgtgctccggcttctctcccttactcatctgggccaggtgctttcgc

SEQ ID NO: 20113 - DNA, 201 bp, Homo sapiens
cactcgccttggggggatggtatgagctgtcatactgtatgagcctcatcctggggccatgacttaccaagccagatcatctctgtgagtctgcctggtgkaaagacaaggatcagtgacttctttgtaggtctgaactgggtaatgcagagcatgccctggagacatggcatgtccccccaattctccaagacatgacag

SEQ ID NO: 20114 - DNA, 201 bp, Homo sapiens
cgattgaggcacctctgaaaagtccaaaactcactcccttcctctccagtttcaggcacagaataaaaattcagaacacatggccttggtcctggctctgyggctggctgcctgtggtcctcagacagctgctgcaggttcctgggcctcagtgtcctcaatataaaataagagggtgggacaagattactgaagtccctt

SEQ ID NO: 20115 - DNA, 201 bp, Homo sapiens
ctcactcccttcctctccagtttcaggcacagaataaaaattcagaacacatggccttggtcctggctctgtggctggctgcctgtggtcctcagacagcygctgcaggttcctgggcctcagtgtcctcaatataaaataagagggtgggacaagattactgaagtccctttcagaactaaaattcacctttagattggt

SEQ ID NO: 20116 - DNA, 201 bp, Homo sapiens
ttctctaggaatcatctgtaaaaagtagaggtttgtcatatctctaaactagggattcaccttatttattaagctatcagtgactttatcttgaggtgcayggcttttagtaactctggttcaagtgcaaggaatgcaaagttaagtgtatcattggaggtgggatttttgagtttgtcagtcatttattgatttgcatgt

SEQ ID NO: 20117 - DNA, 201 bp, Homo sapiens
ctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctga

SEQ ID NO: 20118 - DNA, 201 bp, Homo sapiens
taatacggttatcaaaacagtgttcactccatactccagtgctgttaatctccagactgaattcggatttcactattttcccactgatgtccctttttttkgttccagatccaagagacgatcctacctggcatttattgtgttcagtttttctaattctgggacgttttcctgggttttctttagtcattcacgaagttc

SEQ ID NO: 20119 - DNA, 201 bp, Homo sapiens
caaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcac

SEQ ID NO: 20120 - DNA, 201 bp, Homo sapiens
ttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttga

SEQ ID NO: 20121 - DNA, 201 bp, Homo sapiens
ggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcct

SEQ ID NO: 20122 - DNA, 201 bp, Homo sapiens
ttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaata

SEQ ID NO: 20123 - DNA, 201 bp, Homo sapiens
actacataagatgtgctgttcctctctctttctgtttgaaagtgacttggcagggtgaagttgagaaccccttggaaaggaggaagccgaaatgcaaacamagttgaatcatgaagtgatgtcactctgaaccaattggagcagtggtgtcatgtgcctggcagctacttcaaatgcccacaaaacaggagtaatggttta

SEQ ID NO: 20124 - DNA, 201 bp, Homo sapiens
ttttagaggcaggatcttgctgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctaccca

SEQ ID NO: 20125 - DNA, 201 bp, Homo sapiens
aagtaatcctccacctcagcctcctgagtagctgggactactggtatgcgccaccatgcctggctaagttttttctttttcttttagaggcaggatcttgytgtgttgcccaggctggtctcaaactcatgacctcaagtgatcctcccaccttcacctcccaaagtgctggcattgcaggcgtgagccaccatgcctgac

SEQ ID NO: 20126 - DNA, 201 bp, Homo sapiens
tgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatc

SEQ ID NO: 20127 - DNA, 201 bp, Homo sapiens
gttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatca

SEQ ID NO: 20128 - DNA, 201 bp, Homo sapiens
tcacagctccaggaacttgcaaggaaagggactaacggggcatctgattcacccgtgtgcccttaatggcgtattgtgtgaataaagcaacaatttttagyacagggatttaaaacaacttctgcaaagacagaactaaaaattaatcttaaaaggtggagggttggggtggagggcaggaaagaggaggaactaaattgc

SEQ ID NO: 20129 - DNA, 201 bp, Homo sapiens
tctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcata

SEQ ID NO: 20130 - DNA, 201 bp, Homo sapiens
tgttttggttcatttgtagtttccccccgcttcgttgtttcctcagatatggagaataaagcctggctggtcagtttcagtttttatttaaattcattttrtcttcattccttttaatctagcacagtcctgtgatgtattgggatcacagtgctctggggaaacattgaaatataaaaacattttcctgaaaacatttcc

SEQ ID NO: 20131 - DNA, 201 bp, Homo sapiens
ctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatag

SEQ ID NO: 20132 - DNA, 201 bp, Homo sapiens
atggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagct

SEQ ID NO: 20133 - DNA, 201 bp, Homo sapiens
tggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctc

SEQ ID NO: 20134 - DNA, 201 bp, Homo sapiens
gaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcac

SEQ ID NO: 20135 - DNA, 201 bp, Homo sapiens
aattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcact

SEQ ID NO: 20136 - DNA, 201 bp, Homo sapiens
ttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatt

SEQ ID NO: 20137 - DNA, 201 bp, Homo sapiens
tgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcattt

SEQ ID NO: 20138 - DNA, 201 bp, Homo sapiens
taaaataagagggtgggacaagattactgaagtccctttcagaactaaaattcacctttagattggtcagatttaaactttttctttctagctcatgtcargtattaaaatgtgtgcacttaccctgcagtttcattatattcaacctgctcccccgaccaagtttcacttacgtatctcactacgagtaggtgtatatgt

SEQ ID NO: 20139 - DNA, 201 bp, Homo sapiens
ctgcaaagaggaatgcttatccctgttacttattcctggtttcctccaagactagtttcagctggacttcagttgccaaggacttgtcttctgtaatgccsacagaaaataataatgccacattgtaaggtgaaaacagtaatcctggtatttttgtattttagaagaaggttgaagggaaagaaaaggattaaataattt

SEQ ID NO: 20140 - DNA, 201 bp, Homo sapiens
taatgccacattgtaaggtgaaaacagtaatcctggtatttttgtattttagaagaaggttgaagggaaagaaaaggattaaataatttataacgatgctyttatgggaaataaaatataccatgtccatttggaaacacatttgcttacttccacacagcctttgtaacgtgctctccttcctcttacctgtacttcggt

SEQ ID NO: 20141 - DNA, 201 bp, Homo sapiens
acgcctctgtctctgtcccccgccgccaccacacagatgcacgtactctcttcacttccgtgtacccagtaaatgcagatcctgatttaaatctgcagcaygctgctttcttcccattgcatgtgggaagcttcaggttctcttcggtttattttctcatcacctttattaaaatgcagtaaagcaaggagtatattaatg

SEQ ID NO: 20142 - DNA, 201 bp, Homo sapiens
tctgtgttctgaacctggagtacaggcagacacagccgcatcccagaagctcaagagtgcccataccaggaaattacagaaatctttgccaaatggatgartgaatgcaacttccttgatacagggtcagagaggggaaatctgagaaaagcaggtgggcaatgtactcctgacatactcccttccgttgcaatggccttg

SEQ ID NO: 20143 - DNA, 201 bp, Homo sapiens
ctgccatccccatgctctgcctcctaagcagaggatgaacttaagcatcttaaaattttaaacattgactttccctaaaaccaattaaaaaaaaaaacaaracagacagacagacatgacttgtgcccttaaaaatgcagccaggctggcatataaatgggcgtaggctgtttctaaattttttgctttaaattttgccag

SEQ ID NO: 20144 - DNA, 201 bp, Homo sapiens
catggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgtaaagacaaggatcagtgacttc

SEQ ID NO: 20145 - DNA, 201 bp, Homo sapiens
tatagtggtggcattctgcctaagtcatcttgaaaactgaatgcaaaatctttttaatagctccataatggtctcttgaagtgttacagatttttataacratagctgtaatacaagtgcctttatttactgtgagacttgaacattttgaccatttacatgggtacttgtgtgtctccagctgagctgagtgcatgtcgc

SEQ ID NO: 20146 - DNA, 201 bp, Homo sapiens
ctctgagtgtttttaggaattgcaaaatgctggagcctgcatccattttgagagctacaatatcaataaaaatacttctttcttcgattaaaatacttctmattttaaaaattaaaatagctgtagtagtctttaaagagtaaccatgatcacagttttccatggcaaaataatcattgataggggacttacgattaatgt

SEQ ID NO: 20147 - DNA, 201 bp, Homo sapiens
cccgtccccacaatatcttagggcgaagaaaagcaggtttgagaaaagctttttttcatcatgtatttgtaatagctggagcctgctgagatgatgaggtrgagtggagggagaaagagaccttgaggaggtgtggagggggaaggggtggaaagttctgtcgtcttctgtgcctctctctctctcttgctcagggtctcc

SEQ ID NO: 20148 - DNA, 201 bp, Homo sapiens
gcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttg

SEQ ID NO: 20149 - DNA, 201 bp, Homo sapiens
catacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgc

SEQ ID NO: 20150 - DNA, 201 bp, Homo sapiens
agtctcctcaaagcaagtggcactgagatacaaccttcctacaggttttcaagtcatctcgtgtggtgcacagtcctcgccctacctcgaaggcccgggcraagttttcctgagtgtgtatactcatctctttgtgttgtctctggcagggagcaagtgagtacaggattggagtaataggcatttttaggcttgagatgg

SEQ ID NO: 20151 - DNA, 201 bp, Homo sapiens
aaatagagttatagtgctacaatgagataaatttcacaggtaaatgtgacgtagctaatgcataatcattctttgtgttgcatggcaattctgtacaaatrgaaggtagcatgtttaacgttcctgttatttcacataaatacagactgagagtttcagtggtctggtttgaaagggaagaaatagaagaaggaaggagag

SEQ ID NO: 20152 - DNA, 201 bp, Homo sapiens
ctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgcgaccgacacacagcacaagcgtcatcctgttctgcctgtccc

SEQ ID NO: 20153 - DNA, 201 bp, Homo sapiens
cctgggggtgtgtgggggtggttggttggggtttgcttgttagtttgttgtaaaagcccagcttttcattcttggaaagatttcagccaactcgagagggttacctgccaggaatgctgcagaagcaagaactcagtgggtgagcacttccatttcttcaacaaatgcttctgagtccctgacctgtgccaggtgctcttc

SEQ ID NO: 20154 - DNA, 201 bp, Homo sapiens
atttacttaataattgtgtctattgaatgtattcttatacatacacacaggcatgcacacacggacacgaatataagctttacaaggacagaaaccttatyttttatttatttcttccttgtgtatcctgagcactgagaacagcctggcacaaagcagggctcaggaaatgtttgctgaatgcatgttcacactggatgt

SEQ ID NO: 20155 - DNA, 201 bp, Homo sapiens
aatttgaaacacccgtgtaaactacctttggcaaataggatagctaaatcaccgctaagatttataatttactttttggatatctgaaacatcaacaatayagccatccatggcgtgttcctctggagtgtggtccgtgccgtctctgcctgctccatctggctgatcccaggcaggcagctcagctctcagcagacacag

SEQ ID NO: 20156 - DNA, 201 bp, Homo sapiens
gcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagattt

SEQ ID NO: 20157 - DNA, 201 bp, Homo sapiens
cttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttc

SEQ ID NO: 20158 - DNA, 201 bp, Homo sapiens
agaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcact

SEQ ID NO: 20159 - DNA, 201 bp, Homo sapiens
gaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactg

SEQ ID NO: 20160 - DNA, 201 bp, Homo sapiens
tgcactgcttcctgctgggggcagaacaaagagagcgggcattgtctctggcataaatgaacctctatcaaaacaaacacccagagagaggggcagcctgrttacagctgcctgtgtgagcctcgacagtgggcctcattcctcacaaagggagctttgaggcccggaagaggcctttccttgatgatcgagctgtgcaca

SEQ ID NO: 20161 - DNA, 201 bp, Homo sapiens
aagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgc

SEQ ID NO: 20162 - DNA, 201 bp, Homo sapiens
cagcctttaggtttgtgtttttacttcggtcttttaatctgcctaataaaaacacacataacatcagggctgctcaggaaaccacctgcttttaccaggaytctcatcttcccactatgatacaatgatagtttagaaaaataccaaatatttatcctgagaaactgcaggggagatttaacacccaaaagaagctatttc

SEQ ID NO: 20163 - DNA, 201 bp, Homo sapiens
atgagaaggacttggtgcaggaaagcagcagcacgtgcctggcacagggcagggcctctccagatggcagttcctgtctgtgtcttattcccaccctccgrgcacatggggggaactcagtttctccccactgcgcgtcaccctgggagaggtgttttttgtgccaattgccattttaaatccaaatcagcagggatcatg

SEQ ID NO: 20164 - DNA, 201 bp, Homo sapiens
ttgcttgcaactcagatatccagcccactgatccaggaagagattcctttgacctgggaagtcataatggcagatatttagacccagctctcaagcaagcmtccaagttgttccggtgaacccgtaactttgagtaacctctgattgaaccagagagtaggaactaggtgcagaaccttgttgaatagaattgtttagcat

SEQ ID NO: 20165 - DNA, 201 bp, Homo sapiens
agttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgca

SEQ ID NO: 20166 - DNA, 201 bp, Homo sapiens
gagaccatggcacgcatgctgtgtgtcgaaggccaggtccgcctgtctgcctctccagcagatactctctggggctatttttttctgcttggttgtcatcytttggtttaaccaggcgccagggctcaggcctggacctgctggattccaaagaagacttcgaggtggccgagcttgtctggcttccagaggagctttctc

SEQ ID NO: 20167 - DNA, 201 bp, Homo sapiens
agctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattc

SEQ ID NO: 20168 - DNA, 201 bp, Homo sapiens
tgaggcaggagaatggcttgaacccaggaggcagagcttgcagtgagccgagatcacgccactgcactccagcctgggtgacagagcgaaactccatctcaaaaaaaaaaaaaaagttatttctctatgtaaacaaagaaaactctccttccttataacttgtatgtgttgggtctatttgtattctgtgaaccataagaa

SEQ ID NO: 20169 - DNA, 201 bp, Homo sapiens
gttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggag

SEQ ID NO: 20170 - DNA, 201 bp, Homo sapiens
ccttcaccaatttttaaattttttgtagaaactcactatgttgcccagtctggtctcgaactcctggcctcccacctcagcctcccaaccacaactggccraggtcctgtttctcatcacattgtcactcactgatcttgtcatgctttggtggagcttatctacaataattattactgccatgctttaatggcaattttc

SEQ ID NO: 20171 - DNA, 201 bp, Homo sapiens
gacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttact

SEQ ID NO: 20172 - DNA, 201 bp, Homo sapiens
gtcagagtgcagtagcatgatctcggctcactgcaacctctacctcctgggttcaagtgattctcatccctcagtttcccaagtagctgggatttcaggcrcgtaccaccatgcctggctattatttgcatttttagtaaagacagggttttaccatgttggctaggctggtctcgaactcctgacctcaagtgatccttc

SEQ ID NO: 20173 - DNA, 201 bp, Homo sapiens
taaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgc

SEQ ID NO: 20174 - DNA, 201 bp, Homo sapiens
aaaaaaagttgtgcttaagctaagtttaatttattattgaagaaagaaatttttaaataaatttagtgaggcctaggtatacagtatttataaagtctacrgtagtgtacagtaatgtcctcagccttcacattcactcaccactcactgactcacccgagggagcaacttccagtcctgcaagctttattcgtggtggta

SEQ ID NO: 20175 - DNA, 201 bp, Homo sapiens
aaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgcc

SEQ ID NO: 20176 - DNA, 201 bp, Homo sapiens
agccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgcca

SEQ ID NO: 20177 - DNA, 201 bp, Homo sapiens
ctattttcccactgatgtccctttttttggttccagatccaagagacgatcctacctggcatttattgtgttcagtttttctaattctgggacgttttcckgggttttctttagtcattcacgaagttcgcacttttggagaacatggggccagttattttgtagaatatctttctgttagagtttgtggatgtttcctcc

SEQ ID NO: 20178 - DNA, 201 bp, Homo sapiens
tatggtcaaattggcaacgaccacaccacatgagaaggaagattattcttcctggaacctggctcccttgagattcttttttttttttttttttagacggmgtttcgcccttgttgcccaggctggagtgcaatggcacgatctccggctcaccgcaacctccacctctcgggttcaagcgattctcctgcctcagcctcc

SEQ ID NO: 20179 - DNA, 201 bp, Homo sapiens
ctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctcccctt

SEQ ID NO: 20180 - DNA, 201 bp, Homo sapiens
ccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatataca

SEQ ID NO: 20181 - DNA, 201 bp, Homo sapiens
gtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaa

SEQ ID NO: 20182 - DNA, 201 bp, Homo sapiens
atcaacaaggagattttgtcctgtaactaactcaggtacctggaagcagcccgacatttgggggtgcatcgctgcagtctcctttggagctggagaaaccyatgagcaagaatgggcttatgacacatccatttccactccatccctccttccgttgtatgactgcatggagcccctctgacctccagcagtgtcacctgc

SEQ ID NO: 20183 - DNA, 201 bp, Homo sapiens
tcctgtaactaactcaggtacctggaagcagcccgacatttgggggtgcatcgctgcagtctcctttggagctggagaaacctatgagcaagaatgggctwatgacacatccatttccactccatccctccttccgttgtatgactgcatggagcccctctgacctccagcagtgtcacctgcagcctggtagtgagaaac

SEQ ID NO: 20184 - DNA, 201 bp, Homo sapiens; identical to SEQ ID NO: 3118

SEQ ID NO: 20185 - DNA, 201 bp, Homo sapiens; identical to SEQ ID NO: 3120

SEQ ID NO: 20186 - DNA, 201 bp, Homo sapiens
aagaatggagccaggtggctattttttttttttaaatttatgtaataacaaacattcgcatttattgaaaacttaaagtataataaaaaaataaataaaakaaaaaaagaaaaaagaaaacttattcctgtgtcaggcacttttctaagtgctttgcagtgtattgtctcatttaatagttgtttaaattaacagagtagg

SEQ ID NO: 20187 - DNA, 201 bp, Homo sapiens
tccacttgcacttgtgttaaaatgcggcagaactttccctctatacttaaattgtggtgaaatacgtatgacataaaacttaccatcttaacttttttttmttgagacaggatctcattctgtcacccaggctggagtgcggtggcgcgatctctgctcactgcaacctctgcctcctgggttcaggcgattctcatgcct

SEQ ID NO: 20188 - DNA, 201 bp, Homo sapiens
cgtcctcagttttgtgaagcaacagcctctgtgcctctttctctgcatgctctgttgacggtctagtcttgagagagaacctgctgctgtcccgtctgtcrtagccttcctagcaactcttaggcctgcatgctgtgttttcatgatctcccccaaagcggcactttgatgttttttcagagtcaaagtatcactgtggat

SEQ ID NO: 20189 - DNA, 201 bp, Homo sapiens
tctatacttaaattgtggtgaaatacgtatgacataaaacttaccatcttaacttttttttattgagacaggatctcattctgtcacccaggctggagtgyggtggcgcgatctctgctcactgcaacctctgcctcctgggttcaggcgattctcatgcctcagccacccgagtagctggaattacacgcgcccgccacc

SEQ ID NO: 20190 - DNA, 201 bp, Homo sapiens
tgtgcctctttctctgcatgctctgttgacggtctagtcttgagagagaacctgctgctgtcccgtctgtcgtagccttcctagcaactcttaggcctgcrtgctgtgttttcatgatctcccccaaagcggcactttgatgttttttcagagtcaaagtatcactgtggatatttatcccaaacaaaattgcaaactgat

SEQ ID NO: 20191 - DNA, 201 bp, Homo sapiens
tgccatatgaaacgtcattaagtggagagttgttcacgaactaggtaggtagttactttggtcttgccataggtttttggctgtttctgatgagctactgwttgaagacccctggggtaggggtgaggcctgcattctgggtccaagtctaagagtggcgactagaaatgagcaagttatttaaattgcctgggccttggt

SEQ ID NO: 20192 - DNA, 201 bp, Homo sapiens
ggctggagtgcggtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctg

SEQ ID NO: 20193 - DNA, 201 bp, Homo sapiens
ttggtcagggtggtctcgaactcccatcctcaggtgatccacgcgcctcaccctcccaaagtgctgggattacaggcatgaaccaccgcactcccttgagrttcttgtaagccaaggcagaagaagagacatcttaaagtctgtatgtgcacacctgcctccccccattttatatacaattcaagggctttgcttttggaa

SEQ ID NO: 20194 - DNA, 201 bp, Homo sapiens
tggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaa

SEQ ID NO: 20195 - DNA, 201 bp, Homo sapiens
cttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatca

SEQ ID NO: 20196 - DNA, 201 bp, Homo sapiens
ctttttagtaacagtaggctttgtcataattggcttcatgttccagctttcctaaaactgtaagtgatgttgggtgggccagcagcaaaataattcacttwacaatttgcatgatagtctggaatgaaccgaatacctaaaaccaggaaataatagtagatatttaatggtttggggatcaaataagaatttactcccaga

SEQ ID NO: 20197 - DNA, 201 bp, Homo sapiens
gaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatatt

SEQ ID NO: 20198 - DNA, 201 bp, Homo sapiens
attcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaa

SEQ ID NO: 20199 - DNA, 201 bp, Homo sapiens
tgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaa

SEQ ID NO: 20200 - DNA, 201 bp, Homo sapiens
aaaaagataatccagcctcaccaacagccacagaattgaaatgagatacctgtttctgcttctggcattgggaaagaaagaaaaatggcactagcagccttttttttttttttttttttttttccccaaaaaatttgctactcttgaggttctgtcaaagaatgtgctgtggcctctagaagcatttttaaaaagagactt

SEQ ID NO: 20201 - DNA, 201 bp, Homo sapiens
ctttttttctcctcctcatggtgggtggccctggtgggctctctctggggcctccagtcctccttccccacaacactggggaattgctgccagttgaatarggccctttttttttttttttttttttgagacagtcttgctctgttgcccaggctggagtgcagtggtgcaatctccgctcactgcaacctctgccttact

SEQ ID NO: 20202 - DNA, 201 bp, Homo sapiens
acagccacagaattgaaatgagatacctgtttctgcttctggcattgggaaagaaagaaaaatggcactagcagccttttttttttttttttttttttttycccaaaaaatttgctactcttgaggttctgtcaaagaatgtgctgtggcctctagaagcatttttaaaaagagactttcacaagtgattgtgcaaaattg

SEQ ID NO: 20203 - DNA, 201 bp, Homo sapiens
agagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgcagagccctggtaaacgt

SEQ ID NO: 20204 - DNA, 201 bp, Homo sapiens
tcaccttccttcagtgagacaggaataggacagtatttgaaaagcatctaacatgtttccaagcacataggtttttggtaaatggtggcagctgctgctattttttttttaaattaaactatctaagagttgcattctgagaccatctaaaattctgagtcttaagctgtgttgactatatatgttcactaccataactaa

SEQ ID NO: 20205 - DNA, 201 bp, Homo sapiens
gtttctttagatcttggaccttgaggtgacctctgtaatggatatatttgaaattattaactgtcttcaagtgggggtttgatgagagagagagagagagwgtgtgtgtgtgtgtgtgtgtgtgtgtgtgtgtgtttacagaaaatatgctaggtttgtacattcaaatttgtgttatcctcttcaagaaagtcaccttgg

SEQ ID NO: 20206 - DNA, 201 bp, Homo sapiens
ggtaatcttgtattatttttgcactgtttggaattttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattg

SEQ ID NO: 20207 - DNA, 201 bp, Homo sapiens
tttctttagatcttggaccttgaggtgacctctgtaatggatatatttgaaattattaactgtcttcaagtgggggtttgatgagagagagagagagagaktgtgtgtgtgtgtgtgtgtgtgtgtgtgtgtgtttacagaaaatatgctaggtttgtacattcaaatttgtgttatcctcttcaagaaagtcaccttggt

SEQ ID NO: 20208 - DNA, 201 bp, Homo sapiens
gacaacttctgcctaaaaaataaaagcttctaagacataaattctgtgttatgaacaacttgcaattttcatagttttcagttttagctctggcagcctcwgatagatcttaaatatgtttatcacagctggaaaaatgttttattgtcatctttgtttatcataatatgccacctactctggttgtgtcttacaactgta

SEQ ID NO: 20209 - DNA, 201 bp, Homo sapiens
ggccaaggtgggcagatcccttgaggccatgggttcaagaccagcctgggcaacatgcaaaccccatctgtacaaaagattaaaaaaaaattagtttggcktggtggcacacacctgtagtctcagctccttgggagttgcaagtgggaggatcacctgagcccttgaggtcaaggccgaaataagccaaaatcgcctcac

SEQ ID NO: 20210 - DNA, 201 bp, Homo sapiens
acattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctgga

SEQ ID NO: 20211 - DNA, 201 bp, Homo sapiens
aatccagagttaaaaataatgttcataaggaagggtagcaaaatttagattttaatacttataggaggtgtgttaattggccccagggccgcaggctttakcgttcagaggactttagccccaaaggttttgtggaacttttccagagtcctcaccagtacattgggaataaatggaatgcctttggaagtactttgaaga

SEQ ID NO: 20212 - DNA, 201 bp, Homo sapiens
atgagataaatttcacaggtaaatgtgacgtagctaatgcataatcattctttgtgttgcatggcaattctgtacaaatagaaggtagcatgtttaacgtycctgttatttcacataaatacagactgagagtttcagtggtctggtttgaaagggaagaaatagaagaaggaaggagagaagttggcagaggagcaatct

SEQ ID NO: 20213 - DNA, 201 bp, Homo sapiens
agtaatttagcttactgacaaaaagaaaagcaaaggaaattccagagaaagaacaggataccaagtctaaataaatttggaagacaaagagaatatcatartttagttcaatcttttaaacaaattgtcacaatttatacgttgggataagagaaccatgagaaaaggtatattctaagtcctgaacatctttctataccc

SEQ ID NO: 20214 - DNA, 201 bp, Homo sapiens
attcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacag

SEQ ID NO: 20215 - DNA, 201 bp, Homo sapiens
gcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtgga

SEQ ID NO: 20216 - DNA, 201 bp, Homo sapiens
tatttttaattttttgaggaaccactgtactgttttccatgtagactgcataagaattccaatttttccacatcttgccaacgtttatttttatttatttytttaaattttttatagtagctatccattctaatggatgtgaggtggtatctcattatggttttgatgggacttttgagttttagcaaatatcaatgaagt

SEQ ID NO: 20217 - DNA, 201 bp, Homo sapiens
cacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaa

SEQ ID NO: 20218 - DNA, 201 bp, Homo sapiens
cttactatatttttattgtaccttttctatgtttaggtatgtttaaatacacacatacttaccatggtgttacaactgcctgcagtattcagtgcagtaaygcactacaggtttgcaggttggtagcctaggagtaataggctatactgtatagcctaggtgtgtagtaggctataccattgaggtgtaagtatactctga

SEQ ID NO: 20219 - DNA, 201 bp, Homo sapiens
ctcctgctctttgttttctaaactttcagcggactcgattgggcgaaagccttccggctccctttactaagtcgtttaggtggtggctggggggacaaagragggtttttatctttaaaagataagtacggtttagaagacacgggagaaataatccattttgttatgttatgcagttgaactgtatagcttctctagttt

SEQ ID NO: 20220 - DNA, 201 bp, Homo sapiens
acatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaa

SEQ ID NO: 20221 - DNA, 201 bp, Homo sapiens
aagagccaggattttcaggctggccatttcaggatcagccatttcccacttcctgattcatagcttccaggatttgtaatgcctgtagacttttttctctyttgcttaaaagtggccattgaaagaaaaaataaatagcaaaatccccatcccagaagttctacttcctgttgttgtactattgagctctgaaaaacagct

SEQ ID NO: 20222 - DNA, 201 bp, Homo sapiens
cagaatgtttgaaactttgtgaggagtctgaccccacactgtaggctccctccatgtatatatttcttcttccttttcctttttttttttttttttttttwaatttttgagatagtgtctcgctctgtaaccccagttggaatgcagtggcatggtcatggcttactgcagcctcaacgtcccaggctcaagggatcctcc

SEQ ID NO: 20223 - DNA, 201 bp, Homo sapiens
catgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaac

SEQ ID NO: 20224 - DNA, 201 bp, Homo sapiens
acttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttag

SEQ ID NO: 20225 - DNA, 201 bp, Homo sapiens
cctagggttgtagaaattctcccccatgattgcacaacccactccttctcagccagtgtgcacctggagtcagctgtgtttggccttaaggtgtccatggkccagcagggagagggcagatgggtcagtgttgtcctgctagtgatgagtatcccatggtgggcatgctgatgccacgcaagggagagggtgtctggttct

SEQ ID NO: 20226 - DNA, 201 bp, Homo sapiens
aagactaattgattaatttattaagcacttattgtccagtttgcctttaattttcatttttctaagtttccattagctatcatggcctcacttgttatttmataatgaatggttacaaattgtttgtgtgtttttgtaattagaatgtaatagcaatcgtctaccagatgagctgacattgtaatgacatgaagtcagtaa

SEQ ID NO: 20227 - DNA, 201 bp, Homo sapiens
ttgagaaatcctgatgtccaagttgcacccccaccccaattcaataggagcgtttggggttaggatccaggaatcagtgcttgtctaaagatccctaggcwcttcagcaggcagcaaagattggaaaccactgctttatcccttcatttcttcccatgtgcatatcacaaagcactttgacggttttttttcctaaatatt

SEQ ID NO: 20228 - DNA, 201 bp, Homo sapiens
ccgcctgagccccccaaatagctgggaccacaagtatgcaccaccatacctggcttttttttttttttttttttttttgtattttttgtagagacggggtmattctatgttgcccaggcttgtctcgaactcctggcctcaagcgatccacctgccttggcttctcaaagtgctaggattacagatgtgagccactatgcc

SEQ ID NO: 20229 - DNA, 201 bp, Homo sapiens
ctgtcactcacggatgtactctttgccccaggtgaaagtgacgtcctgcatttcacctccaccaccacgtcgaagaatcgcatcatcataacctggcaccrgtaccggccccctgactacagggatctcatcagcttcaccgtttactacaaggaagcgtgagtttctgctttgggtgatgccattctgttgacagggcta

SEQ ID NO: 20230 - DNA, 201 bp, Homo sapiens
gcctgagccccccaaatagctgggaccacaagtatgcaccaccatacctggcttttttttttttttttttttttttgtattttttgtagagacggggtaaytctatgttgcccaggcttgtctcgaactcctggcctcaagcgatccacctgccttggcttctcaaagtgctaggattacagatgtgagccactatgcctg

SEQ ID NO: 20231 - DNA, 201 bp, Homo sapiens
gtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctc

SEQ ID NO: 20232 - DNA, 201 bp, Homo sapiens
gttttccctttcgtttttcttttctgcttttaatgagccttaattaatccagggagctaggctgcagtatctgtggctctccctgatgttttctttctgcmtttctgtcttggaggggaacctgaggatttggaagtagagggctctactagtgcttcctttttgtccttttctcattgtccaaaagagtcttaagcgatc

SEQ ID NO: 20233 - DNA, 201 bp, Homo sapiens
tggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggct

SEQ ID NO: 20234 - DNA, 201 bp, Homo sapiens
gagccactgcctttgctgccacattttgcttggttattgtgtgagaacaccatttttctctttttaaatgaattgtgtttctctttttaaattgagcatcygactgggcgcggtggctcacgcctgtaatcccagcactttgggaggccacggtgagtggatcacctgaggtcaggaatttgagaccatcctggccaacat

SEQ ID NO: 20235 - DNA, 201 bp, Homo sapiens
ggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggctt

SEQ ID NO: 20236 - DNA, 201 bp, Homo sapiens
tcccaacactttgggaggccaaggtgggtggatctcttgaggtcaggagtttgagactagcctggccaacatgggtgaaaccccgtctctactaaaaatamaaaaattagttgggggtggtggtacacgcctgtaatcccagctacttgggaggttgaggcaagagaatctcttgaacctgggaggcagaggttgcagtga

SEQ ID NO: 20237 - DNA, 201 bp, Homo sapiens
aatagttttttagttccaataatacgtttcgtgtaacccagtatatccaaaatatccattttaacatggagtcagtattaaagttacctaaatatttcactttttttttttttttgtctaatctttgaaatcccatgtgcatgtctcaaattggactggccacatggaatgctcaggagtcccatgtagggaccagctgcc

SEQ ID NO: 20238 - DNA, 201 bp, Homo sapiens
ccaccctctgttctgccaagcattggtccccagcacccctgggtgttagtgcctcttcctggttcactcactcactttctctggccctctctgtgtctctstcactctctttctttcgagatggagttttgctctgttgcccaggctggggtgcagtggcatgatctcagctcactgcaacctccaccacctgggttcaag

SEQ ID NO: 20239 - DNA, 201 bp, Homo sapiens
aaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtaccct

SEQ ID NO: 20240 - DNA, 201 bp, Homo sapiens
agaatgctttcatgatacgtcttggtacttcattacaacaaaaacaaacttattgccacccaggtcgacaggtgggaacagtgtcaccttatttgaacttratttattcggcctttgagaagcacttatagccagtttcctcgaggggcaacaaaatgacattgcagttcaaaagtgctttaaaaacttctttttcccaaa

SEQ ID NO: 20241 - DNA, 201 bp, Homo sapiens
taagcaatacaatttaaataatttttaaaggaaacatttctaaaggacgttttacattgcttgcattaaaaagaatataatgaacataatccaactttttstcaatactcagggtcatcactgtgaaagtaacttcattctatgataagataatgatgctcccaggtgggcaaggcagtttttcatctaaggtaattgaga

SEQ ID NO: 20242 - DNA, 201 bp, Homo sapiens
attgatagaacaaggcaagaccactttccccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgt

SEQ ID NO: 20243 - DNA, 201 bp, Homo sapiens
gaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtt

SEQ ID NO: 20244 - DNA, 201 bp, Homo sapiens
ctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctg

SEQ ID NO: 20245 - DNA, 201 bp, Homo sapiens
atgcaatgtaaaagtgatttactgtcctataattgttttcctgaaagcaaaatgatatttaagtgaactgcaatgaaaaatgcaacgactgtaatttatcrttgaagggcattttcaaagtgtatagaatgactaaagcttaagtgtattaaatattctagaggaagacatatttaggctataaatctagacttcctttgg

SEQ ID NO: 20246 - DNA, 201 bp, Homo sapiens
tttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctca

SEQ ID NO: 20247 - DNA, 201 bp, Homo sapiens; identical to SEQ ID NO: 3127

SEQ ID NO: 20248 - DNA, 201 bp, Homo sapiens
gtttgaggcagactccaaccacatttccatccagtggcttagtggtcttacccgtgagcttgaactgttgtccctgccaggacagtctttgcctctgtaartatctccatattcctccatcctttcaggtcccattcagtccctaggtcctccatgatggaatattggttgatgcacttattccacaaacatttgttggcc

SEQ ID NO: 20249 - DNA, 201 bp, Homo sapiens
tatagctcagttgtatgtagtattttctgtgtggtgttatgccctctgtatctgttttctcagatgttttagttgcttttctctcttaatcttgattagayctgccagagctgtgcttattttgtgtccccatccaaatccagaattaattgccgtgctccacatgttttggtcaatggtggacctcatctgtaacagtag

SEQ ID NO: 20250 - DNA, 201 bp, Homo sapiens
catcctttcaggtcccattcagtccctaggtcctccatgatggaatattggttgatgcacttattccacaaacatttgttggccacctttcaagtgccagwcaacccttctaggtatggaggggtacagtgatgagcaagccactgtttctggctgcagagggctcactgtttagtgggagaaacagacaaatcatacatc

SEQ ID NO: 20251 - DNA, 201 bp, Homo sapiens
aaaaggggcttctacactgttggcctctcgaggagaacggtttttgtttctgtcttcctggaaaagaggtgactgctggcatcatctttctagataaactscttgctatgatgccattagaagcagtgttcttttgtgttttgcttttgtttttccctgtagacaggaataacattttgactagaaacttccctgatgtaa

SEQ ID NO: 20252 - DNA, 201 bp, Homo sapiens
gcctttgtttttattgttggtcactgtaagaattccaaggaatagaaggatctcatgggcaaaatcagtttgcttttttctctgtatatttgttagtttayagcagcttctattttcctcctatttttaaaagctgaaatgcctttaatcgcactcagtgtgtttattcatggaagccagagaagagggtcccttcctttc

SEQ ID NO: 20253 - DNA, 201 bp, Homo sapiens
atttggaagtaacccctggccagcaattcactgtagtgtttgggaaacataggaatatctgcttattgtgacagattctcaagaaacctgtttcctttccrcaaagatggaaaccaggcactgtaccaatgagtcagttcactacgttttgtcctctgtccttacacgcagcggagacagacgagaacttggtcctctgcc

SEQ ID NO: 20254 - DNA, 201 bp, Homo sapiens
aaggaccgtgttttcctcaggggaatccatgggctgagaagactggggagcctcagaggccctttcccaaagccctctgctctccccttccaggttctgasctaaggaccagccagaagcctgccgagcgtcagccgaacctgcaagtggcttctgggctgttccgttccctgcgtgagctttccctctctgctgctgctg

SEQ ID NO: 20255 - DNA, 201 bp, Homo sapiens
tcggtaggacccccgtgtgccactacacaaagaaggaccgtgttttcctcaggggaatccatgggctgagaagactggggagcctcagaggccctttcccraagccctctgctctccccttccaggttctgacctaaggaccagccagaagcctgccgagcgtcagccgaacctgcaagtggcttctgggctgttccgttc

SEQ ID NO: 20256 - DNA, 201 bp, Homo sapiens
gagaaccacctgggtagaggtttccaaaattgtctgattgtaaaaatcacctgaggagcttggtaaagcttgactgtcccaggcctcatttgaggctactragtcaatgtccaggctggggcttggacaagaatgtcattctttttgggtcaaagccaggttaggtgataccgccttgccagataaatggccgggactagg

SEQ ID NO: 20257 - DNA, 201 bp, Homo sapiens
gagctgcggtgagagagaccatgaaaagaagggccagagcggtgtcctgcagagggtggtgtaccttgggagggaagtgtgtagggttgttgaggaacagygtgctgcacagggaggaaagacgtggggcagcattgtgggaagagcaaccaagattctcataggcttgggagcggaagccctgaggtctgttgctggact

SEQ ID NO: 20258 - DNA, 201 bp, Homo sapiens
gtgctttagggtggggggacttgagacccttgacttgactcggtcccactggaaagcttctgttgcttatttgggtaaccccaactctatcttattgggcrgtagtgttatcctaattcttggaaatactcagtgtagaataaagagctgatgaaaatgtgtaagaagggagtaagtggtcattagagagaaatggtaatt

SEQ ID NO: 20259 - DNA, 201 bp, Homo sapiens
ctgtaatcccagcactttgggaggccacggtgagtggatcacctgaggtcaggaatttgagaccatcctggccaacatggtgaaactcctgtctctacttaaaaaaaaaaaaaatgcaaaaactagctgggcatggtggtgcacatctgtaatcccagccacttgggaggctgagggcaggagaatggcttgaacctggga

SEQ ID NO: 20260 - DNA, 201 bp, Homo sapiens
ttttaaaagggttccattttcccctcatatgactttggttcattctcctccttgtttctgtctctcagtgaactttccaaaagatgggttatgatgaaagrtgaatcgtcgttgataactgctcttacttatctgtgtatcgaaactgcaggtagtgctcttcagctctgtggctggatttagtgcctcttctagggaggg

SEQ ID NO: 20261 - DNA, 201 bp, Homo sapiens
ttgggaggccacggtgagtggatcacctgaggtcaggaatttgagaccatcctggccaacatggtgaaactcctgtctctacttaaaaaaaaaaaaaatgsaaaaactagctgggcatggtggtgcacatctgtaatcccagccacttgggaggctgagggcaggagaatggcttgaacctgggatgcggaggtcatagtg

SEQ ID NO: 20262 - DNA, 201 bp, Homo sapiens
tctcatttttatgctgttcagagtgtggttgaagttcagccatcactagtccttcacggatagttcataccccaagttgatggccttgtggaattgctgaygctattttcatatatatatatatataattctagcctttttctctggtcttataagagtcacatacgtaggtaatttcatatcctacaaatatgttctaaa

SEQ ID NO: 20263 - DNA, 201 bp, Homo sapiens
taaaaaaaaaaaaaatgcaaaaactagctgggcatggtggtgcacatctgtaatcccagccacttgggaggctgagggcaggagaatggcttgaacctggsatgcggaggtcatagtgagccaagactgtgtcattgcactccagcctgagcaacagagagagactgcctcaaaaaaaaaaaaatccgtttacatagtgat

SEQ ID NO: 20264 - DNA, 201 bp, Homo sapiens
gtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatc

SEQ ID NO: 20265 - DNA, 201 bp, Homo sapiens
tgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggca

SEQ ID NO: 20266 - DNA, 201 bp, Homo sapiens
agcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaa

SEQ ID NO: 20267 - DNA, 201 bp, Homo sapiens
aggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttct

SEQ ID NO: 20268 - DNA, 201 bp, Homo sapiens
ggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttctt

SEQ ID NO: 20269 - DNA, 201 bp, Homo sapiens
gttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttg

SEQ ID NO: 20270 - DNA, 201 bp, Homo sapiens
caccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccag

SEQ ID NO: 20271 - DNA, 201 bp, Homo sapiens
ccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagcc

SEQ ID NO: 20272 - DNA, 201 bp, Homo sapiens
tgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccatt

SEQ ID NO: 20273 - DNA, 201 bp, Homo sapiens
tcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaa

SEQ ID NO: 20274 - DNA, 201 bp, Homo sapiens
ttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagccaaaatgcagcacagggaga

SEQ ID NO: 20275 - DNA, 201 bp, Homo sapiens
aggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtt

SEQ ID NO: 20276 - DNA, 201 bp, Homo sapiens
aagtccctgggcaagtagccagcgtaactgattgacctaaaacaaaggatggagcccttggggctctgcatagtgaaatgtatgatttcttagtggaaaaygagaaagccactgaggaagcccagaagggaacttagcatatacagccagctttggggaagggggaagcagtgccaagcaagacaggtgcttttcagagac

SEQ ID NO: 20277 - DNA, 201 bp, Homo sapiens
gtgtgcttggtacgaagtagtaacatcaattcagtgttcagtacatccactttgttccagaacaatgtattcaaggtcggtgtattttggctgtgccacakagttctggaaattcccaagagaataagttttcacctgttatataatccagcacaagtgactgtgtagcagcaacctcatgtttcatgatgactttaaaat

SEQ ID NO: 20278 - DNA, 201 bp, Homo sapiens
tgcctggaagatgcggagcggagtttgcgtggcccggagcagctccagtgtctgaggcttctctgtgtcacaggctccaagcaggaagcgcaggcaaaatrgcaaaatacagcatgtggcattcagttcaaaaatgcccttttttagaagtcggtattctaaatgacatccagtcttgcttagttttttaagagaaaggaa

SEQ ID NO: 20279 - DNA, 201 bp, Homo sapiens
aaggcaaaactatagagacagaaagcagaccagggatggctgcaaggaagaggtggagattgaccaccaatgggaatgagggaactcttggatgatggaartgttctggaactgagtagtggtgatggttggacagttgtgtaaatttacggaagctcatggaatgatgggtgaattttttttttttttttttttgagatg

SEQ ID NO: 20280 - DNA, 201 bp, Homo sapiens
acaaaactgtcattagagaagcagggactggctcaattgcccaggctgatgtgcagtagtgcaatcatagctcactgcagcctgaactcctaaactcctgygctcaagaggtccttccacctcagccttccgagcagctaggactacaagtgctcaccataacactcagctaattttttttttttttttttttttttttgt

SEQ ID NO: 20281 - DNA, 201 bp, Homo sapiens
agtgttctttatttccccattgcattgcactaaaatattccaatgcaatctgtgttttgttttgttttttcttttttaattttttttattttttgagacgsagtcttgttctggttgccccggctggagtgcagtggcatgatctcagcttactgcaacctccgcctcccgggttcaagcaattcttttgcctcagcctcc

SEQ ID NO: 20282 - DNA, 201 bp, Homo sapiens
tgcatacatgagacattttgcattgcatagaatttccgagggttcacagatactttgaagcccaaaagtgatccacagaccccagattgagaactcctccrctatgccatgcttaagcttatttctgtgtatcttctttctgaggagcaggcagatgggtcatctttacaatgtgaagttcttggcatttttattttgttt

SEQ ID NO: 20283 - DNA, 201 bp, Homo sapiens
tttcattgatacttttgtatttccccagttctacctcccctcccctagactggttggctgtcctggaatttcccttccttctttcaattgcccaaacactwagtgggaggaggcaaactcatatcaaatagcagattgactacatctgtgctggatcatgcagacagttcaagagtcccaagtaacttagcagcttcatct

SEQ ID NO: 20284 - DNA, 201 bp, Homo sapiens
tctagtcctttacaacaacatccttctctagaggtaggagagacaatttaatattttgttttactctttagaaattaaaactcgggttacatggaaatgtkctcttctctgaataggtaacattgttaaacaagttttgagtgtccttccatctttttctttttatgaatactcctgtacataatttttaaaaacataagt

SEQ ID NO: 20285 - DNA, 201 bp, Homo sapiens
aaacaatatagaaagatataaaatggaaagtaaataaaaataaaaatctctcatcaaactcttcatcacccccaacagaaataaccccaaagataaagctyccttttttatctttcctgatagtttcagtgcatttgcaaacaaatatattgactctttttttcacaaatagaattttagtgtaaatatttcacaaccttc

SEQ ID NO: 20286 - DNA, 201 bp, Homo sapiens
ggtcattggtgctgtttctccttgttgcccaaaccagacccgtctttaataaagttgttctccacccatttctgcatagtttgagaaactcttcagctgtmgatcaaagacacttgaaatattcagctactgttcttacttcctatttattcaccagggaagcctgaagccagaatgccagacagcgcagacactattcca

SEQ ID NO: 20287 - DNA, 201 bp, Homo sapiens
gattaagaaaacgtggcacatatacaccatggaatactatgcagccataaaaaaggatgagttcatgtcctttgtagggacatggatgaagctggaaaccrtcattcttagcaaactattggaaggacagaaaaccaaacaccacatgttctcacttataggtgggaattgaacaatgagaacacttggatacaggaaggg

SEQ ID NO: 20288 - DNA, 201 bp, Homo sapiens
tattatttatttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggtttggggaac

SEQ ID NO: 20289 - DNA, 201 bp, Homo sapiens
tttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggtttggggaacaactgatgc

SEQ ID NO: 20290 - DNA, 201 bp, Homo sapiens
ttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggtttggggaacaactgatgcc

SEQ ID NO: 20291 - DNA, 201 bp, Homo sapiens
agaactttgcaataggcatttttgttttaacttcatttctggtgcagttttattttcctacccttgtctttctattttctctttcatctgctttagacttmaactgtgttttatgtattgctgtaagcctctttaaaccctttctaaaacaaagcagggaatacataaacaaatagttttttgttttttgtttttttttct

SEQ ID NO: 20292 - DNA, 201 bp, Homo sapiens
ctttatcatctactaagtacatgtccctagtacataatagactagtagttagattatcaatgaacaataaatattggctttccttttttttaaattttaattttttttttttttttttttgagaggtggcctcactttgtcacccaggccagaatgcagtagcgcaatcttggctcactgcagccctgatatcctgggctc

SEQ ID NO: 20293 - DNA, 201 bp, Homo sapiens
attgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtctt

SEQ ID NO: 20294 - DNA, 201 bp, Homo sapiens
ttgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttt

SEQ ID NO: 20295 - DNA, 201 bp, Homo sapiens
atacttttttattatttatttcctttgaccacccacaattatcatcagtgtcatcctcatcatcacaattaagattactaccacattaggctacataaactttttttttctctctctctttgttttataatttcaattttattttagattcaaggggtacatgtgcaggttttacatgggtatattgtctgatgctgaggt

SEQ ID NO: 20296 - DNA, 201 bp, Homo sapiens; identical to SEQ ID NO: 3162

SEQ ID NO: 20297 - DNA, 201 bp, Homo sapiens
ggcttggaagcaaaacttcaggggaaaaagacaacatatggaattgaccacaattgaatttacaagtgaagtggctttacagaggaatcaggggatgtttytgagagaggaaattcattaaattctaacttgaatattttctgtttgcctttaagtcagagcaaaggctttgagtcccagcttcccagtttgtgaccttga

SEQ ID NO: 20298 - DNA, 201 bp, Homo sapiens
tattccaaagaaggctacagatagatacattttttccattggaattaggcaatggagttaaacagaagttacaatatggttgaaataaatgtatttttttwaaaaaagatttctctttccttaattattaaaaaatatacaattttgtagaaaattttaaacaaagtataaagaaaaaaataaaaatcattcataatccta

SEQ ID NO: 20299 - DNA, 201 bp, Homo sapiens
agtgctgggattgcaggcatgaggcactgagcccagccaatattggctttccttagatatggttcatggtatgattagaaacaaaaagaattagcagtcamaacacctagtttctagttctattctgccacaatgtaaccttaggcaaagttggtttttgtatttgtcacctataatgatgagtttgtgattagactaatg

SEQ ID NO: 20300 - DNA, 201 bp, Homo sapiens
tgagaggtggcctcactttgtcacccaggccagaatgcagtagcgcaatcttggctcactgcagccctgatatcctgggctcaagcgatcctcccgcctcrtcctcccaggtagctgagactacaggcacatgcccccactcatggctagttttttatttttgtagagacagggtcttgttatgttgtccaggctggtctt

SEQ ID NO: 20301 - DNA, 201 bp, Homo sapiens
ttcatgaccagtccgggctacatagcaagacccccatctctatgttaaaaaaaaaaaaactttaaaaaaaattactacagctttatatataagatatatgktggcacctgctgtagtcccaggtacatgagaggctgaggtgggaggatcacatgagcctgggaagtagaggctgcagtgagccatgatcacaccactgca

SEQ ID NO: 20302 - DNA, 201 bp, Homo sapiens
tagtagttagattatcaatgaacaataaatattggctttccttttttttaaattttaattttttttttttttttttttgagaggtggcctcactttgtcayccaggccagaatgcagtagcgcaatcttggctcactgcagccctgatatcctgggctcaagcgatcctcccgcctcgtcctcccaggtagctgagactac

SEQ ID NO: 20303 - DNA, 201 bp, Homo sapiens
ccttgcttgcctccctttctttttttcttcttttaaatcagcttcctcaggttgatctgcctctcattccttaggcatctgtttcctatgtgttctttctmctttttttcattgatacttttgtatttccccagttctacctcccctcccctagactggttggctgtcctggaatttcccttccttctttcaattgcccaa

SEQ ID NO: 20304 - DNA, 201 bp, Homo sapiens
taaattatacttttttattatttatttcctttgaccacccacaattatcatcagtgtcatcctcatcatcacaattaagattactaccacattaggctacrtaaactttttttttctctctctctttgttttataatttcaattttattttagattcaaggggtacatgtgcaggttttacatgggtatattgtctgatgc

SEQ ID NO: 20305 - DNA, 201 bp, Homo sapiens
gctaacacgtaactgaccaatatggtttggttgtgtccccacccgaatctcatcttgaattgtagttcccataatccccacgtgttgtgggagggacccaktgagaggtcattgaatcatgaggtggttaccctgtgctgctgttctcgtgatagtgagtgagttctcatgagatctgatggttttataagggcttttccc

SEQ ID NO: 20306 - DNA, 201 bp, Homo sapiens
tttatgtaggcagtgacagcatttaccctgctcactactctataactaggatctgatcttatggctaacacgtaactgaccaatatggtttggttgtgtcmccacccgaatctcatcttgaattgtagttcccataatccccacgtgttgtgggagggacccagtgagaggtcattgaatcatgaggtggttaccctgtgc

SEQ ID NO: 20307 - DNA, 201 bp, Homo sapiens
agccttgtggtcagctagtgaaggaagctttatgtaggcagtgacagcatttaccctgctcactactctataactaggatctgatcttatggctaacacgwaactgaccaatatggtttggttgtgtccccacccgaatctcatcttgaattgtagttcccataatccccacgtgttgtgggagggacccagtgagaggtc

SEQ ID NO: 20308 - DNA, 201 bp, Homo sapiens
tgtgttctgtgagccttgtggtcagctagtgaaggaagctttatgtaggcagtgacagcatttaccctgctcactactctataactaggatctgatcttayggctaacacgtaactgaccaatatggtttggttgtgtccccacccgaatctcatcttgaattgtagttcccataatccccacgtgttgtgggagggaccc

SEQ ID NO: 20309 - DNA, 201 bp, Homo sapiens
tgtttttaaatgagtaaaataaaatatataggattacacaggaaaccaattaaatactgctaccaagctatttaaaaatctatgatataatatgctttttwaattaaacccttaaatggatctagaggtaggtaaatgtctaacagcagatattttgaagttgcaatgaatgtaaatggcactttgagctatctacaactg

SEQ ID NO: 20310 - DNA, 201 bp, Homo sapiens
taaatgacctgtgttcagattacctggtaccatacaaaattgttctctggcaacaatattatagtatattgtatatgactatagtcgtgatttttagctcrtcttttcctcttaccaaaaatttaaagcacatgttgcataaatcttatgagtacttaatatttaatatggagaccaacaggccttttgtttcctctcaca

SEQ ID NO: 20311 - DNA, 201 bp, Homo sapiens
ttatttaaaaaaatactgtcatagggatgctaccttcttttcttttttgttagtaactatttgtgggatgtctttggtgtgtcaggctctgagcaatgccrttttctcttggcttctttgcagtctctgtgtgaggcttacagtcatttttcacgtttgactcttcagaaggaagacagggcttctggttctacatctgga

SEQ ID NO: 20312 - DNA, 201 bp, Homo sapiens
tttggttttgacaacctagaaataaccttgaagaaatcctatggagaagtcttaaagaggaagattggattttgtagactcaaagaatgtgtcatggtttggcttaatctaagccatttttattcttcttttcttgtgtttgggtctattatctgtctgtagaatttatacagtgagactgctggggaaagtcttatgtct

SEQ ID NO: 20313 - DNA, 201 bp, Homo sapiens
actgcagcctgaactcctaaactcctgcgctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcc

SEQ ID NO: 20314 - DNA, 201 bp, Homo sapiens
ctgcagcctgaactcctaaactcctgcgctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcct

SEQ ID NO: 20315 - DNA, 201 bp, Homo sapiens
tgcagcctgaactcctaaactcctgcgctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcctc

SEQ ID NO: 20316 - DNA, 201 bp, Homo sapiens
tcatacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataag

SEQ ID NO: 20317 - DNA, 201 bp, Homo sapiens
catacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataaga

SEQ ID NO: 20318 - DNA, 201 bp, Homo sapiens
tacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataagaga

SEQ ID NO: 20319 - DNA, 201 bp, Homo sapiens
gtgaatggcctagggtagttaggtgactgtgttccatatggtcattcaggggcaaatgctgatgaagcaacacagctgtcttcatctaagactagaactcygcttgttgccatttcccagcaggaaggggttgaaagaaaatttatgtagatttttttttctacccagtagttgcatatatattgtattctcacatcctat

SEQ ID NO: 20320 - DNA, 201 bp, Homo sapiens
aaagcaaagtctccttccatactcactgacctccccactctccacgaccccaatcttctgctctcaaagtaactactcttcagtttatgtctagattgtttatatatatacacacacacacacacacacacacacacatatgtggataatatgtaattcccctaattttataccttagaattataccacatgtatattctg

SEQ ID NO: 20321 - DNA, 201 bp, Homo sapiens
aagcaaagtctccttccatactcactgacctccccactctccacgaccccaatcttctgctctcaaagtaactactcttcagtttatgtctagattgtttatatatatacacacacacacacacacacacacacacatatgtggataatatgtaattcccctaattttataccttagaattataccacatgtatattctgc

SEQ ID NO: 20322 - DNA, 201 bp, Homo sapiens
tgtgttttttgttgttgttttgcaaggatgtgttcttggagatttttataatctagaattcacctatttcaagatttctctccagcccccatagtaataamtctgaagtaggagggatgaggtctccaaacacataaatctacagccattttagcttgggggcatgttatagttacaaagatcttatagccatatcaatag

SEQ ID NO: 20323 - DNA, 201 bp, Homo sapiens
aggttcctgatggtttttatgtgaaagacagtgagcagctggttattaccactgaggcaataaagagatactgtgggctttagcagaaacaccagtatatrtatttagtttttaaaataaggttttaaaaggaatgttttatttaattgcctacacagaatgaataaagtgatatttatagtaggactctgggtttgttta

SEQ ID NO: 20324 - DNA, 201 bp, Homo sapiens
atacaggcctgggttcaaatcccacccagggcactggctaaatggttctatgagctacttttctgtagaacagacccctagaaatagaactatttgctcaracagtgtgattcttttaaatgttaactttaatagatattgccaaattgtcctccagaattatctcattatttttatatgcacaaccacaacctataagag

SEQ ID NO: 20325 - DNA, 201 bp, Homo sapiens
tcctgccataattgctaaatgacctgtgttcagattacctggtaccatacaaaattgttctctggcaacaatattatagtatattgtatatgactatagtygtgatttttagctcgtcttttcctcttaccaaaaatttaaagcacatgttgcataaatcttatgagtacttaatatttaatatggagaccaacaggcctt

SEQ ID NO: 20326 - DNA, 201 bp, Homo sapiens
ggaaaaacacactaatatgaatttaactcagttgaaggtaaaatatttatttttacatatagacagtaatctattatgctttgcaatgacatagtttttcyataagagtaccacacgtagaacaaaatatggatgccagtgtagctattctgggtttttaaatactccctacaactagagaaagctcctgtttccagcgat

SEQ ID NO: 20327 - DNA, 201 bp, Homo sapiens
gttctccaaccttcctattccaatacatactgtcatggatgggtacactaaaatctcagaattcactgctatatcactcatccatgtaaccaaaaaccacrtgtacccccaaaagctattgaaataagataaatacattcttatttaaaaaaatactgtcatagggatgctaccttcttttcttttttgttagtaactatt

SEQ ID NO: 20328 - DNA, 201 bp, Homo sapiens
gttcctggtgtcaaggtacacagccatggatgaatcatgaggcttgagtgcatcagagacctaagcgtgggcaggaacccccagagtacccatgtgaatgytctgcttgctgcctcgcaccttttatgacaattcccacaagaagctatgtggtctgtttctacttctgaaggagcagcctttttcccttttttttttttt

SEQ ID NO: 20329 - DNA, 201 bp, Homo sapiens
agcactttcatagacaacggtaagagccaatgggctaccaacatttagtaacgtgtgatggttcacaaatgactgtgaaaaatagatttggatcatatttmtaggaagagaagaacaattaactcatgagtgatttctgtattcttcattacaaagaacttgttcatttgcctcttcagctggcagtaagttatgctacat

SEQ ID NO: 20330 - DNA, 201 bp, Homo sapiens
cattcatgagttggatgactttgtatatgatctgtcctgctctccatttcaaaggcaagaccaccaaaattcacaagcttattatgttgtcactaatgtgyaagccaccagtttttctgcaagttggaagttttctcaacagtcaaatattcccccttctcactaatcttaaggttttaaagttatagctgcaaatctaaa

SEQ ID NO: 20331 - DNA, 201 bp, Homo sapiens
tgggtgctttatatatatcatatcatattgtgtctgctttaataaatcatagttattgactacatatcatacaggatgtgtgccttctgtgggtcagaaartaagttcactatttagtccttttcaaaaattccttcccgatctatcttatagacagaaactaagcttttatacacccaagatttggcagattaacatctg

SEQ ID NO: 20332 - DNA, 201 bp, Homo sapiens
aaggaattggtatgtatatgaaaatgcttgttgggcacattgcattttttggccattaacattaaaacactcattaatggcattttagcatgaaattactscttttcagtggataaatcacattagatcaacaaaaacctctttggtcaacctcttgatctgatgaaccctgtatttattcttctttcctaccctcactgt

SEQ ID NO: 20333 - DNA, 201 bp, Homo sapiens
ttcaaaagggaaatattggtgggttttgcttttcaacaagaacttaatataactagttgtgttttatagagataagcctggaaggggggattggaggagarcaatggttctctgtacattagaatctcctggagggctggtgtctgagtggcaccaccaaagattctgattcagctgttctggatcagaatctacagctca

SEQ ID NO: 20334 - DNA, 201 bp, Homo sapiens
acccaaacttagacatatggccacatctgtcagccagaaagggtgggcaatgttatctatagctgtgttgctacgtgcctattgctaaaaaggctaaaaasgaagaaggggaacatggatgctggtgaacacttggccacctctgacacagataattgctaaagtaataagaagagatggaaattaaatgtgctaagctag

SEQ ID NO: 20335 - DNA, 201 bp, Homo sapiens
gtgatttctgtattcttcattacaaagaacttgttcatttgcctcttcagctggcagtaagttatgctacattttgaaattcctaacaggtaacacctgamagaatgtttagatttcataatcttttcatatacctacgatcatcacatttaaaaaagaactgtatttttgaattaaagtagaaacagattatgcatgaat

SEQ ID NO: 20336 - DNA, 201 bp, Homo sapiens
tatgagcatgaaggggcccatgccaaatgtatagtgcagcaggagcaaaggggctaaggtgggaagttggaagactagcaaatgggccaatttgaagggarcataaagtcaggagatgagaatagtagggtggtgggaaggataggttttgaggccattaaatataagttgaaaaatggggccccactttcataggcccaa

SEQ ID NO: 20337 - DNA, 201 bp, Homo sapiens
tgatggttgcatgctagtaatcccacagaattagagccactcaagttgagagtgagtcattacacttcaagaacataaagctggttgaaaatgtggctaaragagaatcatgtgtacccccacccccagttcagtgtgtattagcctactgcttcttttagtttaaacttgatgaatatttttaatttctaatgaaatttc

SEQ ID NO: 20338 - DNA, 201 bp, Homo sapiens
taggcctcatgcaaaagagttccagaaagactgagcacctgctatgtgtaatgttctctcttaggcttctatagtagagtacgacccttatggagtttgayacaggggaagagagaattaaaatacagtaaatgtataaattaggatgttctaaggacagacacaaatgaaccgcataggcttaaagaggaaagattccat

SEQ ID NO: 20339 - DNA, 201 bp, Homo sapiens
acattatactattttaaatacagcatctactcatctttctattactattcaacttgaagcaaatattcttgccattattatttattttcaaatattatacyaaccttgcccttttgctttctttcttttttcccctgaatagccaatcataagtggaaagtcattgagtttatttacacccttcattttgccttgattctt

SEQ ID NO: 20340 - DNA, 201 bp, Homo sapiens
aggctctgagcaatgccattttctcttggcttctttgcagtctctgtgtgaggcttacagtcatttttcacgtttgactcttcagaaggaagacagggctwctggttctacatctggaactcttttcccacaacaccaacactgagaaatgtgacatggtgctgtgtttacatttgcataggaacttgcattataagtttt

SEQ ID NO: 20341 - DNA, 201 bp, Homo sapiens
cttattaggtgtttaatgtgtacaaaccagtgagatttgttccaacacactataaactttcaaggagagaggctgtgtcttcttcatgtttatatctgctrcaacactgagttcatggcttttcacacataattgctcaacagagcaggtgccatggaaagtcaattcaatgagtaaaattacctcaaaatagtctgttaa

SEQ ID NO: 20342 - DNA, 201 bp, Homo sapiens
aggtcttgccacctcctcattgaacagaactgtgaactaaagccaggagaatgaagtcagtcgtccgtgaccacatggttaagcagcagcaatgctaggawcagggccgcgtgcccagctcacagagggagagtttttctgctcactgtacctcctataaaatcatcataagccctagagagagactttcatgtgtttctt

SEQ ID NO: 20343 - DNA, 201 bp, Homo sapiens
gatttttagctcgtcttttcctcttaccaaaaatttaaagcacatgttgcataaatcttatgagtacttaatatttaatatggagaccaacaggccttttrtttcctctcacatgctatttttctttttcagtgtgaatgacatcacagctgttggaccggcacatttctatgccacaaatgaccactacttctctgatcc

SEQ ID NO: 20344 - DNA, 201 bp, Homo sapiens
actttagagacaaagaggaaataagggttgggacaggaaggtcttgccacctcctcattgaacagaactgtgaactaaagccaggagaatgaagtcagtcrtccgtgaccacatggttaagcagcagcaatgctaggatcagggccgcgtgcccagctcacagagggagagtttttctgctcactgtacctcctataaaat

SEQ ID NO: 20345 - DNA, 201 bp, Homo sapiens
aaacagggcttattgatgattgagtgacatgcatgtacggtggtcttatattcatactttgtatcccctgaataggttctccgcatccagaacattctatstgagaagcctacagtgactacagtttatgccaacaatgggtctgttctccaaggaagttctgtagcctcagtgtatgatgggaagctgctcataggcact

SEQ ID NO: 20346 - DNA, 201 bp, Homo sapiens
ttagaaggtggaagcagggcgatgtgtaatttcctcacatgcatagaggcaggaaggttacctctaaattatttaatcaagtttctcatgtcatttagatwttgacaatttctcatttggaaggtacttgagctggatacactggtggataatttatctattgatccttcctcgggggacatctgggtaggctgtcatcct

SEQ ID NO: 20347 - DNA, 201 bp, Homo sapiens
taagagtaccacacgtagaacaaaatatggatgccagtgtagctattctgggtttttaaatactccctacaactagagaaagctcctgtttccagcgatcwcaagaactgaccatgattacatgcagcagcaggttgagagtgatattcatcagatttagggcccattccatgaagtattgatggcagtggaagaattcca

SEQ ID NO: 20348 - DNA, 201 bp, Homo sapiens
ggcttttcacacataattgctcaacagagcaggtgccatggaaagtcaattcaatgagtaaaattacctcaaaatagtctgttaattcactcacctttgawgtagacagattattctgcattgatacttatctcttactcttaaaattcgctatgtattaataaatattttattgaatattaaggaatgatcactatttta

SEQ ID NO: 20349 - DNA, 201 bp, Homo sapiens
ctgctgcaacactgagttcatggcttttcacacataattgctcaacagagcaggtgccatggaaagtcaattcaatgagtaaaattacctcaaaatagtcygttaattcactcacctttgaagtagacagattattctgcattgatacttatctcttactcttaaaattcgctatgtattaataaatattttattgaatat

SEQ ID NO: 20350 - DNA, 201 bp, Homo sapiens
ctcttttcccacaacaccaacactgagaaatgtgacatggtgctgtgtttacatttgcataggaacttgcattataagttttatttgttgagttattggctttttttttttaataacccacatcagtatatagaactttgcaataggcatttttgttttaacttcatttctggtgcagttttattttcctacccttgtctt

SEQ ID NO: 20351 - DNA, 201 bp, Homo sapiens
agcttcttccaaggtacttcctcattttgttccttctctaatttatccccagcatttgcaaacaatccctatggtgggttgtcctgtcatcttttataagygctaatgtatatattagctaatatgtaagagctaaagagcttatatttccttatttataaatgtgtgtgtatagtttccttataaaccagggcaagcatg

SEQ ID NO: 20352 - DNA, 201 bp, Homo sapiens
aggaaagacagagaatgatctgttaggtcgtctaacagcttatacattcaacctttccttgcctgtggtatttaaatgtcagtgcctgcccagaggtcccrtagttatgtcttgtaaattaactctgttctttcaattctttagatgacacagtttatctctttgttgtaaaccacccagaattcaagaatacagtggaaa

SEQ ID NO: 20353 - DNA, 201 bp, Homo sapiens
taaatcttatgagtacttaatatttaatatggagaccaacaggccttttgtttcctctcacatgctatttttctttttcagtgtgaatgacatcacagctsttggaccggcacatttctatgccacaaatgaccactacttctctgatcctttcttaaagtatttagaaacatacttgaacttacactgggcaaatgttgt

SEQ ID NO: 20354 - DNA, 201 bp, Homo sapiens
ggcaacaatattatagtatattgtatatgactatagtcgtgatttttagctcgtcttttcctcttaccaaaaatttaaagcacatgttgcataaatcttaygagtacttaatatttaatatggagaccaacaggccttttgtttcctctcacatgctatttttctttttcagtgtgaatgacatcacagctgttggaccgg

SEQ ID NO: 20355 - DNA, 201 bp, Homo sapiens
ttcaccattcctatccagcctgtaggcaggtcctgttggttctacctgtgcctccttcctctacccccaaactcctttccctttgagtgagacctgcctartttaggttgtcatcctctctgactagcatatgagactttcttccaatttgttttctgtctacttggatttttttcactcttgccaattttgtctgtctat

SEQ ID NO: 20356 - DNA, 201 bp, Homo sapiens
cccaagctaacaaaaaaataacaataatgaaaagggagaatcagcttttactcctctttcaccattcctatccagcctgtaggcaggtcctgttggttctmcctgtgcctccttcctctacccccaaactcctttccctttgagtgagacctgcctaatttaggttgtcatcctctctgactagcatatgagactttcttc

SEQ ID NO: 20357 - DNA, 201 bp, Homo sapiens
ttttataaatataaattttaaagtgtgatcatactgatgcatacatattgaagtatcaggtatttccttttaaataaatgtattatttttattggctatayattattccattataaggatgatcttaaactaatttaaccaattctctattgatggatatgtgtataggggtggggagttctacataaaaaatattttata

SEQ ID NO: 20358 - DNA, 201 bp, Homo sapiens
taactctgttctttcaattctttagatgacacagtttatctctttgttgtaaaccacccagaattcaagaatacagtggaaatttttaaatttgaagaagsagaaaattctctgttgcatctgaaaacagtcaaacatgagcttcttccaaggtacttcctcattttgttccttctctaatttatccccagcatttgcaaa

SEQ ID NO: 20359 - DNA, 201 bp, Homo sapiens
aaaaaacctatgaaatggtgcacaaattacttgccaaatgtggtattcatattcattctccctcccaccaccctttggccgagcaaagtggtcaaatttamcaaaagcttaaatgcaaccttaagttagatataactgcattttaagtcctgtatccagtaagctttcaatatatggtgattatcagtgatgagcaatggt

SEQ ID NO: 20360 - DNA, 201 bp, Homo sapiens
tggaaatggagatccccaaaattttaaactttcccaggatgatattaaaggcattcagaaactatatggtaatatttattatttcaaataagaggatttcycattttctttttagagtggggtaggaaaagaaaggctgggaaatgggtatttacctggaaaaccacactggaactcatatcaaaaagcctattgagggga

SEQ ID NO: 20361 - DNA, 201 bp, Homo sapiens
ttgttttgaccagaaatttatggtaagtaccttctcttacacaaggaacaataaataagccggaaatcttggaagccttcacagaactggggttaatgacmagataacatggtggattaacatccaagatggaattgctttagtctccacaccccttatttaaatgagattgggaacaaaataacaactcattgaaaaagg

SEQ ID NO: 20362 - DNA, 201 bp, Homo sapiens
ctatataaatttctgcagtcactagcagaaaacaccaaatcaaccataggtccaagaacaattgtctctggacggcagctatgcgactcaccgtgctgtgkgctgtgtgcctgctgcctggcagcctggccctgccgctgcctcaggaggcgggaggcatgagtgagctacagtgggaacaggctcaggtatgtcacagcc

SEQ ID NO: 20363 - DNA, 201 bp, Homo sapiens
ttcctgtatgctgcaactcatgaacttggccattctttgggtatgggacattcctctgatcctaatgcagtgatgtatccaacctatggaaatggagatcyccaaaattttaaactttcccaggatgatattaaaggcattcagaaactatatggtaatatttattatttcaaataagaggatttcccattttctttttag

SEQ ID NO: 20364 - DNA, 201 bp, Homo sapiens
tctaacccctctccacttttgaaagcctagaaacaaataagtaagctaccgtgggctaaaacttgggtatttttctttagtttttttaaattatgatatcwtatatataatattacataatgtatgtagctatttttatcattactgtttgtcacttcttcggttgtagggattaacttcctgtatgctgcaactcatgaa

SEQ ID NO: 20365 - DNA, 201 bp, Homo sapiens; identical to SEQ ID NO: 3174

SEQ ID NO: 20366 - DNA, 201 bp, Homo sapiens
tatgttttcatcaagtagccattaaaagcaggtttcagaatctgctcaaatcgggcttgagttccaaccctccactcactatgtagatagactcaggaagktcatcaaacttctctaagcttcaggtttccaatttggaagttggagataagaatggtatcaaccaaatgagggtgttgtgaagcattcaacacaatacct

SEQ ID NO: 20367 - DNA, 201 bp, Homo sapiens
tcctttttatgggtctcaatgagtcccataaactagcacttcagagaacacactttggaaaatgctgtgtaactattcccaaaagttacgacgtaaagaamcactgctgtccaaaagattcacaaaatgctgactattgttcgtaaagttatcatgaacaaaactgaaaatactatcctccccttacataaaactgtggaa

SEQ ID NO: 20368 - DNA, 201 bp, Homo sapiens
acattttacagatttgtaatctgatgctaagagaggttaagtagtaaactacctaaggtcacacatctagtaaactggtagaaacaagatgcaaaggtacmtgagccctgggcccacactccagtcaatcctgccttcttagcctctggaggttgttcttcagaatctttgtcccagggacaagaaatggtctgagtgaat

SEQ ID NO: 20369 - DNA, 201 bp, Homo sapiens
gaggcatgctgattaaatttaacaggaagaaaagagactagtgcattaaaaccttaagtattagacaaaagggcatctctggtcagagttggaaacaagtmacttctggacaaatggaaatagaatttaattatgtgggctgtatatgtagggagttaatctaaaaagtaatatgagcagaaaacatagattccaaagaaa

SEQ ID NO: 20370 - DNA, 201 bp, Homo sapiens
cctgaatgaaagaagcaaataaaaaaaattacacatttttaataagcagaagtagtgatgagattaaagcactcctattctgattaaccttctaacccctytccacttttgaaagcctagaaacaaataagtaagctaccgtgggctaaaacttgggtatttttctttagtttttttaaattatgatatcatatatataat

SEQ ID NO: 20371 - DNA, 201 bp, Homo sapiens
agtggtcaaatttaacaaaagcttaaatgcaaccttaagttagatataactgcattttaagtcctgtatccagtaagctttcaatatatggtgattatcaktgatgagcaatggttctgtgaaaggaaaagtgtctgggccaagaaagcacccaaactaccctgtgagtgcaaccgacagcacataacaatgtcagctact

SEQ ID NO: 20372 - DNA, 201 bp, Homo sapiens
caaaggcctcaagagtcccctgagaagtggtatatgacctgttgctaatgcctttcatgtggcaaggaagtaggaaatggaaactttcatattaaagaacwtaaaaatatataacacagcagggtgtggtggctcacgcctgtaatcccagcacttcgggaggccaaggcaggtggatcatctgcggtcaggagttcaaga

SEQ ID NO: 20373 - DNA, 201 bp, Homo sapiens; identical to SEQ ID NO: 3175

SEQ ID NO: 20374 - DNA, 201 bp, Homo sapiens
gtctatgataacacagagaatgtcccagtcgtacccctgaggacagactggtacatgcttcctgattgctcttacacacttctaggctttataaagtgtayagtgtaattctccccaaaacatttaaatggattttttaaaaattgagggattcttttcttttgctcacgaaatggcacgccagtgcttcattagcaatat

SEQ ID NO: 20375 - DNA, 201 bp, Homo sapiens
atccagtaagctttcaatatatggtgattatcagtgatgagcaatggttctgtgaaaggaaaagtgtctgggccaagaaagcacccaaactaccctgtgartgcaaccgacagcacataacaatgtcagctacttgcactgggctgccttttttttttttttaatttattttttgagatggagtttcactgttgtcaccca

SEQ ID NO: 20376 - DNA, 201 bp, Homo sapiens
gagccagttgcgtgtcgaggaaataagggtacccccccaccacaccccaaccccctcagtgccctggggtttgaagcaaatgctcagagggcctggtaggrggatgggcgtctccggatgatgcagaaagcaataagcaccagggcgaggaggccaagaaggatcaggccgatgatgagaggcagcaagatggaccggtca

SEQ ID NO: 20377 - DNA, 201 bp, Homo sapiens
aaaccaaggtccagggaagctgtgagggtgcccatccccacctgcttctctcattcccctatggacacctcagctttggattcatgcaggtatagccatgwcctcagtctcacccctcactcagcctcccggcgcccctcccctcccaatcccacacgctactccttcctctgtggagagggataccacctgcgccttcct

SEQ ID NO: 20378 - DNA, 201 bp, Homo sapiens
gggctactggcaggtaaggaggaaggaggctgaggggagggggcccctgggagggagcctgccctgggttgctaaccatctcctctctgccaaaagcccargggacagggaatgactgtcctcacaaaaaatcagctactttgctgccatccttcacggtgacacccacggttacagagagcactggaacaaccagccaca

SEQ ID NO: 20379 - DNA, 201 bp, Homo sapiens
cccttcctcactcctccagagtggacattctcggctcagaatgcatcccttcgagatctccaagcacccctggggcagagcttcagttgcagcaactcgascatcattctttcaccagctgtccacctcgacctgctctccctgaggctccaggctgctcagctgccccacacaggggtctttgggcaaagtaagacctac

SEQ ID NO: 20380 - DNA, 201 bp, Homo sapiens
gagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgcc

SEQ ID NO: 20381 - DNA, 201 bp, Homo sapiens
acccccccaccacaccccaaccccctcagtgccctggggtttgaagcaaatgctcagagggcctggtaggcggatgggcgtctccggatgatgcagaaagraataagcaccagggcgaggaggccaagaaggatcaggccgatgatgagaggcagcaagatggaccggtcactggggcaggagaaacctggcggaaggata

SEQ ID NO: 20382 - DNA, 201 bp, Homo sapiens
cacctgcgccttcctcttcgccccacaggacctccagcagaaggttgtctacctgagctacatggcggtggagtacaatgtgtccttcccccacgcagcamgtaagtaacctccttccctttctcattgctaccactagacgccagggttcctgaaaggactaagctggggccagggaggtggataggatctgacccttcc

SEQ ID NO: 20383 - DNA, 201 bp, Homo sapiens
ttctcagagtgaacatgcctcgtagcttgggtcctatggcaggagtgcaataggacatggatatgcatcacctgttctataaaactggttgctggctgggygcggtggctcaactcgtataatcccaacactttgggaggccaaggcaggcagatctcttgagatcaggagttggagaccagcctggccaacatagtgaaa

SEQ ID NO: 20384 - DNA, 201 bp, Homo sapiens
ttgactgtagtcaccctgctccaggcctccaatgtgcctgctgtggtggtggggagggtgggtaccaggagcaagggacaagatgttgtgggggcagggtsggggggaagagtagaagatcaaagtgtgggggtgttgtacttgggggagcatgggaagagctcaggtgacagagccaaaggtctcaactcctcccctagc

SEQ ID NO: 20385 - DNA, 201 bp, Homo sapiens
cgccgcgggaaaagaacgggaggcggagtgtccgcagcgcgcacgcgcaacgaaagtcaatggcggtctggagagactggcggaagctagctttgcaatayggcggccgaggcggacggaccgcttaaacggctgctcgtgccgattcttttacctgagaaatgctacgaccaacttttcgttcagtgggacttgcttcac

SEQ ID NO: 20386 - DNA, 201 bp, Homo sapiens; identical to SEQ ID NO: 3185

SEQ ID NO: 20387 - DNA, 201 bp, Homo sapiens; identical to SEQ ID NO: 3186

SEQ ID NO: 20388 - DNA, 201 bp, Homo sapiens
catcccaaagaatggagagtcctcagtcctacttttctcatctttcccctagtaaagctgccccaggtgtttaaaatcctgggagccaagagtgctgaagrgttgagtctccagtctgtaatgctggagctagtggcattgactgggaccatggtctacagcatcactaacaacttcccattcaggtgaggggcccaccct

SEQ ID NO: 20389 - DNA, 201 bp, Homo sapiens
cccaaagaatggagagtcctcagtcctacttttctcatctttcccctagtaaagctgccccaggtgtttaaaatcctgggagccaagagtgctgaagggtygagtctccagtctgtaatgctggagctagtggcattgactgggaccatggtctacagcatcactaacaacttcccattcaggtgaggggcccacccttcc

SEQ ID NO: 20390 - DNA, 201 bp, Homo sapiens; identical to SEQ ID NO: 17493

SEQ ID NO: 20391 - DNA, 201 bp, Homo sapiens; identical to SEQ ID NO: 3177

SEQ ID NO: 20392 - DNA, 201 bp, Homo sapiens; identical to SEQ ID NO: 3178

SEQ ID NO: 20393 - DNA, 201 bp, Homo sapiens
ctagcccaacctccaaggagaccattggagactacacgtggaccaatggttcccagccctgtgtccacctccaagcccagattcagattcgagtcatgtayacaacccagggtggaggagaggtaaagctaaaactgggggatgagaggggagggaggcaggactggatataggctcagagggaagaaggaagaggggaca

SEQ ID NO: 20394 - DNA, 201 bp, Homo sapiens
tggaccaatggttcccagccctgtgtccacctccaagcccagattcagattcgagtcatgtacacaacccagggtggaggagaggtaaagctaaaactggsggatgagaggggagggaggcaggactggatataggctcagagggaagaaggaagaggggacagggaaccttggccggcatcgcatgcagtcttgtgacct

SEQ ID NO: 20395 - DNA, 201 bp, Homo sapiens
cctggggtttgaagcaaatgctcagagggcctggtaggcggatgggcgtctccggatgatgcagaaagcaataagcaccagggcgaggaggccaagaaggytcaggccgatgatgagaggcagcaagatggaccggtcactggggcaggagaaacctggcggaaggatagggcaggtaggtatttgcagtgacgtgctggt

SEQ ID NO: 20396 - DNA, 201 bp, Homo sapiens; identical to SEQ ID NO: 3189

SEQ ID NO: 20397 - DNA, 201 bp, Homo sapiens
gctcccagcctgattataatcttcatgcctgagtcagatgaagagcaacccaactgcttggcaaaagatacgtactagcttcatgttggtctgagcggggrcattgcattctgggcagtttgtgctgaactggagcacctggaacacaacatgaggacaaagggtgagccctcccagatgggatgttcaggctaaagacac

SEQ ID NO: 20398 - DNA, 201 bp, Homo sapiens
cctagtccctctccacagcgttttcggccacccaggcacggaaaggcttctgggactacttcagccagaccagcggggacaaaggcagggtggagcagatmcatcagcagaagatggctcgcgagcccgcgtgagtgcccaggggaaggggtgtaggcgaagggaggagacagctgggccatgccatgatgacctgcctct

SEQ ID NO: 20399 - DNA, 201 bp, Homo sapiens
ggagagcccaggccctgattacctagtccctctccacagcgttttcggccacccaggcacggaaaggcttctgggactacttcagccagaccagcggggamaaaggcagggtggagcagatccatcagcagaagatggctcgcgagcccgcgtgagtgcccaggggaaggggtgtaggcgaagggaggagacagctgggcc

SEQ ID NO: 20400 - DNA, 201 bp, Homo sapiens
tcaacgtgggggtgtgggtggaggctggccagagggccctgtccaccctgggggaggagagcccaggccctgattacctagtccctctccacagcgttttsggccacccaggcacggaaaggcttctgggactacttcagccagaccagcggggacaaaggcagggtggagcagatccatcagcagaagatggctcgcgag

SEQ ID NO: 20401 - DNA, 201 bp, Homo sapiens
gcaagcatggctgccgtgctcacctgggctctggctcttctttcaggtgggtctccgaccctgacttcaacgtgggggtgtgggtggaggctggccagagkgccctgtccaccctgggggaggagagcccaggccctgattacctagtccctctccacagcgttttcggccacccaggcacggaaaggcttctgggactac

SEQ ID NO: 20402 - DNA, 201 bp, Homo sapiens; identical to SEQ ID NO: 3196

SEQ ID NO: 20403 - DNA, 201 bp, Homo sapiens; identical to SEQ ID NO: 3198

SEQ ID NO: 20404 - DNA, 201 bp, Homo sapiens; identical to SEQ ID NO: 3197

SEQ ID NO: 20405 - DNA, 201 bp, Homo sapiens; identical to SEQ ID NO: 3199

SEQ ID NO: 20406 - DNA, 201 bp, Homo sapiens; identical to SEQ ID NO: 3200

SEQ ID NO: 20407 - DNA, 201 bp, Homo sapiens; identical to SEQ ID NO: 3188

SEQ ID NO: 20408 - DNA, 201 bp, Homo sapiens; identical to SEQ ID NO: 3190

SEQ ID NO: 20409 - DNA, 201 bp, Homo sapiens; identical to SEQ ID NO: 3192

SEQ ID NO: 20410 - DNA, 201 bp, Homo sapiens; identical to SEQ ID NO: 3195

SEQ ID NO: 20411 - DNA, 201 bp, Homo sapiens; identical to SEQ ID NO: 3201

SEQ ID NO: 20412 - DNA, 201 bp, Homo sapiens
ttgcccctgcagaggccccctgggcaagtcccctgcgccatgtcccttcgtctccttcttcccctaaccaggcctccctccacctgtcttctcagagcagrtaatggcaagcatggctgccgtgctcacctgggctctggctcttctttcaggtgggtctccgaccctgacttcaacgtgggggtgtgggtggaggctggc

SEQ ID NO: 20413 - DNA, 201 bp, Homo sapiens; identical to SEQ ID NO: 3226

SEQ ID NO: 20414 - DNA, 201 bp, Homo sapiens; identical to SEQ ID NO: 3227

SEQ ID NO: 20415 - DNA, 201 bp, Homo sapiens; identical to SEQ ID NO: 3228

SEQ ID NO: 20416 - DNA, 201 bp, Homo sapiens
aagcatacacagcatctgccattgtccacctgcaggatgggggagctgaagaatgtatctattgcctctggccctcattagttgagcgttgcccctggggkcatttactcccccctcatttccaggttgaactttgtcagatgaggaatgccacacacacacacaccagggaagactctggggcagaatgtgttcgtcacc

SEQ ID NO: 20417 - DNA, 201 bp, Homo sapiens
gtaggagttgtttgcccttggccaatatgaaaaacctgagtgttctcccttcacttctagcgacaagtaacacatcccctgtcttgccatgaaaagagctktaactgtagcagccggtggcaggttttctgttcccaggtggggaagtgaggagagacaaacagaggggtgagagggagacagaaggaagacagctggtaa

SEQ ID NO: 20418 - DNA, 201 bp, Homo sapiens
gattacttgaggccaggagttcgagaccagcctagccaacatggtgaaaccctgtctctactaaaaaatacaaaaattagctgggcacggtggagcatgcytgtaatctcagctactcaggagactgaggcacaagaatcacttgaacccaggaggcagaggttgcagtgagtcaagatcgcaccactgcactccagcctg

SEQ ID NO: 20419 - DNA, 201 bp, Homo sapiens
agaacaacactacattagtaggccacctgctaacttctgcctttcacattttccagcttaaaacatctccatcctccccattatgtaagaaagaagtacargtgtttctgactgctccctctcccatgatcccataacccatcagttctgaagctgcattatccaaccttctgaatctctctgaccaccctccaagtcttc

SEQ ID NO: 20420 - DNA, 201 bp, Homo sapiens
tgagactgggccaagaaagaagctgccatccatgtgatgggtccacagagaaggatagatcgagtcaggattctcaagcagtttggctgtgcaattggcaygtattctctgaccccttggcattctctggagagaatgcactaaatattttcactgcatttcacctgagtttctcagcctcaacatcactgacatttggaa

SEQ ID NO: 20421 - DNA, 201 bp, Homo sapiens; identical to SEQ ID NO: 3231

SEQ ID NO: 20422 - DNA, 201 bp, Homo sapiens; identical to SEQ ID NO: 3230

SEQ ID NO: 20423 - DNA, 201 bp, Homo sapiens
ttcctccaccctctctcactatctgtctctctaccctccccatccttttattctagaggagaataaactctaaggccagattgaatgagcatccaaaagamgtatctggagggagattttgtctttcctgtgagcagcagcagcttcctacggaccctgctggagccccagctcggatcagcccttctgacagcaatgaat

SEQ ID NO: 20424 - DNA, 201 bp, Homo sapiens
ttcttaaaactttcttcaactttggtataagaaagactctgtagcctgaaagttaattttcaaacatggctgcagaaagacttggtgtcaaaagatgtggraagtattttacacaatgaaaatcaccacaacaaccagggacctgtgggggtagagtcctttgggtttagaggcattgatgtaattttttttggcagtttt

SEQ ID NO: 20425 - DNA, 201 bp, Homo sapiens
ccaagccttttcctttgaggctcagggcgggctggctaacattgctatattgaacaacaacttgaataccttgatccagcgttccaaccacactcaggccrccaacggtacgccctatctttgcctcttcctctgtagcccaactggaagggatgagagggcctctctgccaccctcagactaggaagcctaagtgccccc

SEQ ID NO: 20426 - DNA, 201 bp, Homo sapiens; identical to SEQ ID NO: 3234

SEQ ID NO: 20427 - DNA, 201 bp, Homo sapiens; identical to SEQ ID NO: 3235

SEQ ID NO: 20428 - DNA, 201 bp, Homo sapiens; identical to SEQ ID NO: 3237

SEQ ID NO: 20429 - DNA, 201 bp, Homo sapiens
tatctgttttaaggtcccagaacattccacgagaggcatcttgctcaatattctttgacaggagcaggtcagcctggagccacatcagtgacctccagggkgcgctggagttaaggcctgatacccaatggcctcatttctgacccagttcaaatacatttcaccaaggcaaggattcctgtttgttctagttgccttctc

SEQ ID NO: 20430 - DNA, 201 bp, Homo sapiens
gatcccagcctgggatccctctctcgctataggtcatgtttgttccccgattatctgatatcagtggcctctagagctttctgacatttcttttctgtcaracccctcatcgtggaataagtgtgaatatgccaggggaaggtaagtcccgctcaccctgcaggctttctcacctttcttgctcctcctgtgcatgaagat

SEQ ID NO: 20431 - DNA, 201 bp, Homo sapiens
tccgaggagctggggccatcaagggtgagtgctcaggaggacgcaggagcgtcggggtgagtgatggggtggttcacatcaattgctgcttcagggatcasagattttaggggctcattgatctatctggtcctcatagtctatgttccctctggccctcataataataacagcaataacagccagaatttatgagactcc

SEQ ID NO: 20432 - DNA, 201 bp, Homo sapiens; identical to SEQ ID NO: 3331

SEQ ID NO: 20433 - DNA, 201 bp, Homo sapiens
ggcccacagtttcagtctcatctgcctccactcggcctcagttcctcatcactgttcctgtgctcacagtcatcaattatagaccccacaacatgcgcccwgaagacagaatgttccatatcagagctgtgatcttgagagccctctccttggctttcctgctgagtctccgaggagctggggccatcaagggtgagtgct

SEQ ID NO: 20434 - DNA, 201 bp, Homo sapiens; identical to SEQ ID NO: 3333

SEQ ID NO: 20435 - DNA, 201 bp, Homo sapiens; identical to SEQ ID NO: 3242

SEQ ID NO: 20436 - DNA, 201 bp, Homo sapiens
gaaccaacctcataaaatgatctcaaaaattctgttccattctatgttctagaatcacacgtgtaagaggcatgatctgctcctggaaatgtgggaggacrccctcatctgcaataagatcaggacagggccctttggaaggcgattctttgcttcccatgacaatttctttgatattctctactctattttagttttcta

SEQ ID NO: 20437 - DNA, 201 bp, Homo sapiens; identical to SEQ ID NO: 3243

SEQ ID NO: 20438 - DNA, 201 bp, Homo sapiens
ggctgtgcaacggggagctggtcactgagggtgtcgctgagagcctcttcctgcccagaacagattacagcttccacaagttccattacctgacctttgtrccctcagcagaggacttctatgactgcagggtggagcactggggcttggaccagccgctcctcaagcactggggtatgcaactgcttttctctccataat

SEQ ID NO: 20439 - DNA, 201 bp, Homo sapiens
cacttgcatattcaaactgacattttgtcgtgtttttctctactgtctttatgcagcggaccatgtgtcaacttatgccgcgtttgtacagacgcatagamcaacaggggagtttatgtttgaatttgatgaagatgagatgttctatgtggatctggacaagaaggagaccgtctggcatctggaggagtttggccaagc

SEQ ID NO: 20440 - DNA, 201 bp, Homo sapiens
atcacacagcagggggcacttaggcttcctagtctgagggtggcagagaggccctctcatcccttccagttgggctacagaggaagaggcaaagatagggmgtaccgttggtggcctgagtgtggttggaacgctggatcaaggtattcaagttgttgttcaatatagcaatgttagccagcccgccctgagcctcaaagg

SEQ ID NO: 20441 - DNA, 201 bp, Homo sapiens
aagcgtctttcccaaggagcctgtggatctgggccagcccaacaccctcgtctgccatgttgacaagttcttcccaccagtgctgaacatcacgtggctgygcaatggggagccagtcattgagggtattgcagagaccatcttcctgcccagcaagaaactcagattacacaggttccactatctgaccctcgttcccat

SEQ ID NO: 20442 - DNA, 201 bp, Homo sapiens
tttgctcctttctttttataactgctcatctgctctgtattatttcctttatggtgttgctccttcttcttccccatatgtccttcctttgacctcttacyttcttcctttttatattcataagtctttattcattctctagctttgaccacttgcatattcaaactgacattttgtcgtgtttttctctactgtctttat

SEQ ID NO: 20443 - DNA, 201 bp, Homo sapiens
ttgcttcaaattcccaaattctcctttacttctctatttaagccctttctattgtgaactaggggacatttggaagaaacacacaaaccaatagaatgtaygttgaatggttatcaccgcaagcacccatgtaactagtacccgggtgaagaaatagactgttgccagcatccctgtgcccctccttaggccaggaggtag

SEQ ID NO: 20444 - DNA, 201 bp, Homo sapiens
agggggcggacatgagcggaggcgccactctcatctaatcctctttctccctctctctctcaatattaacgattcttcccaaatcttcccacccagggctrgattttaaaataggagttttcctagtaccgagttctgtggtcctaagcgggtcgcagagcctctccaggcctgttttctcaccacgcagagagagaattt

SEQ ID NO: 20445 - DNA, 201 bp, Homo sapiens
gatcacacagcagggggcacttaggcttcctagtctgagggtggcagagaggccctctcatcccttccagttgggctacagaggaagaggcaaagataggscgtaccgttggtggcctgagtgtggttggaacgctggatcaaggtattcaagttgttgttcaatatagcaatgttagccagcccgccctgagcctcaaag

SEQ ID NO: 20446 - DNA, 201 bp, Homo sapiens
taggttcccttcattctgctggggaggttctgggagcagatgtgcaggagaaagactgtcagcctggcttcctgagtacgatgataagcagagcttcctgsatgacttactttggacgtgtagcatgagccaaacctggatatctgggtatttgttagtttagcacagctgatcctattcttactgtgtaaaagaaattga

SEQ ID NO: 20447 - DNA, 201 bp, Homo sapiens
ctgcggggagggggcggacatgagcggaggcgccactctcatctaatcctctttctccctctctctctcaatattaacgattcttcccaaatcttcccacycagggctggattttaaaataggagttttcctagtaccgagttctgtggtcctaagcgggtcgcagagcctctccaggcctgttttctcaccacgcagaga

SEQ ID NO: 20448 - DNA, 201 bp, Homo sapiens; identical to SEQ ID NO: 3252

SEQ ID NO: 20449 - DNA, 201 bp, Homo sapiens
aatgactgatgtacctcaagactcctctacctcctggctgcctttgatcctgctgcacatagcactcagcaaagggcctgactcttagaaaacactctatmaatattgaaaatttgaagtctagtgacaaggtggtcccagtttggatggtctctcagctcttgtctcctctgggacctgtctctgcactgcatccttcct

SEQ ID NO: 20450 - DNA, 201 bp, Homo sapiens
aattctctgcggggagggggcggacatgagcggaggcgccactctcatctaatcctctttctccctctctctctcaatattaacgattcttcccaaatctwcccacccagggctggattttaaaataggagttttcctagtaccgagttctgtggtcctaagcgggtcgcagagcctctccaggcctgttttctcaccacg

SEQ ID NO: 20451 - DNA, 201 bp, Homo sapiens
ctgacattttgtcgtgtttttctctactgtctttatgcagcggaccatgtgtcaacttatgccgcgtttgtacagacgcatagaccaacaggggagtttakgtttgaatttgatgaagatgagatgttctatgtggatctggacaagaaggagaccgtctggcatctggaggagtttggccaagccttttcctttgaggct

SEQ ID NO: 20452 - DNA, 201 bp, Homo sapiens
tattcaaactgacattttgtcgtgtttttctctactgtctttatgcagcggaccatgtgtcaacttatgccgcgtttgtacagacgcatagaccaacaggrgagtttatgtttgaatttgatgaagatgagatgttctatgtggatctggacaagaaggagaccgtctggcatctggaggagtttggccaagccttttcct

SEQ ID NO: 20453 - DNA, 201 bp, Homo sapiens
tagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtaacttatctttttacatc

SEQ ID NO: 20454 - DNA, 201 bp, Homo sapiens
agtctatgttccctctggccctcataataataacagcaataacagccagaatttatgagactcctgcatagtttctttccccatttacatctcacaggaaycttcaatgaagataatattccattcatttagaaattattccttttatttagaaattattttgaaaaaactgaagctcaaaaagatgaataagttttccaa

SEQ ID NO: 20455 - DNA, 201 bp, Homo sapiens
gagtctccgaggagctggggccatcaagggtgagtgctcaggaggacgcaggagcgtcggggtgagtgatggggtggttcacatcaattgctgcttcaggratcacagattttaggggctcattgatctatctggtcctcatagtctatgttccctctggccctcataataataacagcaataacagccagaatttatgag

SEQ ID NO: 20456 - DNA, 201 bp, Homo sapiens
ctttcctgctgagtctccgaggagctggggccatcaagggtgagtgctcaggaggacgcaggagcgtcggggtgagtgatggggtggttcacatcaattgytgcttcagggatcacagattttaggggctcattgatctatctggtcctcatagtctatgttccctctggccctcataataataacagcaataacagccag

SEQ ID NO: 20457 - DNA, 201 bp, Homo sapiens
tttgtcgtgtttttctctactgtctttatgcagcggaccatgtgtcaacttatgccgcgtttgtacagacgcatagaccaacaggggagtttatgtttgartttgatgaagatgagatgttctatgtggatctggacaagaaggagaccgtctggcatctggaggagtttggccaagccttttcctttgaggctcagggcg

SEQ ID NO: 20458 - DNA, 201 bp, Homo sapiens
tttttctctactgtctttatgcagcggaccatgtgtcaacttatgccgcgtttgtacagacgcatagaccaacaggggagtttatgtttgaatttgatgahgatgagatgttctatgtggatctggacaagaaggagaccgtctggcatctggaggagtttggccaagccttttcctttgaggctcagggcgggctggcta

SEQ ID NO: 20459 - DNA, 201 bp, Homo sapiens
tgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgcta

SEQ ID NO: 20460 - DNA, 201 bp, Homo sapiens
ccgtccctggaaaaggtaattctctgcggggagggggcggacatgagcggaggcgccactctcatctaatcctctttctccctctctctctcaatattaasgattcttcccaaatcttcccacccagggctggattttaaaataggagttttcctagtaccgagttctgtggtcctaagcgggtcgcagagcctctccagg

SEQ ID NO: 20461 - DNA, 201 bp, Homo sapiens
caattgctgcttcagggatcacagattttaggggctcattgatctatctggtcctcatagtctatgttccctctggccctcataataataacagcaataayagccagaatttatgagactcctgcatagtttctttccccatttacatctcacaggaatcttcaatgaagataatattccattcatttagaaattattcct

SEQ ID NO: 20462 - DNA, 201 bp, Homo sapiens
agatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattg

SEQ ID NO: 20463 - DNA, 201 bp, Homo sapiens
acatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagttt

SEQ ID NO: 20464 - DNA, 201 bp, Homo sapiens
tcgctgtcgaagcgcgcgaactcctcccggttgtagatgtatctctccaggaagcgctgtgtcccattaaacgcgtagcattcctgccgtccctggaaaasgtaattctctgcggggagggggcggacatgagcggaggcgccactctcatctaatcctctttctccctctctctctcaatattaacgattcttcccaaat

SEQ ID NO: 20465 - DNA, 201 bp, Homo sapiens
cgtcgctgtcgaagcgcgcgaactcctcccggttgtagatgtatctctccaggaagcgctgtgtcccattaaacgcgtagcattcctgccgtccctggaamaggtaattctctgcggggagggggcggacatgagcggaggcgccactctcatctaatcctctttctccctctctctctcaatattaacgattcttcccaa

SEQ ID NO: 20466 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggwaaaggtaattctctgcggggagggggcggacatgagcggaggcgccactctcatctaatcctctttctccctctctctctcaatattaacgattcttccc

SEQ ID NO: 20467 - DNA, 201 bp, Homo sapiens
tcccccacgtcgctgtcgaagcgcgcgaactcctcccggttgtagatgtatctctccaggaagcgctgtgtcccattaaacgcgtagcattcctgccgtcmctggaaaaggtaattctctgcggggagggggcggacatgagcggaggcgccactctcatctaatcctctttctccctctctctctcaatattaacgattc

SEQ ID NO: 20468 - DNA, 201 bp, Homo sapiens
cagcagtatccaatttggaagttgaaggtctgtcctggagccagatgctaacgaaacacagcaaatgcttttcctaaggcacaatagtcttttcagtgagstcaggaaccctgtgggggtaaaagacaagttatcccaggttgccagcctccttcctgtaagtccaggagagaaaaattatggtgagaggatgcgtctcag

SEQ ID NO: 20469 - DNA, 201 bp, Homo sapiens
accatggagtccacctttagtctccagtgtcattgctaaggcaagatcccaggtcttgactcagatatcctgacctgcctcttctcctggtgccttgggcsccagaccctaaaattccaggcccagagccccccagctccttgagtccagattcctcctcctctgccatccatccgcccctgcctgttcaattgccccact

SEQ ID NO: 20470 - DNA, 201 bp, Homo sapiens
ctactgtctttatgcagcggaccatgtgtcaacttatgccgcgtttgtacagacgcatagaccaacaggggagtttatgtttgaatttgatgaagatgagmtgttctatgtggatctggacaagaaggagaccgtctggcatctggaggagtttggccaagccttttcctttgaggctcagggcgggctggctaacattgc

SEQ ID NO: 20471 - DNA, 201 bp, Homo sapiens
ttccatatcagagctgtgatcttgagagccctctccttggctttcctgctgagtctccgaggagctggggccatcaagggtgagtgctcaggaggacgcargagcgtcggggtgagtgatggggtggttcacatcaattgctgcttcagggatcacagattttaggggctcattgatctatctggtcctcatagtctatgt

SEQ ID NO: 20472 - DNA, 201 bp, Homo sapiens
ctccacatcctctccagcacctgttgtttcctgactttttaatgatcgccattttaactggtgtgagatggtatctcaagacagtgtggcaattcctcaargatctagaactagaaataccatttgacccagccatcccattactggatatatacccaaaggattataaatcatgctgctataaagacacatgcacacata

SEQ ID NO: 20473 - DNA, 201 bp, Homo sapiens
aaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttca

SEQ ID NO: 20474 - DNA, 201 bp, Homo sapiens
agttagtatgaaaggtctgaaaatataaagcctgtgatgcacttaagatgacggaggaaagacagtgatactcattttaaccagtcagataagtcatgatrtttggggagattatgcgttttctttgctctgaaggtgatctcaaatattctgctggcccatctacagggattatcatttccccaattctgccacacctca

SEQ ID NO: 20475 - DNA, 201 bp, Homo sapiens
tgcctgagtcccctccaggctggatgcagacatgaacacgcccaggagcctgcacttgccaacttctctctctgcaaaccttgtctgtccaaggttatccwggacctcttggtcccattttccccaaagacaagcactgaccactgggcacctctctctgtttactgtacccatgtccttggagagagaataggccagtag

SEQ ID NO: 20476 - DNA, 201 bp, Homo sapiens
ctggattaagaaaatgcacacatatacaccatggaatactgtgcagccataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaag

SEQ ID NO: 20477 - DNA, 201 bp, Homo sapiens
ttttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattca

SEQ ID NO: 20478 - DNA, 201 bp, Homo sapiens
ctcccccacgtcgctgtcgaagcgcgcgaactcctcccggttgtagatgtatctctccaggaagcgctgtgtcccattaaacgcgtagcattcctgccgtmcctggaaaaggtaattctctgcggggagggggcggacatgagcggaggcgccactctcatctaatcctctttctccctctctctctcaatattaacgatt

SEQ ID NO: 20479 - DNA, 201 bp, Homo sapiens
gcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctcatcactgttcctgtgctcacagtcatcaattatagaccccaca

SEQ ID NO: 20480 - DNA, 201 bp, Homo sapiens
agtgaccaaaaaacatcaaagatcatctgactgtctgggatgggggtggggctcgggagaaggaacataatggaaaacatttgccgtcagaagaaggtgtracttatctttttacatctctttctctaactctgaaaatgaactgtgaactggagctctcttgaccacgctggtacctaaaattctcccatctcttcccca

SEQ ID NO: 20481 - DNA, 201 bp, Homo sapiens
ctcctccaggatgtccttctggctgttccagtactccgcagcaggccgccccagctccgtcaccgcccggaactcccccacgtcgctgtcgaagcgcgcgwactcctcccggttgtagatgtatctctccaggaagcgctgtgtcccattaaacgcgtagcattcctgccgtccctggaaaaggtaattctctgcggggag

SEQ ID NO: 20482 - DNA, 201 bp, Homo sapiens
cttctcctccaggatgtccttctggctgttccagtactccgcagcaggccgccccagctccgtcaccgcccggaactcccccacgtcgctgtcgaagcgcrcgaactcctcccggttgtagatgtatctctccaggaagcgctgtgtcccattaaacgcgtagcattcctgccgtccctggaaaaggtaattctctgcggg

SEQ ID NO: 20483 - DNA, 201 bp, Homo sapiens
cagggtcatgggcccgcccagctcgtagttgtgtctgcacatcctgtccggcactgcccgcttctcctccaggatgtccttctggctgttccagtactcckcagcaggccgccccagctccgtcaccgcccggaactcccccacgtcgctgtcgaagcgcgcgaactcctcccggttgtagatgtatctctccaggaagcg

SEQ ID NO: 20484 - DNA, 201 bp, Homo sapiens
gctgcagggtcatgggcccgcccagctcgtagttgtgtctgcacatcctgtccggcactgcccgcttctcctccaggatgtccttctggctgttccagtastccgcagcaggccgccccagctccgtcaccgcccggaactcccccacgtcgctgtcgaagcgcgcgaactcctcccggttgtagatgtatctctccagga

SEQ ID NO: 20485 - DNA, 201 bp, Homo sapiens
caaagccctcactcacctcggcgctgcagggtcatgggcccgcccagctcgtagttgtgtctgcacatcctgtccggcactgcccgcttctcctccaggakgtccttctggctgttccagtactccgcagcaggccgccccagctccgtcaccgcccggaactcccccacgtcgctgtcgaagcgcgcgaactcctcccgg

SEQ ID NO: 20486 - DNA, 201 bp, Homo sapiens
tcagagctgtgatcttgagagccctctccttggctttcctgctgagtctccgaggagctggggccatcaagggtgagtgctcaggaggacgcaggagcgtyggggtgagtgatggggtggttcacatcaattgctgcttcagggatcacagattttaggggctcattgatctatctggtcctcatagtctatgttccctct

SEQ ID NO: 20487 - DNA, 201 bp, Homo sapiens
ccatcggacttgaatgctgcctgggtagaaatccgtcacgtggcagacaagcaggttgtggtgctgcaagggccccttcttggagggggaaacattcaccytaggctggactaggagcgtggaagaaaaataatgaaatagaatttgagattgtccttctttccttccttccttccttccttccttccttccttccttcct

SEQ ID NO: 20488 - DNA, 201 bp, Homo sapiens
aggccaacccggctgctcctgcgccctgggcacgggcccgcggggctgccctgggaccgccggcccaaagccctcactcacctcggcgctgcagggtcatsggcccgcccagctcgtagttgtgtctgcacatcctgtccggcactgcccgcttctcctccaggatgtccttctggctgttccagtactccgcagcaggcc

SEQ ID NO: 20489 - DNA, 201 bp, Homo sapiens
tactgtctttatgcagcggaccatgtgtcaacttatgccgcgtttgtacagacgcatagaccaacaggggagtttatgtttgaatttgatgaagatgagawgttctatgtggatctggacaagaaggagaccgtctggcatctggaggagtttggccaagccttttcctttgaggctcagggcgggctggctaacattgct

SEQ ID NO: 20490 - DNA, 201 bp, Homo sapiens; identical to SEQ ID NO: 3316

SEQ ID NO: 20491 - DNA, 201 bp, Homo sapiens
tgagttgcttactatgttctaggcactattctaagtgcttctcatgtgttcacttatttacatctggaggttggttcttatttatttcatgttacagagcrggaatcagacaccgggagaggtgaagaccacacagcttcaaagtgcaaagcttggatttaaacccaggctttgggcctgcagtggctgcagtcttgtcca

SEQ ID NO: 20492 - DNA, 201 bp, Homo sapiens
gctatagatttttggttcactacctttaacatgtcatgaaattgattaaattctgtctatgtcttgagctgaattcagtttaaattaatatgaattttgcrgagtccactaatgtgttaaccacattatatattttctgacactgaagaatcattgcattcctagaataaatctaaaattggtcaaaacgtattgttttta

SEQ ID NO: 20493 - DNA, 201 bp, Homo sapiens
cctatgtgtgaggtcagttcctaagtgtgagggtttcgagaccagtcagtgtccctagattctctgacaagggggagaactatgaatcttcaggaaccccyaagccaaggtcaggaagtctccatttccctggcttcaaactatgctcaggagctggtatagaagaaagatggggtttggacatggccccagggtatagat

SEQ ID NO: 20494 - DNA, 201 bp, Homo sapiens
aatctgataagtgttcattgatcttctaatgggttaaaagcattcagccacataacaacaacaacaccgataactaactgagtagttaatatggtcaggcrctattctgaggatttacatttattaactcactttattctcacacatagtctttgaggtaggtactattattttcactatttcacatgagagatacttaca

SEQ ID NO: 20495 - DNA, 201 bp, Homo sapiens
gccattttaactggtgtgagatggtatctcaagacagtgtggcaattcctcaaagatctagaactagaaataccatttgacccagccatcccattactggrtatatacccaaaggattataaatcatgctgctataaagacacatgcacacatatgtttattgcggcactattcacaatagcaaagacttggaaccaaccc

SEQ ID NO: 20496 - DNA, 201 bp, Homo sapiens
ctcacacatagtctttgaggtaggtactattattttcactatttcacatgagagatacttacatctttttacatacacagagactttaagcactttgatcmagttcccacagctatgaagtagtagggctagcttccaatccagaaagtctggatccaagactgtttatccactgtcctattcaccctattttgtgaagga

SEQ ID NO: 20497 - DNA, 201 bp, Homo sapiens
aactagaaataccatttgacccagccatcccattactggatatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactg

SEQ ID NO: 20498 - DNA, 201 bp, Homo sapiens
caatccagaaagtctggatccaagactgtttatccactgtcctattcaccctattttgtgaaggaaaagaccaagttcaaattctccagagtccattgccwaataatggagtcagatctatatttctatacataattacaacacagtgtggtgggtgcctgtaactacttactgtctctacttggactcattccatggcaa

SEQ ID NO: 20499 - DNA, 201 bp, Homo sapiens
ggaccgccggcccaaagccctcactcacctcggcgctgcagggtcatgggcccgcccagctcgtagttgtgtctgcacatcctgtccggcactgcccgctyctcctccaggatgtccttctggctgttccagtactccgcagcaggccgccccagctccgtcaccgcccggaactcccccacgtcgctgtcgaagcgcgcg

SEQ ID NO: 20500 - DNA, 201 bp, Homo sapiens
ccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctct

SEQ ID NO: 20501 - DNA, 201 bp, Homo sapiens
cgggcccgcggggctgccctgggaccgccggcccaaagccctcactcacctcggcgctgcagggtcatgggcccgcccagctcgtagttgtgtctgcacaycctgtccggcactgcccgcttctcctccaggatgtccttctggctgttccagtactccgcagcaggccgccccagctccgtcaccgcccggaactccccc

SEQ ID NO: 20502 - DNA, 201 bp, Homo sapiens
cacgggcccgcggggctgccctgggaccgccggcccaaagccctcactcacctcggcgctgcagggtcatgggcccgcccagctcgtagttgtgtctgcayatcctgtccggcactgcccgcttctcctccaggatgtccttctggctgttccagtactccgcagcaggccgccccagctccgtcaccgcccggaactccc

SEQ ID NO: 20503 - DNA, 201 bp, Homo sapiens
tctctgcgggcctctcctcacactgcacttgggtttttttggtctctttcacaggcttttctgtcttggccaaatcacaactgtccagttcccaggatccrgtcctttgctcttccccctgggtcccctctccctggatggtctcatgtatctcagtctcctccccggctgcagacccttctgtctacctgcccatcagac

SEQ ID NO: 20504 - DNA, 201 bp, Homo sapiens
taggggctcattgatctatctggtcctcatagtctatgttccctctggccctcataataataacagcaataacagccagaatttatgagactcctgcataktttctttccccatttacatctcacaggaatcttcaatgaagataatattccattcatttagaaattattccttttatttagaaattattttgaaaaaact

SEQ ID NO: 20505 - DNA, 201 bp, Homo sapiens
ttccctgcccagtctcttaacatttaaacatgtcatttaccttaaaaacataagtgcaaaccaactgataaaaaacaaccttgccttcagtctgcatcctrtcccagagacactttctttgtgtcctcacacgtggagctaagcttctgacttgtctctggtacatccctgaggatcctctcatcttggccatcaggaacc

SEQ ID NO: 20506 - DNA, 201 bp, Homo sapiens
aggatttgtagaatgtaaggaagggaggaaaaattcaatctgataagtgttcattgatcttctaatgggttaaaagcattcagccacataacaacaacaayaccgataactaactgagtagttaatatggtcaggcgctattctgaggatttacatttattaactcactttattctcacacatagtctttgaggtaggtac

SEQ ID NO: 20507 - DNA, 201 bp, Homo sapiens
tatgtggatctggacaagaaggagaccgtctggcatctggaggagtttggccaagccttttcctttgaggctcagggcgggctggctaacattgctatatygaacaacaacttgaataccttgatccagcgttccaaccacactcaggccaccaacggtacgccctatctttgcctcttcctctgtagcccaactggaagg

SEQ ID NO: 20508 - DNA, 201 bp, Homo sapiens
tcagactgtgcctctgggaaggacagacccaggtttagtgtcacctccaccagctgcatccctactcatgtcctgtctgagattctggagcctgatgcagmatatcgggatgaggacagtgcagcggaaaaagcttgctaagaggaaattcagaaagagccaccctcatatctggaacaggggtgtgacctcaacaaggtg

SEQ ID NO: 20509 - DNA, 201 bp, Homo sapiens
gtgtcattgctaaggcaagatcccaggtcttgactcagatatcctgacctgcctcttctcctggtgccttgggccccagaccctaaaattccaggcccagrgccccccagctccttgagtccagattcctcctcctctgccatccatccgcccctgcctgttcaattgccccactctgagtgtggattctcccattttcat

SEQ ID NO: 20510 - DNA, 201 bp, Homo sapiens
tccagtctccattacggatcaggttggtggacacgaccccagctgtttcctcctgtccattcaggaaccatcggacttgaatgctgcctgggtagaaatcygtcacgtggcagacaagcaggttgtggtgctgcaagggccccttcttggagggggaaacattcaccctaggctggactaggagcgtggaagaaaaataat

SEQ ID NO: 20511 - DNA, 201 bp, Homo sapiens
tgctcttcagaggtggggtctagagggtcatcagagactcactccactccacggtgacaggactatccaggctggtgtgctccacttggcaggtgtagacrtctccctgctggggggtcatttccagcatcaccaggatctggaaggtccagtctccattacggatcaggttggtggacacgaccccagctgtttcctcct

SEQ ID NO: 20512 - DNA, 201 bp, Homo sapiens
atgaagcatgtgggatggcctcacagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccggg

SEQ ID NO: 20513 - DNA, 201 bp, Homo sapiens
gagtcccctgctcttcagaggtggggtctagagggtcatcagagactcactccactccacggtgacaggactatccaggctggtgtgctccacttggcagrtgtagacatctccctgctggggggtcatttccagcatcaccaggatctggaaggtccagtctccattacggatcaggttggtggacacgaccccagctgt

SEQ ID NO: 20514 - DNA, 201 bp, Homo sapiens
gataagatgagtggaccccagagccagagagtcccctgctcttcagaggtggggtctagagggtcatcagagactcactccactccacggtgacaggactrtccaggctggtgtgctccacttggcaggtgtagacatctccctgctggggggtcatttccagcatcaccaggatctggaaggtccagtctccattacgga

SEQ ID NO: 20515 - DNA, 201 bp, Homo sapiens
cctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatctgaactccagctgccctacaaactccatctcagcttttcttctcacttca

SEQ ID NO: 20516 - DNA, 201 bp, Homo sapiens
accaaattccattgcccatcactcaatggacgctccgcaggagcctgagtacttgggacctcatgcatctggctgcattaagatcccagcctgggatccchctctcgctataggtcatgtttgttccccgattatctgatatcagtggcctctagagctttctgacatttcttttctgtcaaacccctcatcgtggaataa

SEQ ID NO: 20517 - DNA, 201 bp, Homo sapiens
ccattgcccatcactcaatggacgctccgcaggagcctgagtacttgggacctcatgcatctggctgcattaagatcccagcctgggatccctctctcgcyataggtcatgtttgttccccgattatctgatatcagtggcctctagagctttctgacatttcttttctgtcaaacccctcatcgtggaataagtgtgaat

SEQ ID NO: 20518 - DNA, 201 bp, Homo sapiens
gaacataatggaaaacatttgccgtcagaagaaggtgtaacttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgata

SEQ ID NO: 20519 - DNA, 201 bp, Homo sapiens
gctccgcaggagcctgagtacttgggacctcatgcatctggctgcattaagatcccagcctgggatccctctctcgctataggtcatgtttgttccccgaytatctgatatcagtggcctctagagctttctgacatttcttttctgtcaaacccctcatcgtggaataagtgtgaatatgccaggggaaggtaagtcccg

SEQ ID NO: 20520 - DNA, 201 bp, Homo sapiens
gaatgagctcaggggcactgagtgatcactagggaggggcgagcactgaggggaaggcagtcccttctgctggtggctggaggaggcggagacgtttcacktggggtcactgggagaaaaaacaggggcgggaggagctggggacgtggagggcggagctgctccccctacttaactccctgactgacatttccatcctga

SEQ ID NO: 20521 - DNA, 201 bp, Homo sapiens
ggaagccctcccttccttctttctcttttccatagctaagcgctctctcttctcgaccagtttcttgagaattcctcaacttgctcctgttgttttgcatktaggagatgtagaaatatatttcttaaaactttcttcaactttggtataagaaagactctgtagcctgaaagttaattttcaaacatggctgcagaaaga

SEQ ID NO: 20522 - DNA, 201 bp, Homo sapiens
cctcccttccttctttctcttttccatagctaagcgctctctcttctcgaccagtttcttgagaattcctcaacttgctcctgttgttttgcatgtaggaratgtagaaatatatttcttaaaactttcttcaactttggtataagaaagactctgtagcctgaaagttaattttcaaacatggctgcagaaagacttggt

SEQ ID NO: 20523 - DNA, 201 bp, Homo sapiens
ctttgaccacttgcatattcaaactgacattttgtcgtgtttttctctactgtctttatgcagcggaccatgtgtcaacttatgccgcgtttgtacagacscatagaccaacaggggagtttatgtttgaatttgatgaagatgagatgttctatgtggatctggacaagaaggagaccgtctggcatctggaggagtttg

SEQ ID NO: 20524 - DNA, 201 bp, Homo sapiens
tcaggaaccatcggacttgaatgctgcctgggtagaaatccgtcacgtggcagacaagcaggttgtggtgctgcaagggccccttcttggagggggaaacrttcaccctaggctggactaggagcgtggaagaaaaataatgaaatagaatttgagattgtccttctttccttccttccttccttccttccttccttcctt

SEQ ID NO: 20525 - DNA, 201 bp, Homo sapiens; identical to SEQ ID NO: 3273

SEQ ID NO: 20526 - DNA, 201 bp, Homo sapiens
tcagagcaacttcttggcagcagtatccaatttggaagttgaaggtctgtcctggagccagatgctaacgaaacacagcaaatgcttttcctaaggcacawtagtcttttcagtgagctcaggaaccctgtgggggtaaaagacaagttatcccaggttgccagcctccttcctgtaagtccaggagagaaaaattatggt

SEQ ID NO: 20527 - DNA, 201 bp, Homo sapiens
ttgttctttgctcctttctttttataactgctcatctgctctgtattatttcctttatggtgttgctccttcttcttccccatatgtccttcctttgaccycttaccttcttcctttttatattcataagtctttattcattctctagctttgaccacttgcatattcaaactgacattttgtcgtgtttttctctactgt

SEQ ID NO: 20528 - DNA, 201 bp, Homo sapiens
tgccttgggccccagaccctaaaattccaggcccagagccccccagctccttgagtccagattcctcctcctctgccatccatccgcccctgcctgttcarttgccccactctgagtgtggattctcccattttcatttgttagtctttgtttctcctcctcaatcaccagtaagagaacgtttttcattcaagaataaga

SEQ ID NO: 20529 - DNA, 201 bp, Homo sapiens; identical to SEQ ID NO: 3285

SEQ ID NO: 20530 - DNA, 201 bp, Homo sapiens; identical to SEQ ID NO: 3287

SEQ ID NO: 20531 - DNA, 201 bp, Homo sapiens
tatgaaaggtctgaaaatataaagcctgtgatgcacttaagatgacggaggaaagacagtgatactcattttaaccagtcagataagtcatgatgtttggsgagattatgcgttttctttgctctgaaggtgatctcaaatattctgctggcccatctacagggattatcatttccccaattctgccacacctcacacacc

SEQ ID NO: 20532 - DNA, 201 bp, Homo sapiens
aaacagtcatgttgggttttgattatttgtggtgctaagaagaagggaacatggttggaggcccagtgagagaaacagtgctttgaatcaaagagcagaaygatagaaactgacttcagagcaacttcttggcagcagtatccaatttggaagttgaaggtctgtcctggagccagatgctaacgaaacacagcaaatgct

SEQ ID NO: 20533 - DNA, 201 bp, Homo sapiens
atagatgcaaatactttttagtattcttggtagaaattcctaatgagctcagctgtctcttcagggcttccctgcccagtctcttaacatttaaacatgtmatttaccttaaaaacataagtgcaaaccaactgataaaaaacaaccttgccttcagtctgcatcctgtcccagagacactttctttgtgtcctcacacgt

SEQ ID NO: 20534 - DNA, 201 bp, Homo sapiens
caaaatgaacttctttattaactcctactgtctactaaaaccctcagagaaaagtgatgagagatgatttggtgcatatttttaaaggaaaacaaacagtyatgttgggttttgattatttgtggtgctaagaagaagggaacatggttggaggcccagtgagagaaacagtgctttgaatcaaagagcagaatgatagaa

SEQ ID NO: 20535 - DNA, 201 bp, Homo sapiens
accaaaatgaacttctttattaactcctactgtctactaaaaccctcagagaaaagtgatgagagatgatttggtgcatatttttaaaggaaaacaaacastcatgttgggttttgattatttgtggtgctaagaagaagggaacatggttggaggcccagtgagagaaacagtgctttgaatcaaagagcagaatgatag

SEQ ID NO: 20536 - DNA, 201 bp, Homo sapiens
ccaggaatgacaataactgtgtgtgttgctgcaggtgacaaaatatctgaacagaagaggacttaggagagatctgaactccagctgccctacaaactccrtctcagcttttcttctcacttcatgtgaaaactactccagtggctgactgaattgctgacccttcaagctctgtccttatccattacctcaaagcagtca

SEQ ID NO: 20537 - DNA, 201 bp, Homo sapiens
agttgtgaattacctacaatttcttccccatagagcttctgggaaccatgaaatcagggggaatacttgggtatctgttttaaggtcccagaacattccaygagaggcatcttgctcaatattctttgacaggagcaggtcagcctggagccacatcagtgacctccagggtgcgctggagttaaggcctgatacccaatg

SEQ ID NO: 20538 - DNA, 201 bp, Homo sapiens
gagacaagagaactaggaggatgtttcatcccataagccaagtgcacaggaatttcagggacagtttacaatgcaacatgctcaaaaggcatcaactatgrtaagtgttcactggcctggtagcaagtggttattaaaacccctttaaagagcatcttcacacccaatgcccaactcccacctccttccactttcaccatc

SEQ ID NO: 20539 - DNA, 201 bp, Homo sapiens
tttagaggcattgatgtaattttttttggcagtttttatggttttatttacacacaaaacgtggacatgaactttctactcattttcttagctgtgcaccstggtactggggttggtgactctgatggccggctgggtgactctttccatgatgactttgcagttctggaggaaattttgtgagcgatctcagcacagtaa

SEQ ID NO: 20540 - DNA, 201 bp, Homo sapiens
ttcattgagccttttatcctctgttctcctttgaagaacccctcactgtcaccttcccgagaataccctaagaccaataaatacttcagtatttcagagcrgggagactctgagtcattcttactggaagtctaggaccaggtcacatgtgaatactatttcttgaaggtgtggtttcaacctctgttgccgatgtggtta

SEQ ID NO: 20541 - DNA, 201 bp, Homo sapiens
ggaggttctgggagcagatgtgcaggagaaagactgtcagcctggcttcctgagtacgatgataagcagagcttcctggatgacttactttggacgtgtarcatgagccaaacctggatatctgggtatttgttagtttagcacagctgatcctattcttactgtgtaaaagaaattgaagagaaggtgctcaatgagact

SEQ ID NO: 20542 - DNA, 201 bp, Homo sapiens
cccttttatctccagtccttactcccatatctaacctcttacccctacctcataggtaaacattttaatgaatttgatgtttccttttatttgcatagatsctctgtaatatgtagtagtgtccagtgtacatgtatttttaattaaccaaaatggcattaaattatagatctaattttgtacatccagtttgtttcttcc

SEQ ID NO: 20543 - DNA, 201 bp, Homo sapiens
gcactcagcaaagggcctgactcttagaaaacactctatcaatattgaaaatttgaagtctagtgacaaggtggtcccagtttggatggtctctcagctcytgtctcctctgggacctgtctctgcactgcatccttccttagaaatcccagagtttcataaacacctgcatatgtcagagtgagacacatctgatacctt

SEQ ID NO: 20544 - DNA, 201 bp, Homo sapiens
tttatctccagtccttactcccatatctaacctcttacccctacctcataggtaaacattttaatgaatttgatgtttccttttatttgcatagatcctcygtaatatgtagtagtgtccagtgtacatgtatttttaattaaccaaaatggcattaaattatagatctaattttgtacatccagtttgtttcttccaaat

SEQ ID NO: 20545 - DNA, 201 bp, Homo sapiens
ggagtccactaatgtgttaaccacattatatattttctgacactgaagaatcattgcattcctagaataaatctaaaattggtcaaaacgtattgtttttrtaatgtactgttggattcagtgacatggctaaaattagtccacaatcctgttctcctgtactattcttagctggctctggaaatataaatgaaccaacct

SEQ ID NO: 20546 - DNA, 201 bp, Homo sapiens
ttatctccagtccttactcccatatctaacctcttacccctacctcataggtaaacattttaatgaatttgatgtttccttttatttgcatagatcctctstaatatgtagtagtgtccagtgtacatgtatttttaattaaccaaaatggcattaaattatagatctaattttgtacatccagtttgtttcttccaaatc

SEQ ID NO: 20547 - DNA, 201 bp, Homo sapiens
gatgggtccgggcttacagtactgaacccaggaatgacaataactgtgtgtgttgctgcaggtgacaaaatatctgaacagaagaggacttaggagagatytgaactccagctgccctacaaactccatctcagcttttcttctcacttcatgtgaaaactactccagtggctgactgaattgctgacccttcaagctctg

SEQ ID NO: 20548 - DNA, 201 bp, Homo sapiens
ggaatgacaataactgtgtgtgttgctgcaggtgacaaaatatctgaacagaagaggacttaggagagatctgaactccagctgccctacaaactccatcwcagcttttcttctcacttcatgtgaaaactactccagtggctgactgaattgctgacccttcaagctctgtccttatccattacctcaaagcagtcattc

SEQ ID NO: 20549 - DNA, 201 bp, Homo sapiens
tggccatgggctgatcccactacagcaagggcttgcatcctctcttctcaggagagagaaaggtgagcagagtgaggctggtcagtggtgtgatacccctstctgtgattcagagctgccataaaatctaaggctgaggtagaggaccaccctcccctaagaggtggagcctttgtgattcatcccagaagaggggcctaa

SEQ ID NO: 20550 - DNA, 201 bp, Homo sapiens
gatcccactacagcaagggcttgcatcctctcttctcaggagagagaaaggtgagcagagtgaggctggtcagtggtgtgatacccctctctgtgattcasagctgccataaaatctaaggctgaggtagaggaccaccctcccctaagaggtggagcctttgtgattcatcccagaagaggggcctaacctggtgctgtc

SEQ ID NO: 20551 - DNA, 201 bp, Homo sapiens
tgtccttcctttgacctcttaccttcttcctttttatattcataagtctttattcattctctagctttgaccacttgcatattcaaactgacattttgtcrtgtttttctctactgtctttatgcagcggaccatgtgtcaacttatgccgcgtttgtacagacgcatagaccaacaggggagtttatgtttgaatttgat

SEQ ID NO: 20552 - DNA, 201 bp, Homo sapiens
ctttatggtgttgctccttcttcttccccatatgtccttcctttgacctcttaccttcttcctttttatattcataagtctttattcattctctagctttsaccacttgcatattcaaactgacattttgtcgtgtttttctctactgtctttatgcagcggaccatgtgtcaacttatgccgcgtttgtacagacgcata

SEQ ID NO: 20553 - DNA, 201 bp, Homo sapiens
ccaatctttatcaaagctcaatatttgtgcttgattcagtggcttcttgcttttgcttcaaattcccaaattctcctttacttctctatttaagccctttytattgtgaactaggggacatttggaagaaacacacaaaccaatagaatgtacgttgaatggttatcaccgcaagcacccatgtaactagtacccgggtga

SEQ ID NO: 20554 - DNA, 201 bp, Homo sapiens; identical to SEQ ID NO: 3250

SEQ ID NO: 20555 - DNA, 201 bp, Homo sapiens; identical to SEQ ID NO: 3251

SEQ ID NO: 20556 - DNA, 201 bp, Homo sapiens
ccacctttagtctccagtgtcattgctaaggcaagatcccaggtcttgactcagatatcctgacctgcctcttctcctggtgccttgggccccagaccctraaattccaggcccagagccccccagctccttgagtccagattcctcctcctctgccatccatccgcccctgcctgttcaattgccccactctgagtgtgg

SEQ ID NO: 20557 - DNA, 201 bp, Homo sapiens
gttggggatgtgtgtggagttgggggagcatgcagggaattgtggaatcagccctgcccactttacccactcccctatggctccagctctccctccagcargttttgattgaacattcattctacgcagggagctccagtaatctaccctcagtccctgtcacatggctccactgcctcatctcattccccctacaaacct

SEQ ID NO: 20558 - DNA, 201 bp, Homo sapiens
agctccaaggccttcctgtcccatccttgagaaatcctcttactgcacacacctcacctctctccatccctttacacccagacttcctgaaggaaaaagaygaatgaactgagacactgccctgtgacagccgtggggaacccaagacaagtaaaatccatctcagccccgaggaggatgcgccacactcagcctcatgca

SEQ ID NO: 20559 - DNA, 201 bp, Homo sapiens; identical to SEQ ID NO: 3253

SEQ ID NO: 20560 - DNA, 201 bp, Homo sapiens
taaagaggaggccctaggatttgtagaatgtaaggaagggaggaaaaattcaatctgataagtgttcattgatcttctaatgggttaaaagcattcagccrcataacaacaacaacaccgataactaactgagtagttaatatggtcaggcgctattctgaggatttacatttattaactcactttattctcacacatagt

SEQ ID NO: 20561 - DNA, 201 bp, Homo sapiens; identical to SEQ ID NO: 3255

SEQ ID NO: 20562 - DNA, 201 bp, Homo sapiens
tccaatccagaaagtctggatccaagactgtttatccactgtcctattcaccctattttgtgaaggaaaagaccaagttcaaattctccagagtccattgycaaataatggagtcagatctatatttctatacataattacaacacagtgtggtgggtgcctgtaactacttactgtctctacttggactcattccatggc

SEQ ID NO: 20563 - DNA, 201 bp, Homo sapiens
gcattctgtgtagcatcctacgtattcacccattctccatcttctccttcatgcagcagaccatgtgtcaacatatgcggagtttgtgcagacgcacagamcctctggggagtatatgtttgaatttgatgaggaggagcagttctacgtgaacctggatgagaaggagatggtctggcctctaccagagtttattcacac

SEQ ID NO: 20564 - DNA, 201 bp, Homo sapiens
cttcagacagttttatttaagatgtgtagaataaagaggaggtcaggctgggtagaaccagaagtatctattgccctgttcgcggtcacctgagttatttytaatgttatgttataataaacaccacaataggcttctcttcatagatgcaaatactttttagtattcttggtagaaattcctaatgagctcagctgtctc

SEQ ID NO: 20565 - DNA, 201 bp, Homo sapiens
caagggcaccatggagtccacctttagtctccagtgtcattgctaaggcaagatcccaggtcttgactcagatatcctgacctgcctcttctcctggtgcsttgggccccagaccctaaaattccaggcccagagccccccagctccttgagtccagattcctcctcctctgccatccatccgcccctgcctgttcaattg

SEQ ID NO: 20566 - DNA, 201 bp, Homo sapiens
ttggggatgtgtgtggagttgggggagcatgcagggaattgtggaatcagccctgcccactttacccactcccctatggctccagctctccctccagcagrttttgattgaacattcattctacgcagggagctccagtaatctaccctcagtccctgtcacatggctccactgcctcatctcattccccctacaaacctc

SEQ ID NO: 20567 - DNA, 201 bp, Homo sapiens
cattctacgcagggagctccagtaatctaccctcagtccctgtcacatggctccactgcctcatctcattccccctacaaacctcaacccagcctttgccygtcctccctttcactgcccagcatcacatgcccccttctgctctctgctcccccacctctgggtttccttggtggctcccaacactgtccctcatcccac

SEQ ID NO: 20568 - DNA, 201 bp, Homo sapiens
catgcccccttctgctctctgctcccccacctctgggtttccttggtggctcccaacactgtccctcatcccacatgacagctctgcctatgggatggggrcgctgcatccgtcacttcctcctgacactgttcagtgtcaccagtgctgctccagcctcctctctccccagcctcacccctctgcagttcccagggctga

SEQ ID NO: 20569 - DNA, 201 bp, Homo sapiens
agcagtcattccttagtaaagtttccaacaaatagaaattaatgacactttggtagcactaatatggagattatcctttcattgagccttttatcctctgktctcctttgaagaacccctcactgtcaccttcccgagaataccctaagaccaataaatacttcagtatttcagagcggggagactctgagtcattcttac

SEQ ID NO: 20570 - DNA, 201 bp, Homo sapiens
cagtcattccttagtaaagtttccaacaaatagaaattaatgacactttggtagcactaatatggagattatcctttcattgagccttttatcctctgttytcctttgaagaacccctcactgtcaccttcccgagaataccctaagaccaataaatacttcagtatttcagagcggggagactctgagtcattcttactg

SEQ ID NO: 20571 - DNA, 201 bp, Homo sapiens
atgcccccttctgctctctgctcccccacctctgggtttccttggtggctcccaacactgtccctcatcccacatgacagctctgcctatgggatgggggygctgcatccgtcacttcctcctgacactgttcagtgtcaccagtgctgctccagcctcctctctccccagcctcacccctctgcagttcccagggctgag

SEQ ID NO: 20572 - DNA, 201 bp, Homo sapiens
gtcattccttagtaaagtttccaacaaatagaaattaatgacactttggtagcactaatatggagattatcctttcattgagccttttatcctctgttctyctttgaagaacccctcactgtcaccttcccgagaataccctaagaccaataaatacttcagtatttcagagcggggagactctgagtcattcttactgga

SEQ ID NO: 20573 - DNA, 201 bp, Homo sapiens
ttagtaaagtttccaacaaatagaaattaatgacactttggtagcactaatatggagattatcctttcattgagccttttatcctctgttctcctttgaaraacccctcactgtcaccttcccgagaataccctaagaccaataaatacttcagtatttcagagcggggagactctgagtcattcttactggaagtctagg

SEQ ID NO: 20574 - DNA, 201 bp, Homo sapiens
cccccttctgctctctgctcccccacctctgggtttccttggtggctcccaacactgtccctcatcccacatgacagctctgcctatgggatgggggcgcygcatccgtcacttcctcctgacactgttcagtgtcaccagtgctgctccagcctcctctctccccagcctcacccctctgcagttcccagggctgagccg

SEQ ID NO: 20575 - DNA, 201 bp, Homo sapiens
ctctgctcccccacctctgggtttccttggtggctcccaacactgtccctcatcccacatgacagctctgcctatgggatgggggcgctgcatccgtcacytcctcctgacactgttcagtgtcaccagtgctgctccagcctcctctctccccagcctcacccctctgcagttcccagggctgagccgtcctgctggtta

SEQ ID NO: 20576 - DNA, 201 bp, Homo sapiens
agaggcattcttcgtgagcactgaatcctcagtgatcctcagagcctggacactccagcttagggctctctgcctgagtcccctccaggctggatgcagayatgaacacgcccaggagcctgcacttgccaacttctctctctgcaaaccttgtctgtccaaggttatccaggacctcttggtcccattttccccaaagac

SEQ ID NO: 20577 - DNA, 201 bp, Homo sapiens
ccttcctgtcccatccttgagaaatcctcttactgcacacacctcacctctctccatccctttacacccagacttcctgaaggaaaaagacgaatgaactsagacactgccctgtgacagccgtggggaacccaagacaagtaaaatccatctcagccccgaggaggatgcgccacactcagcctcatgcaccccctccca

SEQ ID NO: 20578 - DNA, 201 bp, Homo sapiens
gatgagtggaccccagagccagagagtcccctgctcttcagaggtggggtctagagggtcatcagagactcactccactccacggtgacaggactatccakgctggtgtgctccacttggcaggtgtagacatctccctgctggggggtcatttccagcatcaccaggatctggaaggtccagtctccattacggatcagg

SEQ ID NO: 20579 - DNA, 201 bp, Homo sapiens
gaggcattcttcgtgagcactgaatcctcagtgatcctcagagcctggacactccagcttagggctctctgcctgagtcccctccaggctggatgcagacrtgaacacgcccaggagcctgcacttgccaacttctctctctgcaaaccttgtctgtccaaggttatccaggacctcttggtcccattttccccaaagaca

SEQ ID NO: 20580 - DNA, 201 bp, Homo sapiens
gagcctggacactccagcttagggctctctgcctgagtcccctccaggctggatgcagacatgaacacgcccaggagcctgcacttgccaacttctctctstgcaaaccttgtctgtccaaggttatccaggacctcttggtcccattttccccaaagacaagcactgaccactgggcacctctctctgtttactgtaccc

SEQ ID NO: 20581 - DNA, 201 bp, Homo sapiens
cacagattttaggggctcattgatctatctggtcctcatagtctatgttccctctggccctcataataataacagcaataacagccagaatttatgagackcctgcatagtttctttccccatttacatctcacaggaatcttcaatgaagataatattccattcatttagaaattattccttttatttagaaattatttt

SEQ ID NO: 20582 - DNA, 201 bp, Homo sapiens
accccagctgtttcctcctgtccattcaggaaccatcggacttgaatgctgcctgggtagaaatccgtcacgtggcagacaagcaggttgtggtgctgcargggccccttcttggagggggaaacattcaccctaggctggactaggagcgtggaagaaaaataatgaaatagaatttgagattgtccttctttccttcct

SEQ ID NO: 20583 - DNA, 201 bp, Homo sapiens
gggtcatttccagcatcaccaggatctggaaggtccagtctccattacggatcaggttggtggacacgaccccagctgtttcctcctgtccattcaggaascatcggacttgaatgctgcctgggtagaaatccgtcacgtggcagacaagcaggttgtggtgctgcaagggccccttcttggagggggaaacattcaccc

SEQ ID NO: 20584 - DNA, 201 bp, Homo sapiens
cttagggcaggagcccccgcagcctgtctcagaatttgatcccttaaagataacgtcccctaggaattgttccctgagccagaccctccaagaatggcagytcggctcttacctggagtggccctgccctggaccacagatgtgagcagcaccatcagtaacgccgtcagagccactgtccggggggccgcagaaacctgc

SEQ ID NO: 20585 - DNA, 201 bp, Homo sapiens
agatggggtttggacatggccccagggtatagatgcagaagataagatgagtggaccccagagccagagagtcccctgctcttcagaggtggggtctagabggtcatcagagactcactccactccacggtgacaggactatccaggctggtgtgctccacttggcaggtgtagacatctccctgctggggggtcatttcc

SEQ ID NO: 20586 - DNA, 201 bp, Homo sapiens
tccagtaatctaccctcagtccctgtcacatggctccactgcctcatctcattccccctacaaacctcaacccagcctttgcctgtcctccctttcactgyccagcatcacatgcccccttctgctctctgctcccccacctctgggtttccttggtggctcccaacactgtccctcatcccacatgacagctctgcctat

SEQ ID NO: 20587 - DNA, 201 bp, Homo sapiens
tcagtccctgtcacatggctccactgcctcatctcattccccctacaaacctcaacccagcctttgcctgtcctccctttcactgcccagcatcacatgcycccttctgctctctgctcccccacctctgggtttccttggtggctcccaacactgtccctcatcccacatgacagctctgcctatgggatgggggcgctg

SEQ ID NO: 20588 - DNA, 201 bp, Homo sapiens
gctaccctgaaagatgaggaggtgacatgatgtcagtaccttctaggtgtgtcctaggaggggtgtggagaggtctaggaggaagggtgtaagcaggaaargtggaagtcagtggaaaactaaggtacctactttgcagtccttcctctcagagtgttggtgtaaatttggactagaaatgtcctgagagtacaatggttg

SEQ ID NO: 20589 - DNA, 201 bp, Homo sapiens
acttgggtttttttggtctctttcacaggcttttctgtcttggccaaatcacaactgtccagttcccaggatccggtcctttgctcttccccctgggtccyctctccctggatggtctcatgtatctcagtctcctccccggctgcagacccttctgtctacctgcccatcagaccacccatctgcccctcaagcacctca

SEQ ID NO: 20590 - DNA, 201 bp, Homo sapiens
ggtcatgggcccgcccagctcgtagttgtgtctgcacatcctgtccggcactgcccgcttctcctccaggatgtccttctggctgttccagtactccgcakcaggccgccccagctccgtcaccgcccggaactcccccacgtcgctgtcgaagcgcgcgaactcctcccggttgtagatgtatctctccaggaagcgctg

SEQ ID NO: 20591 - DNA, 201 bp, Homo sapiens
ttcctcagcctcccgaatagctgggattataggtgcctgccacttcacctggctaatttttgtattattagtagagacaaggtttctccatgttggtcagsctggttctctaggagcacttgaccaacgcctgacctcaagtgatccacccgctcggcctctcaaagggctgggattacgggcctgagccactgcatctgc

SEQ ID NO: 20592 - DNA, 201 bp, Homo sapiens
agtaaagtttccaacaaatagaaattaatgacactttggtagcactaatatggagattatcctttcattgagccttttatcctctgttctcctttgaagarcccctcactgtcaccttcccgagaataccctaagaccaataaatacttcagtatttcagagcggggagactctgagtcattcttactggaagtctaggac

SEQ ID NO: 20593 - DNA, 201 bp, Homo sapiens
gaaattaatgacactttggtagcactaatatggagattatcctttcattgagccttttatcctctgttctcctttgaagaacccctcactgtcaccttccygagaataccctaagaccaataaatacttcagtatttcagagcggggagactctgagtcattcttactggaagtctaggaccaggtcacatgtgaatacta

SEQ ID NO: 20594 - DNA, 201 bp, Homo sapiens
gacactttggtagcactaatatggagattatcctttcattgagccttttatcctctgttctcctttgaagaacccctcactgtcaccttcccgagaatacyctaagaccaataaatacttcagtatttcagagcggggagactctgagtcattcttactggaagtctaggaccaggtcacatgtgaatactatttcttgaa

SEQ ID NO: 20595 - DNA, 201 bp, Homo sapiens
tggtagaaattcctaatgagctcagctgtctcttcagggcttccctgcccagtctcttaacatttaaacatgtcatttaccttaaaaacataagtgcaaaycaactgataaaaaacaaccttgccttcagtctgcatcctgtcccagagacactttctttgtgtcctcacacgtggagctaagcttctgacttgtctctgg

SEQ ID NO: 20596 - DNA, 201 bp, Homo sapiens
gggctcttcctgggtctttgtgggtggtcacaagctttcctctctcaagacagcagggttgcatggtcttgatagccttgtgattcgggttctgagagatycaggactgcaagggaggcctagacttttgatagctgcaaggactcagccagagatggaccgtagtgaatgctcctttttcctgtagctgaaatcagggag

SEQ ID NO: 20597 - DNA, 201 bp, Homo sapiens
gctgggaagagaggacactgccttagggcaggagcccccgcagcctgtctcagaatttgatcccttaaagataacgtcccctaggaattgttccctgagcyagaccctccaagaatggcagttcggctcttacctggagtggccctgccctggaccacagatgtgagcagcaccatcagtaacgccgtcagagccactgtc

SEQ ID NO: 20598 - DNA, 201 bp, Homo sapiens
caggatctggaaggtccagtctccattacggatcaggttggtggacacgaccccagctgtttcctcctgtccattcaggaaccatcggacttgaatgctgyctgggtagaaatccgtcacgtggcagacaagcaggttgtggtgctgcaagggccccttcttggagggggaaacattcaccctaggctggactaggagcgt

SEQ ID NO: 20599 - DNA, 201 bp, Homo sapiens
attacggatcaggttggtggacacgaccccagctgtttcctcctgtccattcaggaaccatcggacttgaatgctgcctgggtagaaatccgtcacgtggyagacaagcaggttgtggtgctgcaagggccccttcttggagggggaaacattcaccctaggctggactaggagcgtggaagaaaaataatgaaatagaat

SEQ ID NO: 20600 - DNA, 201 bp, Homo sapiens
agctgtttcctcctgtccattcaggaaccatcggacttgaatgctgcctgggtagaaatccgtcacgtggcagacaagcaggttgtggtgctgcaagggcyccttcttggagggggaaacattcaccctaggctggactaggagcgtggaagaaaaataatgaaatagaatttgagattgtccttctttccttccttcctt

SEQ ID NO: 20601 - DNA, 201 bp, Homo sapiens
ccatcccctggctcggcctcactgctacttgacaaatggggacaaagagagggtgagatgatttcttcttagggtaccccttgataaccatctgaggcagygttgtctgttgggtggaccaccttctcgttagggaactgtgaggggtagaaaatgaagggaccaggtggaaagggatggaggatacaacactcagctggg

SEQ ID NO: 20602 - DNA, 201 bp, Homo sapiens
tattcattctctagctttgaccacttgcatattcaaactgacattttgtcgtgtttttctctactgtctttatgcagcggaccatgtgtcaacttatgccrcgtttgtacagacgcatagaccaacaggggagtttatgtttgaatttgatgaagatgagatgttctatgtggatctggacaagaaggagaccgtctggca

SEQ ID NO: 20603 - DNA, 201 bp, Homo sapiens
tctcatctaatcctctttctccctctctctctcaatattaacgattcttcccaaatcttcccacccagggctggattttaaaataggagttttcctagtaycgagttctgtggtcctaagcgggtcgcagagcctctccaggcctgttttctcaccacgcagagagagaatttactgaaaagaatgagctcaggggcactg

SEQ ID NO: 20604 - DNA, 201 bp, Homo sapiens
tgataggtgaatcccagccatgctgattcctctccacccatttccagtgctagaggcccacagtttcagtctcatctgcctccactcggcctcagttcctyatcactgttcctgtgctcacagtcatcaattatagaccccacaacatgcgccctgaagacagaatgttccatatcagagctgtgatcttgagagccctct

SEQ ID NO: 20605 - DNA, 201 bp, Homo sapiens
ttcccacccagggctggattttaaaataggagttttcctagtaccgagttctgtggtcctaagcgggtcgcagagcctctccaggcctgttttctcaccaygcagagagagaatttactgaaaagaatgagctcaggggcactgagtgatcactagggaggggcgagcactgaggggaaggcagtcccttctgctggtggc

SEQ ID NO: 20606 - DNA, 201 bp, Homo sapiens; identical to SEQ ID NO: 3325

SEQ ID NO: 20607 - DNA, 201 bp, Homo sapiens
aatctgtgagttgggaggtgagagcagaagagtcccgtagttccttctcactctgatgcatttatcattctaaacccagactttcacatacacattcatcrttttctttcatgataatagttgcttttatcctcttatctttgctaattcttacaaactaataaagactaagaaacaaaataaattaaatcctacaggtgt

SEQ ID NO: 20608 - DNA, 201 bp, Homo sapiens
aagaaacaaaataaattaaatcctacaggtgttccaaactcagcaataatttctagttggcctctaaaacaaaaatcaaaatataaatgtaagaaaagttyagaatgcttagtacctgtgtgatgaaataatctgtacactaaacccccaagtcatgagtttacctatacaacaaacctgcacatgtactcctgaacataa

SEQ ID NO: 20609 - DNA, 201 bp, Homo sapiens
gaaacaaaagtttggaacaaatgccaaaataactgtactgtacttttgaatttatatgccccaaatgaaaaatattatcaacaaagctatacattctacaktttcatgttcataaactaagacagaaactttaaaactgtcaagagccctaaaatttgaaggatattttcttcttcctctcaattttgtatttttttctac

SEQ ID NO: 20610 - DNA, 201 bp, Homo sapiens
tatttctatacataattacaacacagtgtggtgggtgcctgtaactacttactgtctctacttggactcattccatggcaatgttcacacaaaaaatgccyctccagagatcttacaggtttctatttatcataacactcaccatgctttatatttttatatgttttgggaattctcttagcattagacagtgaacttcca

SEQ ID NO: 20611 - DNA, 201 bp, Homo sapiens
aacactggacattatccagttttctaacttttgccaatttcatgtgcataaagaaatatgctgttttattttgcatttctttaattactaataattggggytataattaggactgattagccacttgggggttccttttctataaattgcctgttcacattcattgtccatttttgtactatgtgcttccatcattttctt

SEQ ID NO: 20612 - DNA, 201 bp, Homo sapiens
actattcacaatagcaaagacttggaaccaacccaactgtccatcagtgatagactggattaagaaaatgcacacatatacaccatggaatactgtgcagycataaaaaaggatgagttcatgtcctttgtagggacatggaggaagctggaaatcatcattcacagcaaactattgcaaggacaaaaaaccaaagaccac

SEQ ID NO: 20613 - DNA, 201 bp, Homo sapiens
cagaacattccacgagaggcatcttgctcaatattctttgacaggagcaggtcagcctggagccacatcagtgacctccagggtgcgctggagttaaggcytgatacccaatggcctcatttctgacccagttcaaatacatttcaccaaggcaaggattcctgtttgttctagttgccttctctaatgcccagaaaacat

SEQ ID NO: 20614 - DNA, 201 bp, Homo sapiens
aggagggatcattaaaagccagtgaataaattcttaggttcccttcattctgctggggaggttctgggagcagatgtgcaggagaaagactgtcagcctgrcttcctgagtacgatgataagcagagcttcctggatgacttactttggacgtgtagcatgagccaaacctggatatctgggtatttgttagtttagcaca

SEQ ID NO: 20615 - DNA, 201 bp, Homo sapiens
cattcctagaataaatctaaaattggtcaaaacgtattgtttttataatgtactgttggattcagtgacatggctaaaattagtccacaatcctgttctcytgtactattcttagctggctctggaaatataaatgaaccaacctcataaaatgatctcaaaaattctgttccattctatgttctagaatcacacgtgtaa

SEQ ID NO: 20616 - DNA, 201 bp, Homo sapiens
cagagactcactccactccacggtgacaggactatccaggctggtgtgctccacttggcaggtgtagacatctccctgctggggggtcatttccagcatcwccaggatctggaaggtccagtctccattacggatcaggttggtggacacgaccccagctgtttcctcctgtccattcaggaaccatcggacttgaatgct

SEQ ID NO: 20617 - DNA, 201 bp, Homo sapiens
agaaagtctggatccaagactgtttatccactgtcctattcaccctattttgtgaaggaaaagaccaagttcaaattctccagagtccattgccaaataayggagtcagatctatatttctatacataattacaacacagtgtggtgggtgcctgtaactacttactgtctctacttggactcattccatggcaatgttca

SEQ ID NO: 20618 - DNA, 201 bp, Homo sapiens
gcattcctgccgtccctggaaaaggtaattctctgcggggagggggcggacatgagcggaggcgccactctcatctaatcctctttctccctctctctctyaatattaacgattcttcccaaatcttcccacccagggctggattttaaaataggagttttcctagtaccgagttctgtggtcctaagcgggtcgcagagc

SEQ ID NO: 20619 - DNA, 201 bp, Homo sapiens
attcattctctagctttgaccacttgcatattcaaactgacattttgtcgtgtttttctctactgtctttatgcagcggaccatgtgtcaacttatgccgygtttgtacagacgcatagaccaacaggggagtttatgtttgaatttgatgaagatgagatgttctatgtggatctggacaagaaggagaccgtctggcat

SEQ ID NO: 20620 - DNA, 201 bp, Homo sapiens
aggatgtccttctggctgttccagtactccgcagcaggccgccccagctccgtcaccgcccggaactcccccacgtcgctgtcgaagcgcgcgaactcctsccggttgtagatgtatctctccaggaagcgctgtgtcccattaaacgcgtagcattcctgccgtccctggaaaaggtaattctctgcggggagggggcgg

SEQ ID NO: 20621 - DNA, 201 bp, Homo sapiens
ctttgcttcccatgacaatttctttgatattctctactctattttagttttctatttcttcctgtagttttgacctttatatctttctagaaacgtatcckttttatctaaattttcaaatttatatgtatagagttggtcgtaagattttgcattttaaaatgtgtataaatgtcatttacccttttcgttctgaatctc

SEQ ID NO: 20622 - DNA, 201 bp, Homo sapiens
gtgctgtttggtcgcatcttgtgtatacctacgtatctgcacttatccttctgaacctgctgttgtcctgtcacttgtgtttccttctgtgacttatacgygtctgcagaacaggacgtatgtattatttttatttgggtatttagcatctaacagtgtttgacatatagtagtcttttaatacatatttttgtctgaatg

SEQ ID NO: 20623 - DNA, 201 bp, Homo sapiens
attgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgc

SEQ ID NO: 20624 - DNA, 201 bp, Homo sapiens
ctcttaccttcttcctttttatattcataagtctttattcattctctagctttgaccacttgcatattcaaactgacattttgtcgtgtttttctctactktctttatgcagcggaccatgtgtcaacttatgccgcgtttgtacagacgcatagaccaacaggggagtttatgtttgaatttgatgaagatgagatgttc

SEQ ID NO: 20625 - DNA, 201 bp, Homo sapiens
gagatggtctggcctctaccagagtttattcacacctttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcac

SEQ ID NO: 20626 - DNA, 201 bp, Homo sapiens
ggaatacttgggtatctgttttaaggtcccagaacattccacgagaggcatcttgctcaatattctttgacaggagcaggtcagcctggagccacatcagygacctccagggtgcgctggagttaaggcctgatacccaatggcctcatttctgacccagttcaaatacatttcaccaaggcaaggattcctgtttgttct

SEQ ID NO: 20627 - DNA, 201 bp, Homo sapiens
tgtgatctccccagcttcctcctcctcctcccttcatttttttcctctttctagaaaaaaggtccagggctcaatcccacatcctgatactactccctcargtccctcaggttggtgcaccaggctccccaccccacaagttcacaggaggaagccaaagctccaaggccttcctgtcccatccttgagaaatcctcttac

SEQ ID NO: 20628 - DNA, 201 bp, Homo sapiens
ctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatg

SEQ ID NO: 20629 - DNA, 201 bp, Homo sapiens
ctgaagacagaatgttccatatcagagctgtgatcttgagagccctctccttggctttcctgctgagtctccgaggagctggggccatcaagggtgagtgstcaggaggacgcaggagcgtcggggtgagtgatggggtggttcacatcaattgctgcttcagggatcacagattttaggggctcattgatctatctggtc

SEQ ID NO: 20630 - DNA, 201 bp, Homo sapiens
cttcttcttccccatatgtccttcctttgacctcttaccttcttcctttttatattcataagtctttattcattctctagctttgaccacttgcatattcraactgacattttgtcgtgtttttctctactgtctttatgcagcggaccatgtgtcaacttatgccgcgtttgtacagacgcatagaccaacaggggagtt

SEQ ID NO: 20631 - DNA, 201 bp, Homo sapiens
tcttggcagcagtatccaatttggaagttgaaggtctgtcctggagccagatgctaacgaaacacagcaaatgcttttcctaaggcacaatagtcttttcrgtgagctcaggaaccctgtgggggtaaaagacaagttatcccaggttgccagcctccttcctgtaagtccaggagagaaaaattatggtgagaggatgcg

SEQ ID NO: 20632 - DNA, 201 bp, Homo sapiens
aacgtattgtttttataatgtactgttggattcagtgacatggctaaaattagtccacaatcctgttctcctgtactattcttagctggctctggaaatayaaatgaaccaacctcataaaatgatctcaaaaattctgttccattctatgttctagaatcacacgtgtaagaggcatgatctgctcctggaaatgtggga

SEQ ID NO: 20633 - DNA, 201 bp, Homo sapiens
tcctccaggatgtccttctggctgttccagtactccgcagcaggccgccccagctccgtcaccgcccggaactcccccacgtcgctgtcgaagcgcgcgarctcctcccggttgtagatgtatctctccaggaagcgctgtgtcccattaaacgcgtagcattcctgccgtccctggaaaaggtaattctctgcggggagg

SEQ ID NO: 20634 - DNA, 201 bp, Homo sapiens
caaaaaatgcccctccagagatcttacaggtttctatttatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattata

SEQ ID NO: 20635 - DNA, 201 bp, Homo sapiens
ttgtgaaggaaaagaccaagttcaaattctccagagtccattgccaaataatggagtcagatctatatttctatacataattacaacacagtgtggtgggwgcctgtaactacttactgtctctacttggactcattccatggcaatgttcacacaaaaaatgcccctccagagatcttacaggtttctatttatcataac

SEQ ID NO: 20636 - DNA, 201 bp, Homo sapiens
cctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgt

SEQ ID NO: 20637 - DNA, 201 bp, Homo sapiens
tctgcactgcatccttccttagaaatcccagagtttcataaacacctgcatatgtcagagtgagacacatctgataccttctttctgtgactccagggacwttcctcatctcctgacaccctcagttccctaggagcacatatcctgttcctgtaatgtgggtgcagatacctcagcttctgatcctgacaagtgttagtc

SEQ ID NO: 20638 - DNA, 201 bp, Homo sapiens
aaggttacacagcagatcaacgagccaagtttgaagtccagacccagctctgagggtcatacactgccttccccagattcctgcacacagtgacctactaycagggccctcctatctctctgggatccccagcctctatcttttgtggctgctttacaggaactccgagctatggactctgcattaggagacgaagtgcaa

SEQ ID NO: 20639 - DNA, 201 bp, Homo sapiens
tgtgttctttctaggagggatcattaaaagccagtgaataaattcttaggttcccttcattctgctggggaggttctgggagcagatgtgcaggagaaagmctgtcagcctggcttcctgagtacgatgataagcagagcttcctggatgacttactttggacgtgtagcatgagccaaacctggatatctgggtatttgt

SEQ ID NO: 20640 - DNA, 201 bp, Homo sapiens
taaatgtcatttacccttttcgttctgaatctcctgtattttccttaggagtcttgccagaggtctcattaaagttttcattgcctcaaaatttgattttrtcttctctatttttatatttcattgaattcagcttttgtccttattatttacatgtattttctttttgctgtttttctgcttttccatcctcttaattca

SEQ ID NO: 20641 - DNA, 201 bp, Homo sapiens
tgtattttctttttgctgtttttctgcttttccatcctcttaattcacataattagctcatttgtttacagtcattttactctaacaaaattgtttaacartctgacattctatgcagcattttgaatgaacttatttcatctttctataaagactaaacatctattatgttttcagttatttcctcttcctccactattt

SEQ ID NO: 20642 - DNA, 201 bp, Homo sapiens
cattttctattgtttactcgatcatattgtccttgggacagtttctcagtttggctttttgtttattaattacacttcagttgcaaaagtcctatttcttrtctcatttattatgtttcttattccaatctttatcaaagctcaatatttgtgcttgattcagtggcttcttgcttttgcttcaaattcccaaattctcct

SEQ ID NO: 20643 - DNA, 201 bp, Homo sapiens
cttcttccccatatgtccttcctttgacctcttaccttcttcctttttatattcataagtctttattcattctctagctttgaccacttgcatattcaaaytgacattttgtcgtgtttttctctactgtctttatgcagcggaccatgtgtcaacttatgccgcgtttgtacagacgcatagaccaacaggggagtttat

SEQ ID NO: 20644 - DNA, 201 bp, Homo sapiens
gctggtcactgagggtgtcgctgagagcctcttcctgcccagaacagattacagcttccacaagttccattacctgacctttgtgccctcagcagaggacktctatgactgcagggtggagcactggggcttggaccagccgctcctcaagcactggggtatgcaactgcttttctctccataatctcctggcatcctcta

SEQ ID NO: 20645 - DNA, 201 bp, Homo sapiens
ttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatac

SEQ ID NO: 20646 - DNA, 201 bp, Homo sapiens
ttgagaaatcctcttactgcacacacctcacctctctccatccctttacacccagacttcctgaaggaaaaagacgaatgaactgagacactgccctgtgmcagccgtggggaacccaagacaagtaaaatccatctcagccccgaggaggatgcgccacactcagcctcatgcaccccctcccattccagctcctgccgc

SEQ ID NO: 20647 - DNA, 201 bp, Homo sapiens
aagtcactggcaccgctgtccactgtgctgctgaggtcacctcccctcagcttccaagactcttctctgcgggcctctcctcacactgcacttgggttttwttggtctctttcacaggcttttctgtcttggccaaatcacaactgtccagttcccaggatccggtcctttgctcttccccctgggtcccctctccctgga

SEQ ID NO: 20648 - DNA, 201 bp, Homo sapiens
aggcttttctgtcttggccaaatcacaactgtccagttcccaggatccggtcctttgctcttccccctgggtcccctctccctggatggtctcatgtatcycagtctcctccccggctgcagacccttctgtctacctgcccatcagaccacccatctgcccctcaagcacctcaaacccagctacctccctgtaggtttc

SEQ ID NO: 20649 - DNA, 201 bp, Homo sapiens
gtgagggtttcgagaccagtcagtgtccctagattctctgacaagggggagaactatgaatcttcaggaacccctaagccaaggtcaggaagtctccattkccctggcttcaaactatgctcaggagctggtatagaagaaagatggggtttggacatggccccagggtatagatgcagaagataagatgagtggacccca

SEQ ID NO: 20650 - DNA, 201 bp, Homo sapiens
cccggctgctcctgcgccctgggcacgggcccgcggggctgccctgggaccgccggcccaaagccctcactcacctcggcgctgcagggtcatgggcccghccagctcgtagttgtgtctgcacatcctgtccggcactgcccgcttctcctccaggatgtccttctggctgttccagtactccgcagcaggccgccccag

SEQ ID NO: 20651 - DNA, 201 bp, Homo sapiens; identical to SEQ ID NO: 3283

SEQ ID NO: 20652 - DNA, 201 bp, Homo sapiens
gggaccgccggcccaaagccctcactcacctcggcgctgcagggtcatgggcccgcccagctcgtagttgtgtctgcacatcctgtccggcactgcccgcytctcctccaggatgtccttctggctgttccagtactccgcagcaggccgccccagctccgtcaccgcccggaactcccccacgtcgctgtcgaagcgcgc

SEQ ID NO: 20653 - DNA, 201 bp, Homo sapiens
caacccggctgctcctgcgccctgggcacgggcccgcggggctgccctgggaccgccggcccaaagccctcactcacctcggcgctgcagggtcatgggcycgcccagctcgtagttgtgtctgcacatcctgtccggcactgcccgcttctcctccaggatgtccttctggctgttccagtactccgcagcaggccgccc

SEQ ID NO: 20654 - DNA, 201 bp, Homo sapiens
gaatcaaagagcagaatgatagaaactgacttcagagcaacttcttggcagcagtatccaatttggaagttgaaggtctgtcctggagccagatgctaacraaacacagcaaatgcttttcctaaggcacaatagtcttttcagtgagctcaggaaccctgtgggggtaaaagacaagttatcccaggttgccagcctcct

SEQ ID NO: 20655 - DNA, 201 bp, Homo sapiens
gctttgaatcaaagagcagaatgatagaaactgacttcagagcaacttcttggcagcagtatccaatttggaagttgaaggtctgtcctggagccagatgytaacgaaacacagcaaatgcttttcctaaggcacaatagtcttttcagtgagctcaggaaccctgtgggggtaaaagacaagttatcccaggttgccagc

SEQ ID NO: 20656 - DNA, 201 bp, Homo sapiens; identical to SEQ ID NO: 3290

SEQ ID NO: 20657 - DNA, 201 bp, Homo sapiens; identical to SEQ ID NO: 3293

SEQ ID NO: 20658 - DNA, 201 bp, Homo sapiens
ccagtgctgctccagcctcctctctccccagcctcacccctctgcagttcccagggctgagccgtcctgctggttagttctcagcacccttctgtgactayaagttcaagttctcctccccttcctggacaatgaacccaaggtaatagataagaggttttagggcttgaggggctgtattcaggagattccaaccttgct

SEQ ID NO: 20659 - DNA, 201 bp, Homo sapiens
agtgctttgaatcaaagagcagaatgatagaaactgacttcagagcaacttcttggcagcagtatccaatttggaagttgaaggtctgtcctggagccagrtgctaacgaaacacagcaaatgcttttcctaaggcacaatagtcttttcagtgagctcaggaaccctgtgggggtaaaagacaagttatcccaggttgcc

SEQ ID NO: 20660 - DNA, 201 bp, Homo sapiens
aggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaaagtggaagtcagtggaaaactaaggtacctactttgcagtcct

SEQ ID NO: 20661 - DNA, 201 bp, Homo sapiens
gaaacagtgctttgaatcaaagagcagaatgatagaaactgacttcagagcaacttcttggcagcagtatccaatttggaagttgaaggtctgtcctggarccagatgctaacgaaacacagcaaatgcttttcctaaggcacaatagtcttttcagtgagctcaggaaccctgtgggggtaaaagacaagttatcccagg

SEQ ID NO: 20662 - DNA, 201 bp, Homo sapiens
gaggcccagtgagagaaacagtgctttgaatcaaagagcagaatgatagaaactgacttcagagcaacttcttggcagcagtatccaatttggaagttgarggtctgtcctggagccagatgctaacgaaacacagcaaatgcttttcctaaggcacaatagtcttttcagtgagctcaggaaccctgtgggggtaaaaga

SEQ ID NO: 20663 - DNA, 201 bp, Homo sapiens
tatgaagtagtagggctagcttccaatccagaaagtctggatccaagactgtttatccactgtcctattcaccctattttgtgaaggaaaagaccaagttsaaattctccagagtccattgccaaataatggagtcagatctatatttctatacataattacaacacagtgtggtgggtgcctgtaactacttactgtctc

SEQ ID NO: 20664 - DNA, 201 bp, Homo sapiens
aataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagaga

SEQ ID NO: 20665 - DNA, 201 bp, Homo sapiens
cagccacataacaacaacaacaccgataactaactgagtagttaatatggtcaggcgctattctgaggatttacatttattaactcactttattctcacamatagtctttgaggtaggtactattattttcactatttcacatgagagatacttacatctttttacatacacagagactttaagcactttgatcaagttcc

SEQ ID NO: 20666 - DNA, 201 bp, Homo sapiens
ctgagtagttaatatggtcaggcgctattctgaggatttacatttattaactcactttattctcacacatagtctttgaggtaggtactattattttcacyatttcacatgagagatacttacatctttttacatacacagagactttaagcactttgatcaagttcccacagctatgaagtagtagggctagcttccaat

SEQ ID NO: 20667 - DNA, 201 bp, Homo sapiens
acctggtgctgtctccttccagatccccctgaggtgaccgtgtttcccaaggagcctgtggagctgggccagcccaacaccctcatctgccacattgacargttcttcccaccagtgctcaacgtcacgtggctgtgcaacggggagctggtcactgagggtgtcgctgagagcctcttcctgcccagaacagattacagc

SEQ ID NO: 20668 - DNA, 201 bp, Homo sapiens
gtctggatccaagactgtttatccactgtcctattcaccctattttgtgaaggaaaagaccaagttcaaattctccagagtccattgccaaataatggagycagatctatatttctatacataattacaacacagtgtggtgggtgcctgtaactacttactgtctctacttggactcattccatggcaatgttcacacaa

SEQ ID NO: 20669 - DNA, 201 bp, Homo sapiens
gagcctgagtacttgggacctcatgcatctggctgcattaagatcccagcctgggatccctctctcgctataggtcatgtttgttccccgattatctgatwtcagtggcctctagagctttctgacatttcttttctgtcaaacccctcatcgtggaataagtgtgaatatgccaggggaaggtaagtcccgctcaccctg

SEQ ID NO: 20670 - DNA, 201 bp, Homo sapiens
agatcccagcctgggatccctctctcgctataggtcatgtttgttccccgattatctgatatcagtggcctctagagctttctgacatttcttttctgtcwaacccctcatcgtggaataagtgtgaatatgccaggggaaggtaagtcccgctcaccctgcaggctttctcacctttcttgctcctcctgtgcatgaaga

SEQ ID NO: 20671 - DNA, 201 bp, Homo sapiens
tgggctccccccatgaatccccaacccaaagtcccctttccgcccggcactaaggtcccttaggccaacccggctgctcctgcgccctgggcacgggcccrcggggctgccctgggaccgccggcccaaagccctcactcacctcggcgctgcagggtcatgggcccgcccagctcgtagttgtgtctgcacatcctgtcc

SEQ ID NO: 20672 - DNA, 201 bp, Homo sapiens
cggagctgctccccctacttaactccctgactgacatttccatcctgatgtcagtcctggttcaaatgccacctcctccaggaagccctcccttccttctytctcttttccatagctaagcgctctctcttctcgaccagtttcttgagaattcctcaacttgctcctgttgttttgcatgtaggagatgtagaaatatat

SEQ ID NO: 20673 - DNA, 201 bp, Homo sapiens
attttgaaaaaactgaagctcaaaaagatgaataagttttccaaggttacacagcagatcaacgagccaagtttgaagtccagacccagctctgagggtcrtacactgccttccccagattcctgcacacagtgacctactatcagggccctcctatctctctgggatccccagcctctatcttttgtggctgctttacag

SEQ ID NO: 20674 - DNA, 201 bp, Homo sapiens; identical to SEQ ID NO: 3453

SEQ ID NO: 20675 - DNA, 201 bp, Homo sapiens
tgagcgatctcagcacagtaagatttgttgcacatcagcagcactttcagctccttgaggctgtggaccagaaacttctggaagccactgggcagcatgtkttttttgttgttgttgttgctcccataagcaatgttgggcatcaagatctggcccttggaccttctacgaaccctactgttaagacctctgggtttccgc

SEQ ID NO: 20676 - DNA, 201 bp, Homo sapiens; identical to SEQ ID NO: 3309

SEQ ID NO: 20677 - DNA, 201 bp, Homo sapiens; identical to SEQ ID NO: 3310

SEQ ID NO: 20678 - DNA, 201 bp, Homo sapiens; identical to SEQ ID NO: 3311

SEQ ID NO: 20679 - DNA, 201 bp, Homo sapiens
cagtgaataaattcttaggttcccttcattctgctggggaggttctgggagcagatgtgcaggagaaagactgtcagcctggcttcctgagtacgatgatragcagagcttcctggatgacttactttggacgtgtagcatgagccaaacctggatatctgggtatttgttagtttagcacagctgatcctattcttactg

SEQ ID NO: 20680 - DNA, 201 bp, Homo sapiens
gccaacccggctgctcctgcgccctgggcacgggcccgcggggctgccctgggaccgccggcccaaagccctcactcacctcggcgctgcagggtcatggscccgcccagctcgtagttgtgtctgcacatcctgtccggcactgcccgcttctcctccaggatgtccttctggctgttccagtactccgcagcaggccgc

SEQ ID NO: 20681 - DNA, 201 bp, Homo sapiens
agcttccaatccagaaagtctggatccaagactgtttatccactgtcctattcaccctattttgtgaaggaaaagaccaagttcaaattctccagagtccrttgccaaataatggagtcagatctatatttctatacataattacaacacagtgtggtgggtgcctgtaactacttactgtctctacttggactcattcca

SEQ ID NO: 20682 - DNA, 201 bp, Homo sapiens
gttggaggcccagtgagagaaacagtgctttgaatcaaagagcagaatgatagaaactgacttcagagcaacttcttggcagcagtatccaatttggaagytgaaggtctgtcctggagccagatgctaacgaaacacagcaaatgcttttcctaaggcacaatagtcttttcagtgagctcaggaaccctgtgggggtaa

SEQ ID NO: 20683 - DNA, 201 bp, Homo sapiens
aacatggttggaggcccagtgagagaaacagtgctttgaatcaaagagcagaatgatagaaactgacttcagagcaacttcttggcagcagtatccaattkggaagttgaaggtctgtcctggagccagatgctaacgaaacacagcaaatgcttttcctaaggcacaatagtcttttcagtgagctcaggaaccctgtgg

SEQ ID NO: 20684 - DNA, 201 bp, Homo sapiens
taggccaacccggctgctcctgcgccctgggcacgggcccgcggggctgccctgggaccgccggcccaaagccctcactcacctcggcgctgcagggtcaygggcccgcccagctcgtagttgtgtctgcacatcctgtccggcactgcccgcttctcctccaggatgtccttctggctgttccagtactccgcagcaggc

SEQ ID NO: 20685 - DNA, 201 bp, Homo sapiens
ccttttcctttgaggctcagggcgggctggctaacattgctatattgaacaacaacttgaataccttgatccagcgttccaaccacactcaggccaccaayggtacgccctatctttgcctcttcctctgtagcccaactggaagggatgagagggcctctctgccaccctcagactaggaagcctaagtgccccctgctg

SEQ ID NO: 20686 - DNA, 201 bp, Homo sapiens
taatggagtcagatctatatttctatacataattacaacacagtgtggtgggtgcctgtaactacttactgtctctacttggactcattccatggcaatgytcacacaaaaaatgcccctccagagatcttacaggtttctatttatcataacactcaccatgctttatatttttatatgttttgggaattctcttagcat

SEQ ID NO: 20687 - DNA, 201 bp, Homo sapiens
cccaacccaaagtcccctttccgcccggcactaaggtcccttaggccaacccggctgctcctgcgccctgggcacgggcccgcggggctgccctgggaccsccggcccaaagccctcactcacctcggcgctgcagggtcatgggcccgcccagctcgtagttgtgtctgcacatcctgtccggcactgcccgcttctcct

SEQ ID NO: 20688 - DNA, 201 bp, Homo sapiens
tgtggtgggtgcctgtaactacttactgtctctacttggactcattccatggcaatgttcacacaaaaaatgcccctccagagatcttacaggtttctatytatcataacactcaccatgctttatatttttatatgttttgggaattctcttagcattagacagtgaacttccatgcagatgaccacatctaattcatta

SEQ ID NO: 20689 - DNA, 201 bp, Homo sapiens
atctcttaataacttgaaagaaatgtactcaaaccctctctgatgctattttcgtcatggccctacctcatcttgggagtaaagcgttccacttggctgaraagtaggagaggggctgggtcggaactcatctgctcaggttttcttcctcataccattcggatgctctttttgagtcaatggctctagctttttgtaatg

SEQ ID NO: 20690 - DNA, 201 bp, Homo sapiens
gctattttcgtcatggccctacctcatcttgggagtaaagcgttccacttggctgaaaagtaggagaggggctgggtcggaactcatctgctcaggttttyttcctcataccattcggatgctctttttgagtcaatggctctagctttttgtaatgatctataagcttctggctcctttggctctaactagtccctgagg

SEQ ID NO: 20691 - DNA, 201 bp, Homo sapiens
catctgctcaggttttcttcctcataccattcggatgctctttttgagtcaatggctctagctttttgtaatgatctataagcttctggctcctttggctytaactagtccctgaggatcaattccctttccaaagagggtgggtttttttgttgttgttgctgttgtttaattttctctcttttatctggggaaaaaata

SEQ ID NO: 20692 - DNA, 201 bp, Homo sapiens
gatacatttagcaaattcactttttggtttctgggtcaactctttcaaacctttagctccctacttgaatatccactaatatccactatgctctacacatsccatgccctgggattatgaccttcctttttgctatcagaggagagttattgcatttttccttaacccacctgcatctgtgcccacatacactacctccct

SEQ ID NO: 20693 - DNA, 201 bp, Homo sapiens
ctagtccctgaggatcaattccctttccaaagagggtgggtttttttgttgttgttgctgttgtttaattttctctcttttatctggggaaaaaatagccmctgtcatagactgtaaaaaaaaaaaaaaaaaaaaaaagctgctttttgggagccttaaaaatatttgaaataaatagggctcaaccttaacttaataata

SEQ ID NO: 20694 - DNA, 201 bp, Homo sapiens
aacactcttgttattctgattagacaaagagttgacttaatcctttaaactgaactttcccaaatctgggtttcaaatgggcccaaatagtgtctcttcastctttggagtggccaggaagagctcagcacagccacaattaatgagttggttgctaccgggcaagagtggccttgttctttcacccagtttgctgtacaa

SEQ ID NO: 20695 - DNA, 201 bp, Homo sapiens
aggatcaattccctttccaaagagggtgggtttttttgttgttgttgctgttgtttaattttctctcttttatctggggaaaaaatagccactgtcatagrctgtaaaaaaaaaaaaaaaaaaaaaaagctgctttttgggagccttaaaaatatttgaaataaatagggctcaaccttaacttaataatatcaagtgaaa

SEQ ID NO: 20696 - DNA, 201 bp, Homo sapiens
aattccctttccaaagagggtgggtttttttgttgttgttgctgttgtttaattttctctcttttatctggggaaaaaatagccactgtcatagactgtaaaaaaaaaaaaaaaaaaaaaaagctgctttttgggagccttaaaaatatttgaaataaatagggctcaaccttaacttaataatatcaagtgaaaacatac

SEQ ID NO: 20697 - DNA, 201 bp, Homo sapiens
attccctttccaaagagggtgggtttttttgttgttgttgctgttgtttaattttctctcttttatctggggaaaaaatagccactgtcatagactgtaaaaaaaaaaaaaaaaaaaaaaagctgctttttgggagccttaaaaatatttgaaataaatagggctcaaccttaacttaataatatcaagtgaaaacataca

SEQ ID NO: 20698 - DNA, 201 bp, Homo sapiens
ttccctttccaaagagggtgggtttttttgttgttgttgctgttgtttaattttctctcttttatctggggaaaaaatagccactgtcatagactgtaaaaaaaaaaaaaaaaaaaaaaagctgctttttgggagccttaaaaatatttgaaataaatagggctcaaccttaacttaataatatcaagtgaaaacatacat

SEQ ID NO: 20699 - DNA, 201 bp, Homo sapiens
tccctttccaaagagggtgggtttttttgttgttgttgctgttgtttaattttctctcttttatctggggaaaaaatagccactgtcatagactgtaaaaaaaaaaaaaaaaaaaaaaagctgctttttgggagccttaaaaatatttgaaataaatagggctcaaccttaacttaataatatcaagtgaaaacatacata

SEQ ID NO: 20700 - DNA, 201 bp, Homo sapiens
tgtgtaaatctcagttatacttaccacatggtgctgcaactgtttgcttagtttctgaattctccaagactaacttttcaaagacaggaacggaacctcartcatcctagatttccagctctatatatgtgcttgacacagttggagcctgataagtatttgttgactaaatgggcagatgaaagatagaataatgctgta

SEQ ID NO: 20701 - DNA, 201 bp, Homo sapiens
ggagtcatactgtggagggccttaaaagacaagcagagtcattggaattttatcctatgggcatttaggagttgctgaaagtttgtgaatgggagagcagkcgaagaagaatggtattctagaaaactctttttagctgggtatgcaagatggaaaataacgggagtagctggcagaagaaagattataaggaacactgaa

SEQ ID NO: 20702 - DNA, 201 bp, Homo sapiens
cttagccattgacagaaaagaacagacatgctagcttgagagtatccacacttaactgctagtcccactttactgatccaatgcaaggaaagaagtctackttcacttctcctctgtcttccatcttctctttgttttttttttttaaaaaaaaataacttttatgggtactttgtgtctttaggtcctgctgagggttct

SEQ ID NO: 20703 - DNA, 201 bp, Homo sapiens
  misc_feature (1)...(201): n = A,T,C or G, or insertion/deletion polymorphism (see Tables 1-2)
acataatattctttttctgattgaagtatgtgtcctgattatttgagagacatttttcctaatattaattttgaaaaggaatgtatcactgagtacattanctgagtatattcattagaagagtaatgaatatgtctttagcaagagttttacatctaatgaaaaaaagttcttatatttccatctcattccttgttttga

SEQ ID NO: 20704 - DNA, 201 bp, Homo sapiens
atggcctggcagatgaagactttcacctgcttggttttcagtctgatctgctgccacacccctgacagattctctgttccagtaacacgggctacttgctyccccggtgcacatcgctgcccctgtggccatgttttgcacaggctactacttctgtccagaactcctgccacctttgcaaacctggtcccctcctattct

SEQ ID NO: 20705 - DNA, 201 bp, Homo sapiens
ctggcagatgaagactttcacctgcttggttttcagtctgatctgctgccacacccctgacagattctctgttccagtaacacgggctacttgctccccckgtgcacatcgctgcccctgtggccatgttttgcacaggctactacttctgtccagaactcctgccacctttgcaaacctggtcccctcctattctaggaa

SEQ ID NO: 20706 - DNA, 201 bp, Homo sapiens
accatagtgtggttttccctcctttgtatgccccaatacctgtgtaaatctcagttatacttaccacatggtgctgcaactgtttgcttagtttctgaatyctccaagactaacttttcaaagacaggaacggaacctcagtcatcctagatttccagctctatatatgtgcttgacacagttggagcctgataagtattt

SEQ ID NO: 20707 - DNA, 201 bp, Homo sapiens
aagtttgtgggcaaaagcagttttggatgctcctaggcccaatgtaatagagctactccacaggccttaggggccattcactttatgtctcgcaagccccrcctgagcctgactgaacttagcagagccatggtatgggcttgtgctctagatagaggactcaagttcctgtgcaaggcttgcctagcacagcatggatta

SEQ ID NO: 20708 - DNA, 201 bp, Homo sapiens
tatccacacttaactgctagtcccactttactgatccaatgcaaggaaagaagtctactttcacttctcctctgtcttccatcttctctttgttttttttwtttaaaaaaaaataacttttatgggtactttgtgtctttaggtcctgctgagggttctgagcacaacagatatttggagtctcctgaatgatgtagcagt

SEQ ID NO: 20709 - DNA, 201 bp, Homo sapiens
agtacttactatttaaatgatgcccagagcctctgaatcccctagaagtacagaggagggggagatcattaatggtgtggagaagttggaggaggtgagaygatgccaggtgataaagtagacagagaagatgaaggtcttttttttgagacagggtctcaccctgttgcccaggctggagtgcagtggcatgatcggccc

SEQ ID NO: 20710 - DNA, 201 bp, Homo sapiens
gcctcgacttcctgacatagctgggactacaggcgcacaccgccacacccggctaatttttgtatttttagtagagacagggtttcaccatgtgggccatkctggtctcgaactcctgacctcaagcaatccacccacctcagcctcccaaagttccgggattacagatgtgagccactgtgccctggcctgaagaaggtc

SEQ ID NO: 20711 - DNA, 201 bp, Homo sapiens
atccacacttaactgctagtcccactttactgatccaatgcaaggaaagaagtctactttcacttctcctctgtcttccatcttctctttgtttttttttwttaaaaaaaaataacttttatgggtactttgtgtctttaggtcctgctgagggttctgagcacaacagatatttggagtctcctgaatgatgtagcagta

SEQ ID NO: 20712 - DNA, 201 bp, Homo sapiens
tccacacttaactgctagtcccactttactgatccaatgcaaggaaagaagtctactttcacttctcctctgtcttccatcttctctttgttttttttttwtaaaaaaaaataacttttatgggtactttgtgtctttaggtcctgctgagggttctgagcacaacagatatttggagtctcctgaatgatgtagcagtaa

SEQ ID NO: 20713 - DNA, 201 bp, Homo sapiens
aatgaagtttataacagatatactgtatatttgtcatgggaaagggcttcagtcaatagcaattgatattaataaaacataaaagaaatgacaataaacartcaggataactttgaaacaacttctttttatgtaggtaacattaaagaaaattaaagaaaaggaatcgctttattttataaaataaatgcactactattt

SEQ ID NO: 20714 - DNA, 201 bp, Homo sapiens
cacacttaactgctagtcccactttactgatccaatgcaaggaaagaagtctactttcacttctcctctgtcttccatcttctctttgttttttttttttaaaaaaaaataacttttatgggtactttgtgtctttaggtcctgctgagggttctgagcacaacagatatttggagtctcctgaatgatgtagcagtaatg

SEQ ID NO: 20715 - DNA, 201 bp, Homo sapiens
aagcaagttgtagtgccacggtgtgtttcagactatgctatagaaaatctttagcactcaccttaaaagtttaaagtagaaagaacaacctttaacaggaycatagaaaatgttccatcagatcaaaacaaacaagcaaacaaactgaagcaggtcatttttctctttttggcactgtgcaggaccatatgcttccagaga

SEQ ID NO: 20716 - DNA, 201 bp, Homo sapiens
aggataactttgaaacaacttctttttatgtaggtaacattaaagaaaattaaagaaaaggaatcgctttattttataaaataaatgcactactatttgcaaaaaaaaaattacctaaaaatgctgctactgaacaaacaaaactacccaaaattagagaacaaaagcataaaaattgttaacaaataaaaaaactatatt

SEQ ID NO: 20717 - DNA, 201 bp, Homo sapiens
ttagaaccaggtaagtatcctaacctctcaccagagaagtgttttcattatgttgaattttagtgaattataaattgaaattgtctcttgtggtttctgargacattatttgctctgtcacttggtggccttttctataaaaccccatatgaggaattcttttaggtctaagtgctagaaaagctttgcttcccttgagga

SEQ ID NO: 20718 - DNA, 201 bp, Homo sapiens
ctcctttcctatgcttctctcttgcaacatcaaattctgatgttcctttacatctaacccatcagcatacaaatatgcctttataacaactactaaaaataaaaaaaaacccagctctcccttggccctacatgtccctttaactaccaccccctttctttaatgccttcacaaaaagacctttaaaagtaagatctacat

SEQ ID NO: 20719 - DNA, 201 bp, Homo sapiens
ctataaattacctcaaacctttgtggctggaggtagaaaaaaaaaagaaaggaacaaagcacaattaaatgaacaattgactttgcagggcatgtcagcaygttcatagggttgaaggaagtggcaagtatacagcaacagtggatcttaaatcctatttctccttgtgagatctatggaatgggcaccagcatcaagttg

SEQ ID NO: 20720 - DNA, 201 bp, Homo sapiens
tctgtatctgaaatgtccaataagtagccactggacacatgtggtgactaagcacttaaaatgtggcttgtgaacctgaggagctacattttaactatatktaattttaattaatttaaatataaatagatacatgtgccttgtggctgccacattggaaagcacaatcctatatatcctatggtttattgataagatatt

SEQ ID NO: 20721 - DNA, 201 bp, Homo sapiens
acctaaaataggaggcaatactttgagaaatcatctcattcaagcccatgcttcaagacagagtcaccggtaaactaatttaaaacaaataggaagagtcytaccttccaaatgtcttctggtggaaaataattcatcctacatacttagtaatttggatgtttttaatacagaatgaagtatcataccccttagtatata

SEQ ID NO: 20722 - DNA, 201 bp, Homo sapiens
gatatttggagtctcctgaatgatgtagcagtaatgccctgttccgcctgttgcataactcccagcctcatactgcctggtgatggaattattgattgttragcatttcacaacacattttcaaaacatgctgaaggtcaagaatggatgactcataggcagtaacagttccttctgcctcagtccctctacatgatattg

SEQ ID NO: 20723 - DNA, 201 bp, Homo sapiens; identical to SEQ ID NO: 3473

SEQ ID NO: 20724 - DNA, 201 bp, Homo sapiens
ctgagaacatatttacaaggtgctaataacacctaactatgatcttagaactagtctacatggtgagtcagacggggcttattttcgacccatttttcagwtggaagtaagacacagggaggtgaaatgacttgcatgaggtctcacagctaggaaggtcttctggacctggcttaataaaacccaatgttcttaatttca

SEQ ID NO: 20725 - DNA, 201 bp, Homo sapiens
tctttaaatgggagactccttttatctgagcttgcaaaatcagattcatgggtttctactaatagtcccttgcatttgtgtagtttgtaacgtgttttcamatccctcatcacttctgaactgggtataatctattgggcagatgtcatctacccttggtaggacagaagggcctggagatctgacaggtaatgtgaccac

SEQ ID NO: 20726 - DNA, 201 bp, Homo sapiens
gtagaggcagctttcaatatacgggacatgcaatgggatgttacactgcaaataagaagataaaactagaacaatagcgagaaagccaatgtgttatgttstaaggcttggtgtagttactgcaactgagcatgaaatataaactgagcttcctggcaggcaggacaaaaaagtaaacatgatgacgtacataatattctt

SEQ ID NO: 20727 - DNA, 201 bp, Homo sapiens
caattccctttccaaagagggtgggtttttttgttgttgttgctgttgtttaattttctctcttttatctggggaaaaaatagccactgtcatagactgtwaaaaaaaaaaaaaaaaaaaaaagctgctttttgggagccttaaaaatatttgaaataaatagggctcaaccttaacttaataatatcaagtgaaaacata

SEQ ID NO: 20728 - DNA, 201 bp, Homo sapiens
gcctcccaaagttccgggattacagatgtgagccactgtgccctggcctgaagaaggtctttatgggtacggcatgactgctggagagttttgtcaccgcygcttaaggaagagcttcccaatgttggatatgtctgtaacttcataatttttttttaattttgcgcttttgtgaatttcctcaattggctttcttattgg

SEQ ID NO: 20729 - DNA, 201 bp, Homo sapiens
acatcagattttggcgtgctctggggttcttatctctattctgtctgtactcttcttggatgaactcattgagtcccctggctttaaaataccatttataygcagaaaacttcaaatctctatctctaactgacttctcccttgagcttcagactccataactctacttgtatatgtaaaaagcacttcacacaaactgtg

SEQ ID NO: 20730 - DNA, 201 bp, Homo sapiens
tgtaaagcacattctgggtaaggaaaggcaagcatgtgtttctgcttgactgaaattggtttttttttttccccaccagtttgtcctcttatcgggatacrtcagaaattagagagaccctggcaatcacagcttccacctcctcattttacaaatgagcaactaggctcagagtacagaagtggctttcccagggtcaca

SEQ ID NO: 20731 - DNA, 201 bp, Homo sapiens
ctcgtcagcgaagcctccctcagcatcccctccccacatccatccctgcacactgcaccctctccaagctgctgccagccgtgctgctcccctgcctcctkactggagggcaagccagtaaaaaaggaagcaaattcggttatgtaaagcacattctgggtaaggaaaggcaagcatgtgtttctgcttgactgaaattgg

SEQ ID NO: 20732 - DNA, 201 bp, Homo sapiens
cgaagcctccctcagcatcccctccccacatccatccctgcacactgcaccctctccaagctgctgccagccgtgctgctcccctgcctcctgactggagkgcaagccagtaaaaaaggaagcaaattcggttatgtaaagcacattctgggtaaggaaaggcaagcatgtgtttctgcttgactgaaattggtttttttt

SEQ ID NO: 20733 - DNA, 201 bp, Homo sapiens
tgctctttttgagtcaatggctctagctttttgtaatgatctataagcttctggctcctttggctctaactagtccctgaggatcaattccctttccaaaragggtgggtttttttgttgttgttgctgttgtttaattttctctcttttatctggggaaaaaatagccactgtcatagactgtaaaaaaaaaaaaaaaaa

SEQ ID NO: 20734 - DNA, 201 bp, Homo sapiens
ttggtgcctgaggcttcttccaggacccagtcttttctgtctgccttgggcacagatttctagatgcctgaagatggacaggcccagaggttgcccagagygatgtctgagattactgatctctatctaggcttccatagaaacacatcccaaaacgttcttggttcttattggaatctcatctcatttgcagaacatggc

SEQ ID NO: 20735 - DNA, 201 bp, Homo sapiens
cttataaaatttatttaaatgtgattgggtgaatttagcagttaaagaagtgaagaacactgaggtccaattggtgcctgaggcttcttccaggacccagkcttttctgtctgccttgggcacagatttctagatgcctgaagatggacaggcccagaggttgcccagagtgatgtctgagattactgatctctatctagg

SEQ ID NO: 20736 - DNA, 201 bp, Homo sapiens
  misc_feature (1)...(201): n = A,T,C or G, or insertion/deletion polymorphism (see Tables 1-2)
tgaaggagtgttgctactcttctgtgcccaacaatgtgctagcaccaagggagttcaaaagaaatgtgagacatggtccctaccctccaggaacttacaantcattgttgggagaccaagacacatcccctaaaaacagatatataacacctcaagtctgtgaagtacttactatttaaatgatgcccagagcctctgaat

SEQ ID NO: 20737 - DNA, 201 bp, Homo sapiens
gtccaggcctagagcatctccccattcaggccgtgttcacaggaatcatagcctctccctttattctcccctggggaatctgcagtaatgcttaatccccrctcccagactcactttcgcaaggggaaatcaatagattcttcaagtagttggaccacagaatgatgcctgggtctattttgtcaaccaggtggctctggt

SEQ ID NO: 20738 - DNA, 201 bp, Homo sapiens
acctctagtctgccacctataaaaaaagttgtgtattgcttagcagtttgcaaattttctgactgaagtttcaagaggtttgtgggattgattgattacargaagcgtgtaaattttatcttccctggggaataaaattgtgggactaattgattcttttaaaggcttgtattttctggtgattttgtcagcctgggtaca

SEQ ID NO: 20739 - DNA, 201 bp, Homo sapiens
cggggcttattttcgacccatttttcagatggaagtaagacacagggaggtgaaatgacttgcatgaggtctcacagctaggaaggtcttctggacctggcttaataaaacccaatgttcttaatttcatcaactcctttaaaaattactttgattgctgctttcttgattggctgctctcaggcctcttggctgatgaaa

SEQ ID NO: 20740 - DNA, 201 bp, Homo sapiens
ggactgcaactgcctgatctaagattctgactccattttcatgctgtgctggattccactgtgcttgctgatctctcaagtcatcagatttgaaaagaacrttactaaggatgttagaactacattttagggctcagggatgtccataaaaataagaatttccatctctgaattattagagcagacacttgtggctgaatg

SEQ ID NO: 20741 - DNA, 201 bp, Homo sapiens
accaagggagttcaaaagaaatgtgagacatggtccctaccctccaggaacttacaactcattgttgggagaccaagacacatcccctaaaaacagatatrtaacacctcaagtctgtgaagtacttactatttaaatgatgcccagagcctctgaatcccctagaagtacagaggagggggagatcattaatggtgtgga

SEQ ID NO: 20742 - DNA, 201 bp, Homo sapiens
aacttcataatttttttttaattttgcgcttttgtgaatttcctcaattggctttcttattggcccccaggatcacacagaacacttcaaactcctcttaygtgttcttgatttcatcatttagctgaagatgcaggccctgtctttctttctgagttttccttagcaccctccttttaaattacctttttcattggttaa

SEQ ID NO: 20743 - DNA, 201 bp, Homo sapiens; identical to SEQ ID NO: 3474

SEQ ID NO: 20744 - DNA, 201 bp, Homo sapiens
aattacctaaaaatgctgctactgaacaaacaaaactacccaaaattagagaacaaaagcataaaaattgttaacaaataaaaaaactatatttttgaaawgtcttagatgatacacaaaaaatgcagatttgtataaatacaccatcgccctgggatgacctcttatcattgtctaagcaagttgtagtgccacggtgtg

SEQ ID NO: 20745 - DNA, 201 bp, Homo sapiens
  misc_feature (1)...(201): n = A,T,C or G, or insertion/deletion polymorphism (see Tables 1-2)
aacaggagggagtacaattcttcccaccttacagagaaggcgattgaggcctccaaaggtaaagtgactcactcaggattacagagttacccagggatcancactgtgctgttcaaaatacaccaggctgccaactgcagcaatatcctgggcctgtgagaaccgtgggttcataggatgttgcacaaaaaagagagaaat

SEQ ID NO: 20746 - DNA, 201 bp, Homo sapiens
agtttttgccctaacctacccatcagaacactggagaagactcaggtagataatggattcaagggcattgttaaatgataaaaattatcatgatgatgacttttttttttctctaaggttaaggatatctcttaataacttgaaagaaatgtactcaaaccctctctgatgctattttcgtcatggccctacctcatcttg

SEQ ID NO: 20747 - DNA, 201 bp, Homo sapiens
agagggaacagaggctcaggatatgaaaaaaactttctcatttggtaaaagccacagaaactgatgaaacccaggtcttctctctgcatgtgtagggtatwttcctgccagccacacagccttttaggtctaaataaagtgttgagactccactgcaagtgtgtgtgcgctcaggagtgactcttctacccagtttggtgc

SEQ ID NO: 20748 - DNA, 201 bp, Homo sapiens
atgtgtggagcccagtgatgttgtgttactgggtagccttaaaccttattccaaccttgactccttctactctgtgccataaactctctccttccaatacyccccattcctctgctgccttcccctttatcgtacctggcaaaactgcaatcctggtgaaatgtatatcctctaattcctcctttgcttgcatccaaacag

SEQ ID NO: 20749 - DNA, 201 bp, Homo sapiens
ttgaaacaacttctttttatgtaggtaacattaaagaaaattaaagaaaaggaatcgctttattttataaaataaatgcactactatttgcaaaaaaaaawttacctaaaaatgctgctactgaacaaacaaaactacccaaaattagagaacaaaagcataaaaattgttaacaaataaaaaaactatatttttgaaatg

SEQ ID NO: 20750 - DNA, 201 bp, Homo sapiens
ttttgaccaagtcctgcttgtaactgaattaactggggtgcttgtttaaaatgcagacccgcccccaggcacccccgccaacagaccctagccttaaatayggcctcaaagttggttggggaaaatttttgagcatagtccattgcccagctcttcagggataatggtaaagccctagaatgatggtgtctgggctggatc

SEQ ID NO: 20751 - DNA, 201 bp, Homo sapiens
gtgctggctttgggtgggtgctggatggcagacagtgagtggctatgctgttagcagaagcctcagtggctggcattctgtgtgcccaacctaggcacagytgtatattttattcatcttatgtgtgtttgggtagctaagggcagtgatattgcatgaaggaaagaaagaagcctgaccaggaagtggattataaaggta

SEQ ID NO: 20752 - DNA, 201 bp, Homo sapiens
aaatctaaactcatggcctggcagatgaagactttcacctgcttggttttcagtctgatctgctgccacacccctgacagattctctgttccagtaacacrggctacttgctcccccggtgcacatcgctgcccctgtggccatgttttgcacaggctactacttctgtccagaactcctgccacctttgcaaacctggtc

SEQ ID NO: 20753 - DNA, 201 bp, Homo sapiens
tccagctgtttcaaactatttgtgtggggctttccacacaagctgtgttctctcccgtccccttgctttagttcactcttttccttttgcttggaatgctyttccactctatctgtcaatgcactcaaatgcccactcctggatggagactttcctggcaaccccaggcagaattagccactcccaattctgtgtattctc

SEQ ID NO: 20754 - DNA, 201 bp, Homo sapiens
caacaatgtgctagcaccaagggagttcaaaagaaatgtgagacatggtccctaccctccaggaacttacaactcattgttgggagaccaagacacatccyctaaaaacagatatataacacctcaagtctgtgaagtacttactatttaaatgatgcccagagcctctgaatcccctagaagtacagaggagggggagat

SEQ ID NO: 20755 - DNA, 201 bp, Homo sapiens
ccacacttaactgctagtcccactttactgatccaatgcaaggaaagaagtctactttcacttctcctctgtcttccatcttctctttgtttttttttttwaaaaaaaaataacttttatgggtactttgtgtctttaggtcctgctgagggttctgagcacaacagatatttggagtctcctgaatgatgtagcagtaat

SEQ ID NO: 20756 - DNA, 201 bp, Homo sapiens
gtgccaccatacccagaaaattttgtatttttagtagagatggagttttgccatgttggccaggctggtcttgaactggcctcaagcaatccacctgcctyagcctcccaaagtgctgggattataggcgtgagccaccatgcctggcttcactttgttttttaataccaagtctcataaatagtataaagtgggagttaa

SEQ ID NO: 20757 - DNA, 201 bp, Homo sapiens
tataatgtatcattttagaatatttctaaaggtattatttaagtatttatatacctctgtagttgccagatgacggagttgtcctattctaagtatagtgygtataagagaatgttttagggtagccctttagagaattcttaggaagatgaagtgactagaaacaatatacagcagacagaggtgtaagaataacaaaca

SEQ ID NO: 20758 - DNA, 201 bp, Homo sapiens
cacccgtcttggcttcccaaagtcctgggattacaggcgtgggccaccgtgcccagcctaaatatatatttcttatactacaatattaccctgttatttaytcaagaagtcaatactaggtttgaagtgactaaagaattcatctctgtgcaacaactataggcaagaatagtttcaaaatggaattatacactttaaatg

SEQ ID NO: 20759 - DNA, 201 bp, Homo sapiens
acttctgttcaacatggtattggaggtcctagtcagtgcagtaaggccagaacaaaaaaaaagtaaagaaagaaggaaactatcactcacaaattattttmaatacatagaaaattcaaaataacttgcagataatttatagtaaattcatcagttatcactgtatacaaggtcagtattcaaaaattgtgtttttatgta

SEQ ID NO: 20760 - DNA, 201 bp, Homo sapiens
ggccaccgtgcccagcctaaatatatatttcttatactacaatattaccctgttatttactcaagaagtcaatactaggtttgaagtgactaaagaattcrtctctgtgcaacaactataggcaagaatagtttcaaaatggaattatacactttaaatggatgaatggaatggtatgcaacttaaatgtcaagatgtttt

SEQ ID NO: 20761 - DNA, 201 bp, Homo sapiens
atttttatggtctttattttttcagtttggtggcaagcatgttaagaggaaggacttatgttctgtattagcaaaacagagcaaattgtaattcacagtgatgtatgctgcattcatcttctagaaaactattgctttgtatcacttgagtgaaaagattttataaagtaggaactatctaaaaaatcatgctctagtcac

SEQ ID NO: 20762 - DNA, 201 bp, Homo sapiens
cttttgaagagagaatcaattctgccctattgttccctccctactaggtggaactgatataaggggatagttttcccttctttacttcgtattcttgattstttttatagattctttttaaagacagtaaaatgttttttgttaaacctatttgggaatatatatctagaaccacaaataggtctccatcatttattattc

SEQ ID NO: 20763 - DNA, 201 bp, Homo sapiens
gcagtatgcagaagcacctcagggcgcctaatgttagctgacgaaggcaccattaaggaggtcacagtttggctaaagggcccccaaaggatgagacaacygtgtaatcctagctctatagagatcattaccaagtctttgccatacaaagtttgggcttcaggtgaaatgagaagggcaaggttctgcccaagagggtcc

SEQ ID NO: 20764 - DNA, 201 bp, Homo sapiens
tgagaccatcctggctaacatggtgaaaccctgtctctactaaaaatacaaaaaaaaattagctgggcatggtggcacgcgcctgtagtcccagctacttrggaggctgaggcaggagaatggcatgaacctgggaggtggggcttgcagtgagctgagatcacgccactgcactccagcctgggcgacagagtgagactc

SEQ ID NO: 20765 - DNA, 201 bp, Homo sapiens
agaatgggactagaagcagaaagttatatttgggcctttttgagtttttcttgctctgtcactaagccaattatggcttagccttcctataggtatagtarcatctaaaagtggtagaagcaaaggctggagttctcatgttagagagaacagtgtagaagaagataaggagttgagaggaaccagggcaaagcaatcact

SEQ ID NO: 20766 - DNA, 201 bp, Homo sapiens
gaattcatctctgtgcaacaactataggcaagaatagtttcaaaatggaattatacactttaaatggatgaatggaatggtatgcaacttaaatgtcaagrtgttttcaaaaaaatgagtaaagaacttgacaaaacattttaatataaactgaagtggatctgctaagttgtgttacagcgaatggtgggaaaaaaaata

SEQ ID NO: 20767 - DNA, 201 bp, Homo sapiens
atggggcatccatctcctcgagtatttatcctttgtattaccaacaatccaattatattattttagttatttaaaaatgtacagccttgtttacttctaarcattatataaaatgtgtgcttcacttataaaccacactatctgacactcagaaggtttttgtgaggtcagtcatatccagctcaagaggttgctagggaa

SEQ ID NO: 20768 - DNA, 201 bp, Homo sapiens
ctgggaggtggggcttgcagtgagctgagatcacgccactgcactccagcctgggcgacagagtgagactctgtctcaaaaaaaaaaaaaaaaaaaaaaawtttaatataaatgtacaatattttgttttattacataaattggataatgctatttgtatgcatttgaaatttacattattcatttaatgacgcatcttgt

SEQ ID NO: 20769 - DNA, 201 bp, Homo sapiens
ctcacacactgttagtattactctttgaaactggattttatttctttgaattcccaagcctgtgcttttcttgttttgccatactacttctggaagccaagttcacctagctaataattggaagagatagtattgaaatccaagtcttctaatgtttcatctaaatattcttggcattttgtctttttttttttttgagat

SEQ ID NO: 20770 - DNA, 201 bp, Homo sapiens
tgagaatgaagagaagagtctaaaatgattccaaggagtcagtcatcttgtttggaaggtggggagagggggtagaccaaaatttgcaactgtagtgaaayatttattcatcacattgtgtctggcaacattattttaggtacaatttatatttgttacatcgcttattatcattattgagactaggtgaagttaagaaga

SEQ ID NO: 20771 - DNA, 201 bp, Homo sapiens
tcttgtttatcctttcaaagaaccaactttttgttttgattctttgtatggtttttgggtctcagtttcatttctactctgttttcttttattccgttagscttgggattagtttgttcttgtttttctagttcctttaggtgtgatgttacatgattaatttgaaatctttctgtcctcttgatgtgggagtttagtgct

SEQ ID NO: 20772 - DNA, 201 bp, Homo sapiens
aattttatactgaatttatataatagtttcttaaagttttggtatttatatttggaagaaactagtttttttcctgagaaaagaaatttaaatgatgaatratgatgtcattttagactctaacacaacaaaaatgtgtagtcttaagtgaaatttaattgagagttattttcttggtttaacactttttctcaacagggt

SEQ ID NO: 20773 - DNA, 201 bp, Homo sapiens
ggctgaggcaggagaatgacttgaacccagaaggcagaggttgcagtgagctgaaatctacactccagcctgggtgacagagggagaccctgtctcaaaaraaaaaaaaaaaagtgtgaagtattgagggtataagttgggtagtcatagtgggaataaaaggagagggatagctataagaaatacctcaaagaaagaatg

SEQ ID NO: 20774 - DNA, 201 bp, Homo sapiens
gctgaggcaggagaatgacttgaacccagaaggcagaggttgcagtgagctgaaatctacactccagcctgggtgacagagggagaccctgtctcaaaaaraaaaaaaaaaagtgtgaagtattgagggtataagttgggtagtcatagtgggaataaaaggagagggatagctataagaaatacctcaaagaaagaatgg

SEQ ID NO: 20775 - DNA, 201 bp, Homo sapiens
ggaagtttttataaatgattctcctcccggccgggtgcggtggctcacgctgtaatcccagcactttgggaggccacggcaggcggatcacgaggtcaggrgtttgagaacatagtgaaacccaatctctactaaaaatacaaaaattagccaggcgtggtggcacatgcctttagtcctagctactcgggaggctgaggc

SEQ ID NO: 20776 - DNA, 201 bp, Homo sapiens
ttaccttaacagttacccatatattatagtaaaaatttttatccataaacagctgattgtgtgcaatgtcagagttaccagggagaaacatcacattgggraaacagtctcactggaaaactgttagaagagaaactttagggcccttgggtaggggaaaattatcattttgtgggacacctggagattgtttttttcctt

SEQ ID NO: 20777 - DNA, 201 bp, Homo sapiens
gctgaggcaggagaatcgcctgaacctgggaggcggaggttgtggtgagcagagcatgccattgcactccagcctgggcagcagagcaagactccgtctcaaaaaaaaaaaaaagattctcttcccaaaaaaaagagatttttgaaaaaactaaatcactcagaattatatatgttcactaggtttctttttccataaggt

SEQ ID NO: 20778 - DNA, 201 bp, Homo sapiens
cttaagtgatctcaagagtgaatttgatttaggctttgtaatccatgtgttgcatgggagtcaagtgtcatcacaggaaccataggtagtaaagcaaaggyatgatggaagccaggaccagaaagaaaatctacagtgtactgaaggaagctgggaatcgttgggcaagaagaggtaaacagatactcagataatcgattc

SEQ ID NO: 20779 - DNA, 201 bp, Homo sapiens
gatagaaaagtgagatgtggaagtgtcataaatatatggtgttcagcttattttggaattaggacaatggtttttttgttttgttttgtatttttcatgtrtacttcctagatcaactctcagatctttaatttgtgcatagggcttcctgaggatgttgctcttactagaggtaattgatcagttttcattgatggctcc

SEQ ID NO: 20780 - DNA, 201 bp, Homo sapiens
tgcatgggagtcaagtgtcatcacaggaaccataggtagtaaagcaaaggtatgatggaagccaggaccagaaagaaaatctacagtgtactgaaggaagytgggaatcgttgggcaagaagaggtaaacagatactcagataatcgattcagaaacacacacagggtagcaagttaaaactgaggcagaccggcaaacac

SEQ ID NO: 20781 - DNA, 201 bp, Homo sapiens
taaacagatactcagataatcgattcagaaacacacacagggtagcaagttaaaactgaggcagaccggcaaacacccagacagttgcagatgctggacargaggccaagcagtgtgtcatatatcctggcttaaaagaaccagaaggaggcaggtacttcattgcagtttaaaaaaacctagcaattcctaagaattcat

SEQ ID NO: 20782 - DNA, 201 bp, Homo sapiens
acattttcgttatggtattgactactgtagtgattttctgtgtctacctttgtttacattttttatttcatcaagataaattccaaaatgtagaattcctygttcaaagaatatgtacatttttatagcttttgatacgtttcatagcatttgataccaaatggcttttgaaaatagttgatctaatacatacttttatta

SEQ ID NO: 20783 - DNA, 201 bp, Homo sapiens
gacagagcaggcacttaatagctgttgaatgagaaaatgaatgacagctattataagaaataccaacaaagagtatcttactttaaaatatcaaaacagtwtacatgtacatgaaatagttaaatataaaagtaagactttattttggggtgagaaataagtcttgataaagcaagtcattctggagttgagttaatgatt

SEQ ID NO: 20784 - DNA, 201 bp, Homo sapiens
ggctcttggttggtttgtgaatggcagttaacagcagaacttatttatgaatttatcttacactcttcttgacacttgctaaaaagagttcctcttttttrttgccacatgctacatttccatggtttatttggaatttacacgctgacagaaatgtttgtactactttttggtactccttcaaaatagggcagagaaatt

SEQ ID NO: 20785 - DNA, 201 bp, Homo sapiens
aaaagatcatactgtaatatgatttttttgatggctttttaaaaatttgtgatttgaaatcataatcatcattattatttatatttttgtatacttttggmcttattagtgtgttggagccagcttgagctggcttgcaagatttcatttgcaaattagttgccaaaaccattggtagcttataattagctatggtgggaa

SEQ ID NO: 20786 - DNA, 201 bp, Homo sapiens
aaaacgcagtgtttgagaaagttatttatgtattgatttggtaggagctgataaaaaattataaaagttgtggagagattttgaatagctaaagtgggagmtatcatggaagtgatttatgaagcttttttttttctttttcttttttgagatggcatcttgctctgttgcccagagtggagtgcagtggcgttatcacgc

SEQ ID NO: 20787 - DNA, 201 bp, Homo sapiens
atttatatcatttttgggggttctttacattaatgaacaaatcaagttcttcagatatagaataatactaggttttatgtaaaaaattatttctaaaatcrtttgtgatagtgattggttgttacttcggattcattgctgatctatggggtatctatttcaagtgtactctcttcttgaaattctgactaaaacccagat

SEQ ID NO: 20788 - DNA, 201 bp, Homo sapiens
aacagcctttttctaaaacccagggtcattttgctgaacatagttgttgtgccatgcttatgatacagtgaatttcttgttctggtgctgtcaaaagcttrccatttaaaaaggaaatttggtgatgagaaaaatctagtactgagaaacaataaaaaatcttgatgaatgaaagaaagtgacaatgttagagtaggttat

SEQ ID NO: 20789 - DNA, 201 bp, Homo sapiens
cctctgtagttgccagatgacggagttgtcctattctaagtatagtgcgtataagagaatgttttagggtagccctttagagaattcttaggaagatgaartgactagaaacaatatacagcagacagaggtgtaagaataacaaacaggccaggtacagtggctcacacttgtaatcctagcactttgggaggctgagac

SEQ ID NO: 20790 - DNA, 201 bp, Homo sapiens
ctcccattctgtatgcccacacctacagcattgtttccctctcactggccatacccctcctgatcagatcttctagttttctttgctgtttcagcataatrttgtgcctttttttttttttttttgctttcgtcaataatgaaaaaggaatcattattttcactcttccacatgtctgatgaaaggcaatttttttttttt

SEQ ID NO: 20791 - DNA, 201 bp, Homo sapiens
atctgttgtggaattagctgttttaagaaagtaagttttctacataatagaagcttacaccttttaaatatcaaatttcattttattttcaccattttttkggggaaatctttaaggtgttgttttccttttaaatctagtgtatttgaacataattcagcttttaatgtcttgaagctgacataaacattttttaaaatt

SEQ ID NO: 20792 - DNA, 201 bp, Homo sapiens
atgggcaaatagtgatttattttattttgcaaaaaagctcaggattttttccaatgttttgtttaagtatgtttaggtatgtataggtagtttaaatcttygttttccatgaagggaaatatgtgttgttgacctcagacttcttttaatgtacaatttacatacaataagctttaccatttttagtgtatagttctgtgc

SEQ ID NO: 20793 - DNA, 201 bp, Homo sapiens
agaaaaccattctatactagaaaggtgttatttaaaaagtttgatacccagaaaaattaattatttcattagttaccataatgcctgtgagttttttgccrctttgatttaactgacattgacatgtctttgtgttagtgttgcagcttctcagtttttatattctacttcattggttgtaatttagtctcagatgatttc

SEQ ID NO: 20794 - DNA, 201 bp, Homo sapiens
ttgtttgtaatattcccttatattcttttaaaactgctataggatctgtactgatgttctgtttcatacctgatgttttgtgtcttctgtttgtctttttktgttgttgttgttgttgttagttttgatagaggcttacaaattttttgcttaattgattttctctattttcctcttttatttcttcttttaataattcct

SEQ ID NO: 20795 - DNA, 201 bp, Homo sapiens
cttactgaaacttccccagtggttcctcattactaaacagctaaaatgtacttttttgcatgggcggaaatagccgtcataatcccgtcccttatccaacttttttttttaactgtagttcagcccctttcgccaccattttatgctttaagcatatcaaattaatttagttgcctaggtccactatgggttttttctgtt

SEQ ID NO: 20796 - DNA, 201 bp, Homo sapiens; identical to SEQ ID NO: 3479

SEQ ID NO: 20797 - DNA, 201 bp, Homo sapiens
ccttatccaacttttttttttaactgtagttcagcccctttcgccaccattttatgctttaagcatatcaaattaatttagttgcctaggtccactatggkttttttctgttacttttgttcatgtcgtatatgcctataatattatttatttggcaatttactgttactcatgtttcaccttaaaagatgtctctttctt

SEQ ID NO: 20798 - DNA, 201 bp, Homo sapiens
cagctcactgcagcctccacctcctgggctcaagcaatcctctcacctcagccccacaagtagccgggaatacaggcatgagccaccactcccagctaactttttttgtattttttatagagacggggtttcgtcatgttgcccaggctggtcttgcactcttgggctcaagtggtctgcttgcctcagcctcccaaagtg

SEQ ID NO: 20799 - DNA, 201 bp, Homo sapiens
gaaattgttttctctcttatatgagtttgtatacagtatccttgattttaccttttggtctacaaagcttaatattatttactctgtggccctttgtgttaaaaaaaaaaaaaaaaaaacttgtcaacccctgtcaggttattttgaatgccccaccctctcagttcttagacctctgttttcttggtgacactgtcattt

SEQ ID NO: 20800 - DNA, 201 bp, Homo sapiens
tcatctgtgttgatgcaccaataattcattgctttttattgctgagtagtattccattgggaaaataccttggagtgatattgctgggtcatatgatagayggacaggcatacctcattttattgcacttcactttactacactttgcaaattacagtgttttttttttaattgaaggtttatggcaaccctgtgttgagc

SEQ ID NO: 20801 - DNA, 201 bp, Homo sapiens
ggaaaataccttggagtgatattgctgggtcatatgatagacggacaggcatacctcattttattgcacttcactttactacactttgcaaattacagtgttttttttttaattgaaggtttatggcaaccctgtgttgagcgtctgtcagcatcatgtttccagcagcgtgcactcactttctatctctgtgtcatattt

SEQ ID NO: 20802 - DNA, 201 bp, Homo sapiens
tctgactttaaacttttttttgccaaaattaaacagtacagcaccaacatttcctcagtaatcttcatctatcaataaagtgttttgcagctaatccaaaycatggagctactcttctgtaacatccagaaggaagagctatctgaatgtccattttccctagagctttctccataggtggtattgtatcatcataggcac

SEQ ID NO: 20803 - DNA, 201 bp, Homo sapiens
tactggtctcttcttttctcgcctgtcctggtaactttgggcaagtgaagaggttcttggcccaacctgagccacttgctatggctgggtccctgaatttygcctacttgcctctctgtctctaggtggaaaacagcctcaggccaaatagggaagaagagtgcttcctgtggtctttattgtcatttgggcttcaagttg

SEQ ID NO: 20804 - DNA, 201 bp, Homo sapiens
actttgtgagaaacatttgaatacattatgtgtcattgaaccaatagtgtcaatagtgaacttcatttgctctggtgggcttaaccattatcagtgttccrtgaatttctgtcagctatggaagctgaatgttctgatttactctattatatagcagtttaatatcttagaagtggtaaagtcttattgggagcttttgaa

SEQ ID NO: 20805 - DNA, 201 bp, Homo sapiens
cccactaccatcctctgaattcaacagtatttttccagaacagatcgtgtattgaaacataaacgtatgtgccatgaaaatcatgacaaaaaactaaatasatgtgccatcaaaggtggccttctgacatctgaggaagattctggcttttctacatcaccaaaagacaactcactgccaaaaaagaaaaggcagaaaacg

SEQ ID NO: 20806 - DNA, 201 bp, Homo sapiens
agtataattgtaccaaatctaaagtatttatagacagctcaacagagtccccatttgtcatagacttttcagtttattgttggtgtgtccggagttggttcctgtcggtgggttcgtggtctctctaacttcaagaatgaagccatggacctttgcgttcagtgagtgttacagctcttaaagatggcacggacccaaaga

SEQ ID NO: 20807 - DNA, 201 bp, Homo sapiens
tttaaaaaaacctagcaattcctaagaattcatgattatcatagacctagtgatacttaagtaaatttattgagtacctgttctccaccaagcactgtaamccaatacataaattatctcactttatccacacagcagtcctgtgaggagggtactggtattcctgttttacagataaggttcaaaatgattaagtcacct

SEQ ID NO: 20808 - DNA, 201 bp, Homo sapiens
aggacggggagagtgggggtgaggagataagtctagaaagcttgattttggaattgcattgtctagccttgatgctaagctaaggaatgtcagatttatcktgtaaagcattataagataccaaggcatttaactgccatgttaaaaaaatactgttttgtgaggaaagttggaaatttggaaaataagttactgttaatt

SEQ ID NO: 20809 - DNA, 201 bp, Homo sapiens
ctgtagatggtctcgatctcctgacctcatgatctgtccgcttcggcttcccaaaatgctgggattacaggcgtgagccacttcgccctgccccccccccyttttttttttttttttgaaacagggtctcactttgtcacccaggctgaagtgcagtgcgcatgttcccagctcactgcagcctccacctcctgggctcaa

SEQ ID NO: 20810 - DNA, 201 bp, Homo sapiens
ttactgttaattataactaatatgaagaaaattgtataatatttaatatttttatgctaaaatatttactcataattacaaatgtattaatcaaatttagrtatttaaatttttttaaaacaaatggaacaacatagttaagctttaaggaatgtaatattactttagctttggtcagtttgagaagtaggcaaaacttaa

SEQ ID NO: 20811 - DNA, 201 bp, Homo sapiens
tgtagatggtctcgatctcctgacctcatgatctgtccgcttcggcttcccaaaatgctgggattacaggcgtgagccacttcgccctgcccccccccccttttttttttttttttgaaacagggtctcactttgtcacccaggctgaagtgcagtgcgcatgttcccagctcactgcagcctccacctcctgggctcaag

SEQ ID NO: 20812 - DNA, 201 bp, Homo sapiens
ttactctttcatcattaagaattatgttaggggccgggtgcagtggctaatgcctgtaatctcagcactttagggggccgaggcaggcaagggattgcttragttaagaacttcaagaccagcctgcacaacatggggaaaccccatctctgccaaaaaaaaaaaaaaaaaaaattatctgggcatggtggtgtgcacctg

SEQ ID NO: 20813 - DNA, 201 bp, Homo sapiens
gtctgagtgtgatttgtgtggccgcaggagcagtgaacatctccaaaaagacaatatgagcaaagatttccttaaaaatttatatatgacattgaaatttwaaaaaattttgaaatttaaaatttaaattttatgtaagaaatttatttaatagaaaaaacttaaaatgcatattagcataaagaaaaatggaatcaagag

SEQ ID NO: 20814 - DNA, 201 bp, Homo sapiens
aaaggaatggagatgagtataagaatgggagggaggaaaagggatatgaaaaaagatggtacagtaaaaaaggaaggaaatatgtactaaaggagaacaaragacaggaataaaaaatgagaaccaatcaaaaaataataaatgaccatggaaggtgaatttatgtttgcattcatttttgactgagttagccatcataat

SEQ ID NO: 20815 - DNA, 201 bp, Homo sapiens
gttgctccagaaacagacctacatatattacattcacttgatgtacagtaaagatgacactggagtgtggctgagaaagggtgatgtgtttttttgtgggttttttttttttttttgagacagagtcttgctctgtcgccaggctggagtgcaggggcacaatctcggctcactgcaacctccgactccctggttcaagtg

SEQ ID NO: 20816 - DNA, 201 bp, Homo sapiens
tttaatgaatgttgctaggtctagggggaaaaattaatcttgactttctatcttacaccatatacaaaaatcatttctggatgaattgtagatctaaataygagggtaaaataatgaaacttctttttttttaataatgaaacttctattagaaaacttcagagaataatgtcacaacttggaatggggggaaaatcctaa

SEQ ID NO: 20817 - DNA, 201 bp, Homo sapiens
attttttgagctgttatactactgtgctaggcttctttcttaaattcctacttcacattaattatctcatttaacatttggctctgaggtatattctattwtttccattttgcagatgagaatataaagtcgtagaagtttaaatacatgcttatttctcacagtaagaaatgctgagaccagcattaaaactcagctcat

SEQ ID NO: 20818 - DNA, 201 bp, Homo sapiens
tataaagctataatcatttgaaacattgtataattggcacagggagaaacagagatcagttgctccagaaacagacctacatatattacattcacttgatrtacagtaaagatgacactggagtgtggctgagaaagggtgatgtgtttttttgtgggttttttttttttttttgagacagagtcttgctctgtcgccagg

SEQ ID NO: 20819 - DNA, 201 bp, Homo sapiens
gtgtgttggaatttaacttaggtatttgactgctgaaaactatgatcaaagttggtcattacttaggtgattaatttgggaaagaagtgactaaactgaamtatacttaacattttcgttatggtattgactactgtagtgattttctgtgtctacctttgtttacattttttatttcatcaagataaattccaaaatgta

SEQ ID NO: 20820 - DNA, 201 bp, Homo sapiens
cagaaggcagttatgtcaagaattgtgctcagggcaggatttcgtttccacagaggagagacacttgcagagtgccagctaggttagatcttttgccgctwctttcatttgattaatttgggtttttaaagggctgtttaaaaaaaaaaaaaaaaggccgggaaactttaaaagtaggcattactgtagtactgcatttct

SEQ ID NO: 20821 - DNA, 201 bp, Homo sapiens
aatttttttaaaacaaatggaacaacatagttaagctttaaggaatgtaatattactttagctttggtcagtttgagaagtaggcaaaacttaaatacttyttttgttttcagagatgaagtctccctctgttgcctaggctggagtgcagtggcatgatcatagctcactgcagcctccacctcctgggctcaagcaatc

SEQ ID NO: 20822 - DNA, 201 bp, Homo sapiens
tcaaaaactgtagaaaatgtactctgaaacaagataagtttctctactctttgacttgttaacctgccttcctttaatgtagggccccctgaaaaattatkttacattctacagaagatgaaacattcattcagttgggtctagatataatgctttgttttacaaattatttcacaccatattcttttggaaaaatactca

SEQ ID NO: 20823 - DNA, 201 bp, Homo sapiens
aagacaagcccaggaatgaatttaagaagatgtagaaaatcccatatgaggaaatcattcaaagcactacggaggatacaaaggtttgtgaaatgggaagrcgtatcttttttcttcctaggtgaaaagagtaaacatggtaaataatatcaaattgttcataagttaacataaacacttcagagaactctcctccctcta

SEQ ID NO: 20824 - DNA, 201 bp, Homo sapiens
ctaaatttgagtacgtttcagttatcatttcttcaagtagtgtttgagccccactccctttcttccttctttatgaaactttgatggtgtgaatgttggatttttttttttttattgccctgtagttccctaaagctactacttttttcaatttattttcttctcttgttcagattgggtgaattctacttttctgtcctc

SEQ ID NO: 20825 - DNA, 201 bp, Homo sapiens
tggcctgtgtggatccctgagtcagggttgtggcctgctcagagaatggggcaaaacggagctgcatgctgccttcctctgcaaaccagcctgtttgctgkgggtaacggtgggtgtctcttcagagcagggcatggcagagtgaaaatgcgagcagaggagagagcaacaatttttaagtgtccattttagtagtgcaaa

SEQ ID NO: 20826 - DNA, 201 bp, Homo sapiens
agcatcttcatttcaaaatttatgtctattggtgttacattgaactttgaagatgtttactttttttctgactcctagaatattgctaagagtaatgttaratatatcttaatttgaaaatgaccttacctgtggtgttatgttagagtagacatttattaggaggtggaggatctggttgatggcttttgtttttgattt

SEQ ID NO: 20827 - DNA, 201 bp, Homo sapiens
agctccacccagcaacataggcaggcagtatttatacacagaaaaagcaagtgacaagcagaaatagcttgattggttaccgcttggcatttgccttatayggacatggtcttatcaggtggcagtctgtaattggttgaggcttggctactgtgatttgctgagactcagctacttgttacaaaaatatactcttaaatt

SEQ ID NO: 20828 - DNA, 201 bp, Homo sapiens
ttttttttaataatgaaacttctattagaaaacttcagagaataatgtcacaacttggaatggggggaaaatcctaaacaggatatagaaagtactaatcwtaatggaaaaattggtattttgggtcacattattgttaagaccttttgttcattaaagacaccatcaagaaggtgaaaaaccaagcctgatgaatatgta

SEQ ID NO: 20829 - DNA, 201 bp, Homo sapiens
ttcatcatttcaaaatattttattagatagcactatattagaaagcctctcaactcagaaacaaaatttatttcagcaattaaaaaaactatttggcttayccattttacacttatcagacccattcaggaggatttagcaaatcataaatttttatggtctttattttttcagtttggtggcaagcatgttaagaggaag

SEQ ID NO: 20830 - DNA, 201 bp, Homo sapiens
agatttggctaacagaagccttttcaagcaggttttatgttcttggacatatctcgtcagtcgttgagtacttctttgctttttggcacattatgttctargcttatcttgtcctttttctgctttagttctggagtcagccatttctccaaggaccccctagttcattttagtggagaatggtatttagaagccaaggtc

SEQ ID NO: 20831 - DNA, 201 bp, Homo sapiens
ttttaagaacctccagggtaggaaattccataaaatctttagtttgttaactatgctcagaatacttactgtcaggaagttttcttcctgtgtatagcctrtactctgtttttgttttgagtgtgctaaaaattttccatatgattttatctatcttttttgtcagcttttctctgtcactggtaatcttgctgggaatct

SEQ ID NO: 20832 - DNA, 201 bp, Homo sapiens
gtcaggaagttttcttcctgtgtatagcctatactctgtttttgttttgagtgtgctaaaaattttccatatgattttatctatcttttttgtcagctttkctctgtcactggtaatcttgctgggaatcttgctgattttataaccataatcgtttctattgtttttggccactagaattttatgttgaatttatataat

SEQ ID NO: 20833 - DNA, 201 bp, Homo sapiens
tctcaaggaatttgtagtatttacaatttttttttttttgagacggggtcttgctctgttgcccaggctggggagcagtggtgcgatctcagctcactgcwgcctccgcctcctgggttcaaacaattctcctgcctcagcctcccaagtagctgggattacaggagcgtgccaccatgctcagctaatttttgtattttt

SEQ ID NO: 20834 - DNA, 201 bp, Homo sapiens
tatgcctgtaatctcagcattttgggaggctgaggcaggcagattgcttgagctcaggagtttgagaccagcctaggcaacatggcgaaaccttgtctctrcaaagataaaaaaattagcggggcatggtggcacatgcctgtagttccaggtgcacgggaggctgaggcaggagaatgacttgaacccagaaggcagagg

SEQ ID NO: 20835 - DNA, 201 bp, Homo sapiens
cccgcgccggtccgatttatgaagcttgttacttcaagtattagaaaagtaaaatggaaagatggtttagagaagatttcttttgggaacaatataaaacaagcaaggcaagaaaaaactaaaatgagtaaattagggtgtggaaaagttagagtaagaggaaggattaaggcggaggctactgaaagagatttcttactg

SEQ ID NO: 20836 - DNA, 201 bp, Homo sapiens
gagatttcttactgtcaggctgtgtgataatacaaagctgtgttctgcagcgttttgttggatactattgataactggttctttaaggaaaggggcttaarcaggccttggtttgtagaggtgaggatattgacaagcatcattaaatgtaatatttttattaaagaaacttggaagtagggagccctcatattccctggg

SEQ ID NO: 20837 - DNA, 201 bp, Homo sapiens
gactctgggtctcttatgcccagtctggtgaccaatcccagaatagactaaggaaactgggtgtttgtctgtttggtggaaaatagggctgagccaaaaartgaacgtgtgaacgtttacttttctgttaaaacatttaaaagtaatttctccacactggatttctttggcctttctttaaaaacagaggacttgagtata

SEQ ID NO: 20838 - DNA, 201 bp, Homo sapiens
ttttaaattttttacagagatggaaacttgctaggttgcccaggctggccttgaactcctggcttcaagccagtcttttgcctcagcctctcaaagtgttrggattacaggtgtaagtcaccacagccggtttccagctgactttaataacataaccagtctcctaacactcttaatatagttctgtctgacctttgatgt

SEQ ID NO: 20839 - DNA, 201 bp, Homo sapiens
tggtcagcacgctgagggggttccactggcatctagtgggtagataaacctcctacaatgcatatgacagtccccatgacaaagaaattatccactgcaamatgtcagtagtgctgatgttgacaaaaccctgatctgatgtattgagaataacattctcccaaatgatttaaacctatgaaagttatttgtaatctaatt

SEQ ID NO: 20840 - DNA, 201 bp, Homo sapiens
ttgtcacaaatgacaggctttccttttttaagctgaataatatttcattatgtacacacacaccccccacattttctttatccattcatccattgacagaygcttgggttgtttctatatcttggctattgtgaataatgctacagtgaatgttcagatatctctttaagataatgatttcagttcctttggatatatagc

SEQ ID NO: 20841 - DNA, 201 bp, Homo sapiens
tgtttaattttttttcctaaaaacaaaacaaaaaaagtgaactgagttttccaggctctgaatgtctgagtgtgatttgtgtggccgcaggagcagtgaamatctccaaaaagacaatatgagcaaagatttccttaaaaatttatatatgacattgaaatttaaaaaaattttgaaatttaaaatttaaattttatgtaa

SEQ ID NO: 20842 - DNA, 201 bp, Homo sapiens
aattttgaaagctgagctggggagctgataatgaatactataggcaacagtctgttgccaattcctcactgaggaaatgttaaggaaatagttttatattmatttatttgtagaagaatacattgggagatgataatgctctaagtcagtgaggttggtatggttaattggagggaagtggatgtcactgggtatgggtgc

SEQ ID NO: 20843 - DNA, 201 bp, Homo sapiens
ctaatagaacctaactcttctgaatgcctttcagcatcatccaaagcttgaacttctatttctggattaaaaattcattcacaaatgagctgtgcaatacratcactttttctgactttaaacttttttttgccaaaattaaacagtacagcaccaacatttcctcagtaatcttcatctatcaataaagtgttttgcagc

SEQ ID NO: 20844 - DNA, 201 bp, Homo sapiens
aggaaaagatataggatccctgttaataggatgtaaacttcatgagggcagggacttcattttgttcacagctgtatcctaagagcctggaataggagacrtaatagatcctcagtaaatattttatgggttaatgaatgggttagtaaataaacaagtaacccaggctgagtgcagtggcatgatcatggctcactgcag

SEQ ID NO: 20845 - DNA, 201 bp, Homo sapiens
gctcactgcagcctcaaactccttggctcaagtaatcctcccacctcagccttcctagtgtctgggtggcatgcaccaccatgcctggctaacaaaaaaawttttttttttttgtagagctggggtctcactatgttctccaggctggtctcaaactcctgggctcaagtgatcctctcaccttggcctcccaaagtgttg

SEQ ID NO: 20846 - DNA, 201 bp, Homo sapiens
gaggcatgagaatcgcttgaacctcaggaggcagaggttgtggtgagctgaggttgcgccactgcactctagcctggttgacagagtgagactctgtctcaaaaaaaaaagttttcctgctctcatttgctgtttcatcctaagaaacttgagaaatagactactttaaatattacagtgtatataaatgtgtaatttcat

SEQ ID NO: 20847 - DNA, 201 bp, Homo sapiens
catttttatagttaactcttatttttttcttccctcatgtggtgagaaagtcctttttaaaaagatcatactgtaatatgatttttttgatggctttttaraaatttgtgatttgaaatcataatcatcattattatttatatttttgtatacttttggacttattagtgtgttggagccagcttgagctggcttgcaaga

SEQ ID NO: 20848 - DNA, 201 bp, Homo sapiens
attgttgggttaacattaatgaaatctaagaatttttttcagtaaaatataacaatattatctaaatcccatgttgtatatattatataggtcttttccamctccttagtaactgaatgagagagaggatatttttaattccttctctttattctgaaatgtatctctcttttcatttattcaacaaataatttgagtgcc

SEQ ID NO: 20849 - DNA, 201 bp, Homo sapiens
gaggctgaggcaggcagattgcttgagctcaggagtttgagaccagcctaggcaacatggcgaaaccttgtctctgcaaagataaaaaaattagcggggcrtggtggcacatgcctgtagttccaggtgcacgggaggctgaggcaggagaatgacttgaacccagaaggcagaggttgcagtgagctgaaatctacactc

SEQ ID NO: 20850 - DNA, 201 bp, Homo sapiens
gagcatatagcacaagccttcaaatctgttttcattttaaaatgtacagccctctttttttgatacaggtgtatcattaggactgactggttttacatttrttagccatatttaggattatttttaaattttcaattggaatgggaaggtagagagattttcctggtaaggctttgagaaaacagagggaggaaggtagct

SEQ ID NO: 20851 - DNA, 201 bp, Homo sapiens
tggttttacatttgttagccatatttaggattatttttaaattttcaattggaatgggaaggtagagagattttcctggtaaggctttgagaaaacagagrgaggaaggtagcttaagaagatacatttaaacacatgaaaaagaaagaatggctgaggagaaattcactgagatatgagtaacagatagaaaattggaaa

SEQ ID NO: 20852 - DNA, 201 bp, Homo sapiens
tataaaagcttaacactatatatcaaaatatcccaataaagacataaaagagatcatttatatgtgtgtatatatgtatataattaaagtatggtgtaattaaatatataaattgataaaaacctgatatatataaaaatattaaaccatacttaaattttttttgtttaggaggataggggaagtcatccagaagattga

SEQ ID NO: 20853 - DNA, 201 bp, Homo sapiens
ataaaagcttaacactatatatcaaaatatcccaataaagacataaaagagatcatttatatgtgtgtatatatgtatataattaaagtatggtgtaattaaatatataaattgataaaaacctgatatatataaaaatattaaaccatacttaaattttttttgtttaggaggataggggaagtcatccagaagattgat

SEQ ID NO: 20854 - DNA, 201 bp, Homo sapiens
taaaagcttaacactatatatcaaaatatcccaataaagacataaaagagatcatttatatgtgtgtatatatgtatataattaaagtatggtgtaattaaatatataaattgataaaaacctgatatatataaaaatattaaaccatacttaaattttttttgtttaggaggataggggaagtcatccagaagattgatt

SEQ ID NO: 20855 - DNA, 201 bp, Homo sapiens
ggagttggttcctgtcggtgggttcgtggtctctctaacttcaagaatgaagccatggacctttgcgttcagtgagtgttacagctcttaaagatggcacrgacccaaagagtgagcggtagcaaggtttattttgaagaaaggacaaagcttccacagtgtggatggggacccgagcggattgctgctgctggctggcgt

SEQ ID NO: 20856 - DNA, 201 bp, Homo sapiens
aaaagcttaacactatatatcaaaatatcccaataaagacataaaagagatcatttatatgtgtgtatatatgtatataattaaagtatggtgtaattaaatatataaattgataaaaacctgatatatataaaaatattaaaccatacttaaattttttttgtttaggaggataggggaagtcatccagaagattgattc

SEQ ID NO: 20857 - DNA, 201 bp, Homo sapiens
ccttgagaaatctccagactgtttttcacagtcgctgaaataattcacgtctaccaataatgtataagtgttcccttttctctgtagcttcgccaacatgtttttttttttttgacattttaataatagcccttcttagggatgtgagatagtatctcattgtggtgttcatttttttttttaaagatgatgttgctatgt

SEQ ID NO: 20858 - DNA, 201 bp, Homo sapiens
taaactagaactcatttttttttcacagtatatttacttgaagaagcactataataatcattgagaagtattttgagtctgaaatttaatttaattttccrtttcaaattgctttatttcagggaaataattttccagttgttttgctatattctgcaaataaaaaccgtgtttccttttttcacttaaactttggtagga

SEQ ID NO: 20859 - DNA, 201 bp, Homo sapiens
gtaccagtaccatgctgttttggttactgtagcctgtagtatagtttgaagtcctggttttgttcttttttggctaggattgctttggcttttggggctgttttttttttttttggttctatataaattttagaatagttttttctatgtctgtgaaaaatgatattagtagttcgataggaatggtggtgaatctgtaga

SEQ ID NO: 20860 - DNA, 201 bp, Homo sapiens
gtagagtttttaaactgttactgacatttaagaaaatagtggaaaaggtatggaaaatagatgaaaagagaaataattttaccagagaattgcagtttgtaaaaaaaaaaaaaaaaaaaaaaaactggaagttctggaactgaaaacataataactgatataaaaaacattgcacataagtttaatggaagattagagaca

SEQ ID NO: 20861 - DNA, 201 bp, Homo sapiens; identical to SEQ ID NO: 3477

SEQ ID NO: 20862 - DNA, 201 bp, Homo sapiens
tagagtttttaaactgttactgacatttaagaaaatagtggaaaaggtatggaaaatagatgaaaagagaaataattttaccagagaattgcagtttgtaaaaaaaaaaaaaaaaaaaaaaaactggaagttctggaactgaaaacataataactgatataaaaaacattgcacataagtttaatggaagattagagacaa

SEQ ID NO: 20863 - DNA, 201 bp, Homo sapiens
gtttaaccatttgagtaacttccagactatgtttcaaagcagctttaccattttacatttctatcagcagtatatgagggttccagtttctccatatcctygataacacttcatactgtctttttgattatagctatgctggtgggtgtgaagcagtatttcatggtttgattagcatgtctctgttggctaatgctgtgg

SEQ ID NO: 20864 - DNA, 201 bp, Homo sapiens
cttggacatcattttccagtctgtcttggttcttaacagcgctgccattttgtactctgtggtgtcagctgcctaaggtctctacaagataaagggtcttyacagggagctcagagtggcttattactccacgtattttcttttctttccagttggatagaggttccttgaagctgaaattaattgtttagtttttttttc

SEQ ID NO: 20865 - DNA, 201 bp, Homo sapiens
tttgtcttcacaaggacccacaatccagtgattctacctccttttcactatccctcattttcctcatatcttcattttccttatttaatttaaattgtcawcatttatcatattcactaccttgcttacattcatacccttgccctctcatacatagtacttacgttggctaaattacagccataagtaaatttaatgatc

SEQ ID NO: 20866 - DNA, 201 bp, Homo sapiens
agagtttttaaactgttactgacatttaagaaaatagtggaaaaggtatggaaaatagatgaaaagagaaataattttaccagagaattgcagtttgtaaaaaaaaaaaaaaaaaaaaaaaactggaagttctggaactgaaaacataataactgatataaaaaacattgcacataagtttaatggaagattagagacaac

SEQ ID NO: 20867 - DNA, 201 bp, Homo sapiens
cccagtgcaatgaagtatttttaaattgtgataatgtacattggttttttttagacgtaatgctattttacacttaataggctatagtataatgtaaacayaacttttacatgttttacatgcactgagaaacaaaaaaatttgtgtgacttgctttattgtgatgttagctttattgtggttgtctggaactgaacctgc

SEQ ID NO: 20868 - DNA, 201 bp, Homo sapiens
gagtttttaaactgttactgacatttaagaaaatagtggaaaaggtatggaaaatagatgaaaagagaaataattttaccagagaattgcagtttgtaaaaaaaaaaaaaaaaaaaaaaaactggaagttctggaactgaaaacataataactgatataaaaaacattgcacataagtttaatggaagattagagacaaca

SEQ ID NO: 20869 - DNA, 201 bp, Homo sapiens
ctggcttgtttcacttataatgttcttaaggttcatccatgttgtcaacgttatagaatttccttctttaaggatgaataatgttccattgtgtgtgtgtrtatatatatggactgctgccagtcggaggcctgttacagattgggctgcacagcaggaagtgagtggcaggtgagtgagcattactgcctgagctctgcc

SEQ ID NO: 20870 - DNA, 201 bp, Homo sapiens
ggatttttttttttttattgccctgtagttccctaaagctactacttttttcaatttattttcttctcttgttcagattgggtgaattctacttttctgtyctcaagttcaacgattctcttccccatgatttccattcccccccccgccccgaaacagagtgtggctctgtcacccaggctggagttagtggcacgatct

SEQ ID NO: 20871 - DNA, 201 bp, Homo sapiens
tgcccacgctggtcttaccctcctgagcagaagtgatcctcctgcttcatcttcccaaagtgctgaaattacaggtgtgagctactgcagctggctttgcttttttttttttttttaaatttttctgtagtaggtatctgaagactatgcttctttttttaataacttctgtttctttgctgagattttccattttttcac

SEQ ID NO: 20872 - DNA, 201 bp, Homo sapiens
catggagctactcttctgtaacatccagaaggaagagctatctgaatgtccattttccctagagctttctccataggtggtattgtatcatcataggcacygttgaggtcatagcctgtggcctgtgtggatccctgagtcagggttgtggcctgctcagagaatggggcaaaacggagctgcatgctgccttcctctgca

SEQ ID NO: 20873 - DNA, 201 bp, Homo sapiens
ccagaaaagattttagactttggtatcagaaagattgaattatgtaaaataaggaaaatttaatgaaaagaaacagagaagtagatataccagacatttgycatgctttcttctacatgttaccttgatttaggaagaagtagctttaaagatgaactgattataagacggaggatgcaaacaggaagtatggaatagtaa

SEQ ID NO: 20874 - DNA, 201 bp, Homo sapiens
cattcacttattggttgagggacatttgggccgtttcctcttttggccattgtgaataatgccgctatgaatacttgtgcatgagtttttgtgtgaacttmacatttttagttgtcttgggtatgtgcttaggggtgaaattgctgggtcatatttaacattttcatggtctgcaaaactgttttccaaagcacttaatac

SEQ ID NO: 20875 - DNA, 201 bp, Homo sapiens
atctgtatacatatataaaaagatatatatctttacatatataaaaagatatcttgatgtatgtatataaagatatatatatctttatatgtatatatacwtataaatatgtatatttatatacatatataaaaagatatatatacatatataaagcaagtatatatatatatactcatatatatagtgtcatttcactat

SEQ ID NO: 20876 - DNA, 201 bp, Homo sapiens
aatgtaactggcatcctccaaataacagagtgctttggatcagaagtaatttgtgaaatctagcttttttcttttacctgttttcagaacaagttcctttkagtgcttctcttggcttacaagtgaagtttcattttagattgaatgggttctgttacaaagtcaggggaagaggtattactgaatttgtgagaatatttt

SEQ ID NO: 20877 - DNA, 201 bp, Homo sapiens
ccttggaaagagggtattacatacgcacataacaaaaagacaggaaaatggactgtgcctgtattcatccttttctttccaatagcatatgctaatccttwtcatttttataaagcaaaatatatttgacaaatgaaattggaagttacaactttcaaaagccatttattttagagattcttatggcaaagcaattcatta

SEQ ID NO: 20878 - DNA, 201 bp, Homo sapiens
aattagccaggcatgatggagggttcctgtaatcccagctactcgggaggctgaggcaggagaatcgcttgaaccggggaggcagaggttgcactgagccragattgtactatcgcactccagcctgggcaactgagtgagactctgtctcaaaaaaaaagtaaaagtaagtttggcaagtttttggccaatattttatta

SEQ ID NO: 20879 - DNA, 201 bp, Homo sapiens
gatcctcccacctcaggcttctgagtagctgggactgcaggtgcacgccaccacttgcagctaatttttgcttttttttttttttttttttggtagagacygggcttcaccatgttgcccaggctggtctcaaattgctgggctcaagcgatccacctgccttagtctcctaaagtactgggattacaggaataagccact

SEQ ID NO: 20880 - DNA, 201 bp, Homo sapiens
gaaccggggaggcagaggttgcactgagccaagattgtactatcgcactccagcctgggcaactgagtgagactctgtctcaaaaaaaaagtaaaagtaartttggcaagtttttggccaatattttattaattttttttttctgctctttctcttctttcctggtactcaaaatgttggtaagctgaatgttgttccata

SEQ ID NO: 20881 - DNA, 201 bp, Homo sapiens
aagcgggcggatcacgaggtcaggagattgagacaatcctggctaacaaggtgaaaccccgtctcaactaaaaaaatacaaaaaattagccgggcgtggtrgcaagcgcctgtggtcccagctactcggaggctgaggcaggagaatggcgtgaatgcgggaggcggagcttgcagtgagctgagatcgcgccactgcact

SEQ ID NO: 20882 - DNA, 201 bp, Homo sapiens
ttgtttagtttctagtaattgtgtggttttgagggttcttcttggtattgatacctatttttattccaatgtggtctgagaatgtgcttggtatgacttcmatttttttgaatttattgagacttgatttatggcccaacaagaggttgatcttagaatatgttctgtgtgcaaatgagaaaaatgtattttctatggttg

SEQ ID NO: 20883 - DNA, 201 bp, Homo sapiens
cattgagatctccaaatataattgttgaatttttaatttttcctttcaataatgttagttactgcttcattattttgggactctttttaggtgcatacacrgttattatatcttcctgatgttttgactgtttattattacgaaatatctttctttgtctctatagtcttaaagtctgttttgtctgatgttaatatagcc

SEQ ID NO: 20884 - DNA, 201 bp, Homo sapiens
cacagggagctcagagtggcttattactccacgtattttcttttctttccagttggatagaggttccttgaagctgaaattaattgtttagtttttttttcccttccaaatcagtcttccatgtgagtaataagatttaaaggaagcattctttctttcctcctctcttctgtgtagtatccctagcccctgactttccat

SEQ ID NO: 20885 - DNA, 201 bp, Homo sapiens
ttggtacatgaaaaaggaataataaaaagtcaaaattagtcttcttcatgaagatcctttcttatttcattttccaaattccaggtaagtttcttaccagaaaaaaaaaaaatatatatatatatatgtgtgtgtgtgtatatgtatttctctctctctctctctatatatatatatatatataaaagatcttactatcta

SEQ ID NO: 20886 - DNA, 201 bp, Homo sapiens
catgaaaaaggaataataaaaagtcaaaattagtcttcttcatgaagatcctttcttatttcattttccaaattccaggtaagtttcttaccagaaaaaawaaaaatatatatatatatatgtgtgtgtgtgtatatgtatttctctctctctctctctatatatatatatatatataaaagatcttactatctacatagt

SEQ ID NO: 20887 - DNA, 201 bp, Homo sapiens
tgaaaaaggaataataaaaagtcaaaattagtcttcttcatgaagatcctttcttatttcattttccaaattccaggtaagtttcttaccagaaaaaaaawaaatatatatatatatatgtgtgtgtgtgtatatgtatttctctctctctctctctatatatatatatatatataaaagatcttactatctacatagttc

SEQ ID NO: 20888 - DNA, 201 bp, Homo sapiens
tttgtcatagacttttcagtttattgttggtgtgtccggagttggttcctgtcggtgggttcgtggtctctctaacttcaagaatgaagccatggaccttygcgttcagtgagtgttacagctcttaaagatggcacggacccaaagagtgagcggtagcaaggtttattttgaagaaaggacaaagcttccacagtgtgg

SEQ ID NO: 20889 - DNA, 201 bp, Homo sapiens
aattttaaacgtgtgtctgttaagcagaaatggacagaacaaaatgaagtagacagattcacatagtggttacctatgataatgtgtttatcaataatcartagtacaagagaccaaagtatctgtgagatagaataatctgtgagatctgaataacacaaccatgacctgagtgacatatatagcccatgtacccaacag

SEQ ID NO: 20890 - DNA, 201 bp, Homo sapiens
tgctaattttaaaaaattttttgtagatacagggtccactgtgtcacccagactggtcctgaacttctagactcaagtgatcctcccgcctgaacctctcraagtgctgggatcagtggcttgaggcagcacacctggttgacttttttgttaaaggaaatgccgtagtgttgcttttagttaaataaactgttaattatt

SEQ ID NO: 20891 - DNA, 201 bp, Homo sapiens
acagggtccactgtgtcacccagactggtcctgaacttctagactcaagtgatcctcccgcctgaacctctcgaagtgctgggatcagtggcttgaggcascacacctggttgacttttttgttaaaggaaatgccgtagtgttgcttttagttaaataaactgttaattattggttcatctattagaatgtagcaagtaa

SEQ ID NO: 20892 - DNA, 201 bp, Homo sapiens
tctggagagttttagtgtgggaaatctggaaatgcattaaaatgacccttgaatgttttttctagggttctgtggcaattcttttttttttttttttttgrgacggagtctagctttgtcgctcaggctgaagtgcagtggcacgatctcggctcactgcaacctctgcctcctgggttcaagcaattctcctgcctcagc

SEQ ID NO: 20893 - DNA, 201 bp, Homo sapiens
ccacaagaagagtcagctatttcttctggtagacaggagaaaggtaatggcagataatttacgttctttttaagtagccctctgccactaggcttaaatgrctagagggttacctaagccactgcagttaggcttttacacagctgaactaaacacgtgtcaataggaaggatgttaggtgtgtgggggggttgggagtgg

SEQ ID NO: 20894 - DNA, 201 bp, Homo sapiens
agttaaattatatagggttttttggggtctgtaattgatgtacatttgattttaaaaagacactgtcttatatcaggacaaagcagatttacatacaactrtcagcagaaaaaatttctgtgtgatctgaacagaggtactcttttctttgatcataagaaaatgcagtacttttagaaggtaaagctattaagattacag

SEQ ID NO: 20895 - DNA, 201 bp, Homo sapiens
cgggcggatcacgaggtcaggagattgagacaatcctggctaacaaggtgaaaccccgtctcaactaaaaaaatacaaaaaattagccgggcgtggtagcragcgcctgtggtcccagctactcggaggctgaggcaggagaatggcgtgaatgcgggaggcggagcttgcagtgagctgagatcgcgccactgcactcca

SEQ ID NO: 20896 - DNA, 201 bp, Homo sapiens
gggcggatcacgaggtcaggagattgagacaatcctggctaacaaggtgaaaccccgtctcaactaaaaaaatacaaaaaattagccgggcgtggtagcargcgcctgtggtcccagctactcggaggctgaggcaggagaatggcgtgaatgcgggaggcggagcttgcagtgagctgagatcgcgccactgcactccag

SEQ ID NO: 20897 - DNA, 201 bp, Homo sapiens
ctcaggcctgtaatcccagcaggctggcaggctgaggctggtggatcacgaagtcaggacatcgagaccatcctggctcacacggtgaaaccctgtctctrcatacaaaaaaaattagccgtgcgaggtggtgggcccctgtagtcccggctactcgggaggctgaggcaggagaatggcgggaacctgggaggcatagct

SEQ ID NO: 20898 - DNA, 201 bp, Homo sapiens
gacactagtaacaacttaatacttgctaaataaattaatgactggggtgccatttggcatattattggtctacattttttttaactatagaaaatattgakcatgagtttcttacaggtaagttacagattatttgaaagaagtatgtacatgtaatcagaggtccacactcagggatgctctgagataagctatgtcaga

SEQ ID NO: 20899 - DNA, 201 bp, Homo sapiens
aaaaaggaataataaaaagtcaaaattagtcttcttcatgaagatcctttcttatttcattttccaaattccaggtaagtttcttaccagaaaaaaaaaawatatatatatatatatgtgtgtgtgtgtatatgtatttctctctctctctctctatatatatatatatatataaaagatcttactatctacatagttctc

SEQ ID NO: 20900 - DNA, 201 bp, Homo sapiens
aaacaaaaaaccccagaaaacttaggttcaacttattccaactgctgtcatctacctggaagaagaccagacactagtaacaacttaatacttgctaaatraattaatgactggggtgccatttggcatattattggtctacattttttttaactatagaaaatattgatcatgagtttcttacaggtaagttacagatta

SEQ ID NO: 20901 - DNA, 201 bp, Homo sapiens
tgtaatctcagcactttagggggccgaggcaggcaagggattgcttgagttaagaacttcaagaccagcctgcacaacatggggaaaccccatctctgccaaaaaaaaaaaaaaaaaaaattatctgggcatggtggtgtgcacctgtagtctcagctgcttgggaggctgaattgggaggatcacctgagtccaggaggc

SEQ ID NO: 20902 - DNA, 201 bp, Homo sapiens
tttgagaactcattcactatcatgagaatagcatgggggaactgctcgtgtgatccaatcatcttcctcccttgacatgtggggattacaggtccctgtcktgatatgtggggattacaattcgagatcaaatttgggtggggtacagaaccaaatcatatcatttaccttgctagaacctctactgtagtgttgaataga

SEQ ID NO: 20903 - DNA, 201 bp, Homo sapiens
ctacatggtatcaacatcaatagtcaattaaaaaacaaggcagatgatttcaagtggttttccttggctattgatgagttgacagatggtaccaattactrtgatctgtttctacccacttctgacaccaagtgtgtgggtttttcctcataccaacaaacacttctccaactctttggacaccagccggctgtcctatta

SEQ ID NO: 20904 - DNA, 201 bp, Homo sapiens
gtaatctcagcactttagggggccgaggcaggcaagggattgcttgagttaagaacttcaagaccagcctgcacaacatggggaaaccccatctctgccaaaaaaaaaaaaaaaaaaaattatctgggcatggtggtgtgcacctgtagtctcagctgcttgggaggctgaattgggaggatcacctgagtccaggaggca

SEQ ID NO: 20905 - DNA, 201 bp, Homo sapiens
ctttgttatctttactgattagttatagtagttatgttgtagattccttaggtttcttcactattgtattgtccatatgttttacttactttccaatctgyatctcttttatttctttttcttattgcactgtctggggcctacaaaacaatgatgaatagaagcgatgcaagtagacatgtttgctttgttccagatctt

SEQ ID NO: 20906 - DNA, 201 bp, Homo sapiens
tgaggcaggagaatggcgtgaatgcgggaggcggagcttgcagtgagctgagatcgcgccactgcactccagcctgggcgacagagcgagactccgtctcaaaaaaaaaaaaaacatgaatggatatttaacttcatcaagtacttcttctgcatcgattgaaatgatcatatgaatatcctgtcattattctcttaatat

SEQ ID NO: 20907 - DNA, 201 bp, Homo sapiens
ttaatgctgtcggtgacctaacaggaggcagagctcaggcattaatgcaagcagtggggacagtgtgtaaatacagatgaagctttgcttgctcactggcygctcacctcctgatgtgcagccgggttcctaacaggtcacggcttggtgctggtccacggcctgggagttggggacccttgcagcatgtgtagatttgtg

SEQ ID NO: 20908 - DNA, 201 bp, Homo sapiens
tagtgttcctgtcagtttattgatctcttctaatttttaaggtattttaatatattaaggatatggagtttttgactgatgttacaaatacttttcaccarttgattcttaaggatttccaaataaatggacagaataatgaaattttagcattaagagacttgtttcatttagttttagtttgttttctaagaaatgtga

SEQ ID NO: 20909 - DNA, 201 bp, Homo sapiens
gaattatttcctttctgagtttccattttctcataaaattgataatcatactttcctggcaagggttatggtgaggatgtgagaattaaagtatgttaacatatgattaaagtatgttagcagaaatcattagtgtatagctgttgaacttttctgagtagagaattgagccaaggaccgtatattagatagctggcaata

SEQ ID NO: 20910 - DNA, 201 bp, Homo sapiens
gcgggatgggcgtttgcctaacgtatttaatggaggtaattcagcattctttgagtcaatctttaatttttacctgtaatggatgcccatgttactacacrtacttacaataactgttgggtataagtgtgcatttatggccaatcccttttctttttatattcatataaataacatggtatcactattataaatattata

SEQ ID NO: 20911 - DNA, 201 bp, Homo sapiens
aattatttcctttctgagtttccattttctcataaaattgataatcatactttcctggcaagggttatggtgaggatgtgagaattaaagtatgttaacatatgattaaagtatgttagcagaaatcattagtgtatagctgttgaacttttctgagtagagaattgagccaaggaccgtatattagatagctggcaatag

SEQ ID NO: 20912 - DNA, 201 bp, Homo sapiens
ggatagcataaaggatattttcatcatttcaaaatattttattagatagcactatattagaaagcctctcaactcagaaacaaaatttatttcagcaattaaaaaaactatttggcttatccattttacacttatcagacccattcaggaggatttagcaaatcataaatttttatggtctttattttttcagtttggtgg

SEQ ID NO: 20913 - DNA, 201 bp, Homo sapiens
aaatttttatggtctttattttttcagtttggtggcaagcatgttaagaggaaggacttatgttctgtattagcaaaacagagcaaattgtaattcacagtgatgtatgctgcattcatcttctagaaaactattgctttgtatcacttgagtgaaaagattttataaagtaggaactatctaaaaaatcatgctctagtc

SEQ ID NO: 20914 - DNA, 201 bp, Homo sapiens
ctgtcttaaaaaaaaaaaaaaagaatctttagataggatactgggatgatatattgaaaggcagggaatttagaaggaggatctaacgtgaaaggaaagatttttttttttggcatattgagttttagatatcaagatgtctacgtagagatattttatagaaattgctaatcctttgtgtatccaagcagttacacacct

SEQ ID NO: 20915 - DNA, 201 bp, Homo sapiens
aatttttatggtctttattttttcagtttggtggcaagcatgttaagaggaaggacttatgttctgtattagcaaaacagagcaaattgtaattcacagtgatgtatgctgcattcatcttctagaaaactattgctttgtatcacttgagtgaaaagattttataaagtaggaactatctaaaaaatcatgctctagtca

SEQ ID NO: 20916 - DNA, 201 bp, Homo sapiens
ttgaagtcattgagaataatggctgaatttgggagcaagcagaattgaagttattgggtaggggaaataggagggtgttctggaggttggtagatgttgcrgaaggaatggtttcagtgagtaatgtgactcccaagcgattttttagtgataggataacagggagtggtcctggggagcaagaagcagcaagtccttttt

SEQ ID NO: 20917 - DNA, 201 bp, Homo sapiens
cgtgtcttgacaatcaaggacttttatgtgagtcttcctttatgatgtttattaatgttatgcattccatttgttttgaagtgagtaccaatgtgctaatktgtattgtctgaaagtatgtaatgtttttacagcttgtttttaagaatctgtaaatatgtacaaacaaatcacagtactgctttatgttagaaggcatat

SEQ ID NO: 20918 - DNA, 201 bp, Homo sapiens
acaggttgaggtatatgatagaggtatgactcactttgtctttgaaacatattttaaaataacactaagtctttgttttaaaataaagaagaaaaacaagmcctagagtcaattctgttactcataccctgttagcttgccgtaacattaaagaaagaaaagatgttggtacatgaaaaaggaataataaaaagtcaaaat

SEQ ID NO: 20919 - DNA, 201 bp, Homo sapiens
aagattgtgccactgcactccagcctgggtgacagagtgaaactctgtctttaaaaaaaaaaaaaaaaaaaaaaattctttgaaccattattgtttagaartgtgttgtttaatatccaagtattttgagatattttctagctaccattctgttattagttgtagtttaattctgttgtggtcttagagcagacgccatat

SEQ ID NO: 20920 - DNA, 201 bp, Homo sapiens
ttgccaattcctcactgaggaaatgttaaggaaatagttttatattcatttatttgtagaagaatacattgggagatgataatgctctaagtcagtgaggktggtatggttaattggagggaagtggatgtcactgggtatgggtgcaggatgttgagaatgaagagaagagtctaaaatgattccaaggagtcagtcatc

SEQ ID NO: 20921 - DNA, 201 bp, Homo sapiens
aaagtatggaatccaccttttaggtttttgttttttttttttttatagaaaagtcaactgattctgattgagattgcattgattctgtatattgacttgaytgacaaaccaacatctaaacaataatggctcccagtccatgaatgtagtacacctttacttttatttaggttttctttatttcagcattgttctgtagtt

SEQ ID NO: 20922 - DNA, 201 bp, Homo sapiens
tcatatcatttaccttgctagaacctctactgtagtgttgaatagaagtagtagcaagagtagacatccttgtcttctttctgatcttagggggaagcacttattattttacttttgaatatgatattagctttgatttttcatagatggcctttatcaggttgaggaagttccctttcctagttgggtgtttttattgtg

SEQ ID NO: 20923 - DNA, 201 bp, Homo sapiens
catatcatttaccttgctagaacctctactgtagtgttgaatagaagtagtagcaagagtagacatccttgtcttctttctgatcttagggggaagcacttattattttacttttgaatatgatattagctttgatttttcatagatggcctttatcaggttgaggaagttccctttcctagttgggtgtttttattgtgt

SEQ ID NO: 20924 - DNA, 201 bp, Homo sapiens
gatgtattttttaagagtcattatcagtttggtagatgaaatatgatagtgctgtttaatggtaatttcttggattactgctgagactcttttttatatgyttaatgactatttctaaatttttaaaaatgatttgcttgatgatgttctgtcagtttattccttactgaattcatctctatttttaacacatttcaatat

SEQ ID NO: 20925 - DNA, 201 bp, Homo sapiens
atatcatttaccttgctagaacctctactgtagtgttgaatagaagtagtagcaagagtagacatccttgtcttctttctgatcttagggggaagcacttattattttacttttgaatatgatattagctttgatttttcatagatggcctttatcaggttgaggaagttccctttcctagttgggtgtttttattgtgta

SEQ ID NO: 20926 - DNA, 201 bp, Homo sapiens
atcaaacatctaaacaaatctctcttctggaaaaataagaaaatgaaaaagcaattacacgtcacatggctgattagcaataaatttcatttgtgactacrgtggcatgagagtttgactcctgacttgctttccttgaaagaaaaaaattatctgcaatactgtctcttgatatagaaaacagacccattccatctgact

SEQ ID NO: 20927 - DNA, 201 bp, Homo sapiens
gaatggtgtcatgaaacaagactggggggaaaagggagaaggcctgctttctagtcgagaaaagcggagaccgtctgaaactctacttgctccaacaggtsaacgtgattgaaaattcagaattcactctcctaatagcaggaaagtgttacaaaagcccacaggccaaatgataccaccctcccaggaagtctcttgcag

SEQ ID NO: 20928 - DNA, 201 bp, Homo sapiens
ttctatgaatgtttaaagtagattctattaaaattataatttcacagatgaggaaactgaggcacaagaagattaaattatttgcctgagagcttagctastgaagagctgagattcaaaccagccactttggctccatggtcctaataaaattacaagcaaggaacaagacaaatcactgtcaaccagcaaaaccgtggg

SEQ ID NO: 20929 - DNA, 201 bp, Homo sapiens
tttctagtcgagaaaagcggagaccgtctgaaactctacttgctccaacaggtgaacgtgattgaaaattcagaattcactctcctaatagcaggaaagtrttacaaaagcccacaggccaaatgataccaccctcccaggaagtctcttgcagaactgtgttttttaatgttatttgtcaagtgaaaacagttacagtgg

SEQ ID NO: 20930 - DNA, 201 bp, Homo sapiens
tacacaaacaagcaaaaggggaggatgagagtggtcattcgggtttgctttggaggtccagagaaaatgcaagtccaacttccaggcacagaccagttgcycgcagcaggcttcctcccattggtctcagaccaaggtgagccactcccccgggcgggacagagaaagctcctctggaagccagacaagctcggccacctc

SEQ ID NO: 20931 - DNA, 201 bp, Homo sapiens
cctgttgctaagcttcaattatcagtttgttgtattgctgcaactcacggatctgaaaaactcataaatgaaaagagagagagacatcagcctgtcaaatrtatgtaataattttaacgtaatttaaggtagcataacaagttattttcaacctgatcacatttctttaaaaaaaaaaaaaaagggtttattgagatataa

SEQ ID NO: 20932 - DNA, 201 bp, Homo sapiens
atgaggaaaggagagcagagagggtcaataacgtgccccggtacaatgcatcagtagacttctaattctccaaccctcatctcagaggggaatggtgtcakgaaacaagactggggggaaaagggagaaggcctgctttctagtcgagaaaagcggagaccgtctgaaactctacttgctccaacaggtgaacgtgattga

SEQ ID NO: 20933 - DNA, 201 bp, Homo sapiens
caaataattccaaagccagtttgagaaagctagtgccatgttaaaaagaaaatggttgaacaaaagtatacaaaacagcaacaacaatgtatttcaaactygcagaatttggacgatggacggatggatggagatacacaattctgaacaaacggcattcgtattatgtaactcttactgaagtagagacctatggtatta

SEQ ID NO: 20934 - DNA, 201 bp, Homo sapiens
ttaatactttgagtcaaataaaaccaaagcaatttaacaaaagaaaacatcatgccgaggaagtatgcttctcttgagataacaatctaacttgttttaaagatcctttgtttactaaccattttatattccaaatatatgttccttcctcagaacaaatcaattcttttccagaccctcggggatgggggtgcaggcatg

SEQ ID NO: 20935 - DNA, 201 bp, Homo sapiens
gatcatgggctcctacctggaatttctctccatgcttcctactttttccaggaagttatcaaaggtcactaagacgctttgaatttggggaaaactcctayaaataaattcatctctccctaattaccattagacttctgttctttaaagttctattgactaaactttggctgacttaaattggtgatgtctcatttacgt

SEQ ID NO: 20936 - DNA, 201 bp, Homo sapiens
ttgttaatactttgagtcaaataaaaccaaagcaatttaacaaaagaaaacatcatgccgaggaagtatgcttctcttgagataacaatctaacttgtttwaaagatcctttgtttactaaccattttatattccaaatatatgttccttcctcagaacaaatcaattcttttccagaccctcggggatgggggtgcaggc

SEQ ID NO: 20937 - DNA, 201 bp, Homo sapiens
gggtgaaattacagctaactcttaaaggagcttgccagagggcaagctggtagtattgtttgctattccaagcagaggggcttccacctgccaagacaaaragacacgaatgagtacagcctgaactgttcaaaatgtctgggaggaagggaggctgaagttctctctcagacagccaaacaaagatttccgaattaaaaa

SEQ ID NO: 20938 - DNA, 201 bp, Homo sapiens
agaggaacacaataggagggcgtattactccacgggttttaaccctagcccttgatgctaccaggtatccatgatgcccctaataaaggtgacagttcctycacttttctaacatccagctattctttaaaaaagttgaacactgcagtttccggagaactttgctatgtgaattgcctcactgcaggtgtgctctcccct

SEQ ID NO: 20939 - DNA, 201 bp, Homo sapiens
ataatccaatggttttaagtatatttagagctatgcagccatcgccacaaactaattttagaacaattttcatcaccccaaaaagaaaccctgtgcccacyagcagtcactccccattccatccgcccccagcccctggcaaccactcatctaccttctgcctctatggatttgtttattctagacatttcacataaaccg

SEQ ID NO: 20940 - DNA, 201 bp, Homo sapiens
ggagctcaagtcagtgcaatcattctgcatgcagaatcaaggccagagagagggtgaaattacagctaactcttaaaggagcttgccagagggcaagctgrtagtattgtttgctattccaagcagaggggcttccacctgccaagacaaagagacacgaatgagtacagcctgaactgttcaaaatgtctgggaggaagg

SEQ ID NO: 20941 - DNA, 201 bp, Homo sapiens
ctgtctttatttctccaccagacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcaggtactgagtcagtcaagacttcagcaaa

SEQ ID NO: 20942 - DNA, 201 bp, Homo sapiens
gggatcctggggggaagctttggtatcatggagtaaaaacatacattaaaacaccccctccctcctgcctgtgttctcaaaaatcgccgtcttgcacaaasaatatccttcaagaagaacgctccaaaagaaaaacagcctattttaaaatgcccgactcctgcgtcggcgaaggccatccctgctgttttgaatttcaga

SEQ ID NO: 20943 - DNA, 201 bp, Homo sapiens
cagaaccagcctcgggcccagccggcccaactcagaaaaaggcaggggtcagtctccagcctggactcctctaaaaatcagaaagcagtgccccagcaaaygaacaacaacagcgctcacctgaaacagtttcaccttcatttttagaggagaggaacacaataggagggcgtattactccacgggttttaaccctagccc

SEQ ID NO: 20944 - DNA, 201 bp, Homo sapiens
gagaaagctcctctggaagccagacaagctcggccacctcgaagtcttctttggaatccagcaggtccaggcctgagccctggcgcctggttaaaccaaargatgacaaccaagcagaaaaaaatagccccagagagtatctgctggagaggcagacaggcggacctggccttcgacacacagcatgcgtgccatggtctc

SEQ ID NO: 20945 - DNA, 201 bp, Homo sapiens
taacaagttattttcaacctgatcacatttctttaaaaaaaaaaaaaaagggtttattgagatataattcacataccattaaagtccccgatttaaagtayataatccaatggttttaagtatatttagagctatgcagccatcgccacaaactaattttagaacaattttcatcaccccaaaaagaaaccctgtgcccac

SEQ ID NO: 20946 - DNA, 201 bp, Homo sapiens
aaactagagaagctatacagttcaactgcataacataacaaaatggattatttctcccgtgtcttctaaaccgtacttatcttttaaagataaaaaccctyctttgtccccccagccaccacctaaacgacttagtaaagggagccggaaggctttcgcccaatcgagtccgctgaaagtttagaaaacaaagagcaggag

SEQ ID NO: 20947 - DNA, 201 bp, Homo sapiens
tggcacccctctttaaacaaactgttcctcttcacttgcatggtaaggactggaaagagccctgccgcgttggccagctcttcagggtagcgggggccacygccctctcccagcctcgggaagcccaaggccactgcatcagcctggcccagcccagaaccagcctcgggcccagccggcccaactcagaaaaaggcaggg

SEQ ID NO: 20948 - DNA, 201 bp, Homo sapiens
gcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtattttttttttta

SEQ ID NO: 20949 - DNA, 201 bp, Homo sapiens
agtaaggcagaggttgcagtgagcggagattgcaccactgcactccagcctgggcaacagagcaagactgtctcaaaaaaaaaaaaaaaaaaaaagggccytattcaactggcagcaattccccagtgttgtggggaaggaggactggaggccccagagagagcccaccagggccacccaccatgaggaggagaaaaaaag

SEQ ID NO: 20950 - DNA, 201 bp, Homo sapiens
ggcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtattttttttttt

SEQ ID NO: 20951 - DNA, 201 bp, Homo sapiens
caactgggactgctctctcgacaaaccaccccagcccacagctcctctggcaacccagcccctcacaccgaggacccatctcaccagtcacctccctcagstgggccaacctgtccagtccattcctgcttcctggtctcaggtctagagacaagacttccctccctgagcctgtcctcactgcctccctcatctatacca

SEQ ID NO: 20952 - DNA, 201 bp, Homo sapiens
attgtgaaccaaaatgtgaaccaaataaaagaatgacctatcatctggggcatctataatgttattcataggcaagaacttgctttgttatgttctgaatyaccataacacagatgctaatataaaacaaatatttatataagcgagggtgactgctttggtgacgaggacatgggataaaaatatggtggcagaaatcat

SEQ ID NO: 20953 - DNA, 201 bp, Homo sapiens
aacacactaagatgacatctctgtgtatgtgtgtgcgtgtgtgcactgcaaattaaatctcagcttgtcttaagggtttgcatgtttgttatatccatcaractgtgaccttaacagttccccctttagaagttatacttgaaataggtattcatagaatacagtcactttagcaaaagaagaaacaattttcaccagaag

SEQ ID NO: 20954 - DNA, 201 bp, Homo sapiens
tcaatcatacagtcctttacttcctaagatacatttcataattttacccaacggtgctttccaacacactaagatgacatctctgtgtatgtgtgtgcgtstgtgcactgcaaattaaatctcagcttgtcttaagggtttgcatgtttgttatatccatcaaactgtgaccttaacagttccccctttagaagttatact

SEQ ID NO: 20955 - DNA, 201 bp, Homo sapiens
ccaactctaggaagctttgcttcccttcctgcccctcctcagaagcttcatgcccttctcaccatgtctcacctactgatgcctcctggtcatttgggcamttgtctgtctcagcagctaaacttgcaatccaggagggtatacatggtcctcttctctgtcatgttcttagtacctaatggagtgcctgccacccattag

SEQ ID NO: 20956 - DNA, 201 bp, Homo sapiens
tgaattttcaggccttgcttcttggctcatgctgttacctctgtctgaaatttccctcctccattgtcgacactttactcctcttaatgtgggtgtcccawctctaggaagctttgcttcccttcctgcccctcctcagaagcttcatgcccttctcaccatgtctcacctactgatgcctcctggtcatttgggcaattg

SEQ ID NO: 20957 - DNA, 201 bp, Homo sapiens
ctactcttagatcagctgattagcaaattgaatgtcatctgcaccttcattcctctttggcaggtcacatagctcattaccgggttccagggattgggagrtggatgtctttggaggtggagaattggtctagctaccacagaaagggattttactacttgtgcccaaacgtattctgaattttcaggccttgcttcttgg

SEQ ID NO: 20958 - DNA, 201 bp, Homo sapiens
aagatggatgtgcttggaaaatgagtatttcttttctcattctgcctggtgatctggctgagagtagatttggattgggtttaggagtggcataagggacygagttgcaggctctgagacatgtactggcttcactcatttttatgaatgaatatttgaattttggaataccatgtaagtcatgcttactgttcattctcc

SEQ ID NO: 20959 - DNA, 201 bp, Homo sapiens
agcagatcacattatgaaaagcagactccaaagtattcactctgtggtatcccccacactcggcaaatgtttttgtgcattttcttatgtcagcctcaaarcaaccatatgggatctgcacaaaggagggaaccaaaccttaggagagttaaaccacttgtctgaggctctgcctcttaaaatccttcaagaggatttcac

SEQ ID NO: 20960 - DNA, 201 bp, Homo sapiens; identical to SEQ ID NO: 3490

SEQ ID NO: 20961 - DNA, 201 bp, Homo sapiens
atgtaggctttctctgggtgagtgttgggttcaacacccttgtccaagctcatctctagaccctcacagggagctggcttctagccctagaatagagtggygctttgtaataactcgagtcatctctcaggtgttgaaggaaaagtgttggaaatgggttgagggaggtgggtgccaagcatgaatggatgggtgaaggtg

SEQ ID NO: 20962 - DNA, 201 bp, Homo sapiens
gtggccactccagacccaggaatgttcccatgccttcaccactcccaaaacctgctgagggccgtcagcaacatgctccagaaggtgagcctttcctgtcstctccactgtggacctgcaccctccctgaggaaggggcctctgatcctcccctctggtacctgatggaactgcagagaaattgtggaagttcattagcag

SEQ ID NO: 20963 - DNA, 201 bp, Homo sapiens; identical to SEQ ID NO: 3487

SEQ ID NO: 20964 - DNA, 201 bp, Homo sapiens; identical to SEQ ID NO: 3488

SEQ ID NO: 20965 - DNA, 201 bp, Homo sapiens; identical to SEQ ID NO: 3489

SEQ ID NO: 20966 - DNA, 201 bp, Homo sapiens
cttgtctgaggctctgcctcttaaaatccttcaagaggatttcactacacttaccttctcactcacctctaaaggctccaggacgtgctccaggatttgcmtgcaaggggccagtttgcatatctgcaaatattgctgggaaacaagcaagattggtgcctgattatgacccattgtgaaccaaaatgtgaaccaaataaa

SEQ ID NO: 20967 - DNA, 201 bp, Homo sapiens
tctggggcatctataatgttattcataggcaagaacttgctttgttatgttctgaatcaccataacacagatgctaatataaaacaaatatttatataagygagggtgactgctttggtgacgaggacatgggataaaaatatggtggcagaaatcattgtctgaaaagtaattgttttacttttattcttttcgtgtgtg

SEQ ID NO: 20968 - DNA, 201 bp, Homo sapiens
gctgcccacattccttgacttgtggccccttccattgtccataccagcaatgtctggttgagtctttctcatgctgctccctctggactgaccttctaccygcttctacttttgaggacactgcttacactggattcacccagataatccaggatcatctctctactcttagatcagctgattagcaaattgaatgtcatc

SEQ ID NO: 20969 - DNA, 201 bp, Homo sapiens
acttgtggccccttccattgtccataccagcaatgtctggttgagtctttctcatgctgctccctctggactgaccttctacccgcttctacttttgaggwcactgcttacactggattcacccagataatccaggatcatctctctactcttagatcagctgattagcaaattgaatgtcatctgcaccttcattcctct

SEQ ID NO: 20970 - DNA, 201 bp, Homo sapiens
agctgtagttgctatttcatttttaggaccaagagttgggtgatttgggtgctagaatcaattctaccagtaaccagacaactattcccaagtcacttaamccctctgtgcctcagtttcctccagtataaaatggggtgactttattctagctttcttttagactttttgtgaggaagatatgaaagtatttattcatca

SEQ ID NO: 20971 - DNA, 201 bp, Homo sapiens
tcttcaatcatacagtcctttacttcctaagatacatttcataattttacccaacggtgctttccaacacactaagatgacatctctgtgtatgtgtgtgygtgtgtgcactgcaaattaaatctcagcttgtcttaagggtttgcatgtttgttatatccatcaaactgtgaccttaacagttccccctttagaagttat

SEQ ID NO: 20972 - DNA, 201 bp, Homo sapiens
agatgtcattttaaaggaactgtttctttctaagacacaactcccactgatgattttttctaaatagttttaagggtcttttcagagctcattgaagatgsatgtgcttggaaaatgagtatttcttttctcattctgcctggtgatctggctgagagtagatttggattgggtttaggagtggcataagggactgagttg

SEQ ID NO: 20973 - DNA, 201 bp, Homo sapiens
accacttgtctgaggctctgcctcttaaaatccttcaagaggatttcactacacttaccttctcactcacctctaaaggctccaggacgtgctccaggatktgcatgcaaggggccagtttgcatatctgcaaatattgctgggaaacaagcaagattggtgcctgattatgacccattgtgaaccaaaatgtgaaccaaa

SEQ ID NO: 20974 - DNA, 201 bp, Homo sapiens
cgagggtgactgctttggtgacgaggacatgggataaaaatatggtggcagaaatcattgtctgaaaagtaattgttttacttttattcttttcgtgtgtktgtgtgtgtgtgtgtgtgtgtgtgtgtgtgtgtgtgcatgtgccagatttcttgtttgaaaggcaatgagcttcatccaagtatcaaagaatgttagcat

SEQ ID NO: 20975 - DNA, 201 bp, Homo sapiens
agggctagcgttgcacctggcacatagtaagtgcacaataaatgtaagcacattttgaaatgtattattagtctttgggctaagcacctgcaccgaatttkttacctcctctttgctgctatttcctcattgatgaaattcagaaaacggtgggacctaattaactgtgttattgtgaagattaaatgacacaatacagtg

SEQ ID NO: 20976 - DNA, 201 bp, Homo sapiens
aattagccgagtgtggtggtgggtgcctgtaatcccatctactcgggagtctaaggcagggaaaattgcttgaactcggaggtggaggttgcagtgagccraaatcgtgccactgcactccagtctgggccacagagtgagactccgtcttaaaaaaacaaaaaaagtcaggctttctcactccactgtttttaaaacact

SEQ ID NO: 20977 - DNA, 201 bp, Homo sapiens
gttcaagaccagcctgaccaacatggtgaaaccccgtctctactaacaaatacacaaattagccgagtgtggtggtgggtgcctgtaatcccatctactcsggagtctaaggcagggaaaattgcttgaactcggaggtggaggttgcagtgagccgaaatcgtgccactgcactccagtctgggccacagagtgagactc

SEQ ID NO: 20978 - DNA, 201 bp, Homo sapiens; identical to SEQ ID NO: 3485

SEQ ID NO: 20979 - DNA, 201 bp, Homo sapiens
gcagttattgatgagctgatgcaggtaagacttcattctatcagtgagagcacctttttcatgctaaagataaccagccagggtctttgataaagagatayaaaaagaggtctggaggccttttaaaggcctgacagacctacattttcaagaagacagccttgagggtgccgtctatagggagcacaaatgtgagcagat

SEQ ID NO: 20980 - DNA, 201 bp, Homo sapiens
acgcctgtaatcccagcactttgggaggccaaggcggacagatctcctgaggtcaggagttcaagaccagcctgaccaacatggtgaaaccccgtctctastaacaaatacacaaattagccgagtgtggtggtgggtgcctgtaatcccatctactcgggagtctaaggcagggaaaattgcttgaactcggaggtggag

SEQ ID NO: 20981 - DNA, 201 bp, Homo sapiens
tgcagtttacaagtagtgtagtatgcttgcaaccaaatcattccaatgctccccattggtctcctcttctgaaaaaggaaggtaatactagaatctacctmaaaggatcagagaaagggtaaaatggaacaactcgtgcaaagggctagcgttgcacctggcacatagtaagtgcacaataaatgtaagcacattttgaaa

SEQ ID NO: 20982 - DNA, 201 bp, Homo sapiens
gtgcaaagggctagcgttgcacctggcacatagtaagtgcacaataaatgtaagcacattttgaaatgtattattagtctttgggctaagcacctgcaccraatttgttacctcctctttgctgctatttcctcattgatgaaattcagaaaacggtgggacctaattaactgtgttattgtgaagattaaatgacacaat

SEQ ID NO: 20983 - DNA, 201 bp, Homo sapiens
tgtgccttagtagtatttatgaagacttgaagatgtaccaggtggagttcaagaccatgaatgcaaagcttctgatggatcctaagaggcagatctttctrgatcaaaacatgctggcagttattgatgagctgatgcaggtaagacttcattctatcagtgagagcacctttttcatgctaaagataaccagccagggtc

SEQ ID NO: 20984 - DNA, 201 bp, Homo sapiens; identical to SEQ ID NO: 3486

SEQ ID NO: 20985 - DNA, 201 bp, Homo sapiens
aaaggctaatgttttaaaagatgtcctctgcctttctgctctctaggaattttttcttgagtattttctagcttgttgccttaggaatatcttaaaataarctcaatgccaccaagccttcttaaagggctcctttcccctttcaatctttcataatgtgctgtgcattgctcctcacaattcaattaatcttaattggac

SEQ ID NO: 20986 - DNA, 201 bp, Homo sapiens
ttgctcctcacaattcaattaatcttaattggacagggggctcaagtgaaaactgctttgtttcccgaagaaaggttcaaaatgggtaacttttaggtgcyccaattcatatagatttttttgtgcaaaagctgacacccctactcccagatatagtcctaagggtcaaaagattatagaaatcaatttaatgttttgtac

SEQ ID NO: 20987 - DNA, 201 bp, Homo sapiens
tcaggtctagaggctgcccacattccttgacttgtggccccttccattgtccataccagcaatgtctggttgagtctttctcatgctgctccctctggacygaccttctacccgcttctacttttgaggacactgcttacactggattcacccagataatccaggatcatctctctactcttagatcagctgattagcaaa

SEQ ID NO: 20988 - DNA, 201 bp, Homo sapiens
ccctttagaagttatacttgaaataggtattcatagaatacagtcactttagcaaaagaagaaacaattttcaccagaagcaagtgtcacagtgaggtgtrgaggctggttagcacaggctgttgacatgatttattgtgtttacataatgaaaaaatatgtaatccagagaaacatgccccaagcttagggagaggaggg

SEQ ID NO: 20989 - DNA, 201 bp, Homo sapiens; identical to SEQ ID NO: 3491

SEQ ID NO: 20990 - DNA, 201 bp, Homo sapiens
gaggcctgtttaccattggaattaaccaaggtataaaggattttcctcccagagcatgcagtgtggttaaaaactgtgcatcaaatctcacctgcttctaraaattcacgtttctggtatccatcattatgggattttaactggtcctacttcagaagttagatttgggagaaaaattatttttaaaaaatggtttttttt

SEQ ID NO: 20991 - DNA, 201 bp, Homo sapiens
ttaccattggaattaaccaaggtataaaggattttcctcccagagcatgcagtgtggttaaaaactgtgcatcaaatctcacctgcttctaaaaattcacrtttctggtatccatcattatgggattttaactggtcctacttcagaagttagatttgggagaaaaattatttttaaaaaatggttttttttgcaacaatg

SEQ ID NO: 20992 - DNA, 201 bp, Homo sapiens
gcttcactcatttttatgaatgaatatttgaattttggaataccatgtaagtcatgcttactgttcattctcctaggccctgaatttcaacagtgagactrtgccacaaaaatcctcccttgaagaaccggatttttataaaactaaaatcaagctctgcatacttcttcatgctttcagaattcgggcagtgactattga

SEQ ID NO: 20993 - DNA, 201 bp, Homo sapiens
tcaggagaccggcctgttcctgagtttgagtaggtccccatggctggcaggccagagccccgtgctgtgtatgtaacacaataaacaagcttcttcttccmaccctgtcctggccctgctgagcagcagcagaaagtaccaaaccgagcagtacacacaaagggactcttcagtgctctgggattgaaagtggttagcgtt

SEQ ID NO: 20994 - DNA, 201 bp, Homo sapiens
ttcaggagaccggcctgttcctgagtttgagtaggtccccatggctggcaggccagagccccgtgctgtgtatgtaacacaataaacaagcttcttcttcscaccctgtcctggccctgctgagcagcagcagaaagtaccaaaccgagcagtacacacaaagggactcttcagtgctctgggattgaaagtggttagcgt

SEQ ID NO: 20995 - DNA, 201 bp, Homo sapiens
tcccagactcggacgccgcagacctgtgggagcagcgcggaatgccccgccccttttcccgaggacacccaatgagggcgagaggtcacttccggggcggsttcgctaacggaaagggcggggcatccctctcgaggagcggccttgttcctcaagcggccgctgggggcgccagagcaggaccggagcgcgggccaagct

SEQ ID NO: 20996 - DNA, 201 bp, Homo sapiens
cctggcacccccacatctccaggtccagcgtggtaccccccatctccaggtccagcctggcaccccacccccatctccaggtccagccaggccctcagagkcaccctcatcccaagtccacgtgcccactgcttaccctgccccatgcttcagggtggagtgggcgcaggcacgccaggccttctttagctctggaaagaa

SEQ ID NO: 20997 - DNA, 201 bp, Homo sapiens
  misc_feature (1)...(201): n = A,T,C or G, or insertion/deletion polymorphism (see Tables 1-2)
tctgagccatgctgggccttccctcaggtgatggcactgggcatagtgcctatgtgctcctaccagatggagaggatgttcaacaccactcggatcccggncaaggacacaggtaactgagccccctcgctgctacctgtgggccatctggctggctcgctgccctcctgcctgctcatcaccaagcgtccccagtgtctc

SEQ ID NO: 20998 - DNA, 201 bp, Homo sapiens
gcctccagggcaggaccttggagggaggaacaacgagcagaaggccctggcgactgggctgagcccccaagtgaaactgaggttcaggagaccggcctgtycctgagtttgagtaggtccccatggctggcaggccagagccccgtgctgtgtatgtaacacaataaacaagcttcttcttcccaccctgtcctggccctg

SEQ ID NO: 20999 - DNA, 201 bp, Homo sapiens
agtgggcaggggaggttggattcaggagatgtttccaaatataaggttctgtgcaaagagtggccttaagggcttgagaataatggggctgggtgaggagrgagaggtgggaagaggattaagatagaggcagcccttgccatctggccccacggtgatgataactggctggacagtacctagagtctgtgcgccccttgt

SEQ ID NO: 21000 - DNA, 201 bp, Homo sapiens
ccacagatctctgtgggtccagcgttcctggtcgccgctctagcctggggcagaagcagaaatgcaggaggcacgcgtttaaatcaggacgccctcaatgkgaggtgcgcaggccgaggagggggctgcggcaagctgcgagtcttcactttcttcggctcttgggtttgactctgtaattggttctaggcctggaggaga

SEQ ID NO: 21001 - DNA, 201 bp, Homo sapiens
gtcagacatgagtgtgcccagggaggttcttccccttggtgtctcccctgagacagttcacagccacccgaggctggcctcaagaggaccccctgcagccyttgcccctctccaataggtgtggcccctaccagaccccgcagacccgggcacttctcagcatggccatcttctccacgggcgtctgggtgacgggcatct

SEQ ID NO: 21002 - DNA, 201 bp, Homo sapiens
tataaatgtgaactgcttttaatcctctttaccactggcaattgaaaagaatgttcaccaagtcaataattgcattatcaagagccagaggtgcatttatyggttccagtaaagataccacacctagcacagctgtgtgatcggggacacgacttggctaagtttgtgcagggcatcatcatttacttgaatccaccaaga

SEQ ID NO: 21003 - DNA, 201 bp, Homo sapiens
cagccattggcagtcacggggcagccctcccctatgacaaccattgtcttagccctacatccgctcatttgatgcagtcagacatgagtgtgcccagggargttcttccccttggtgtctcccctgagacagttcacagccacccgaggctggcctcaagaggaccccctgcagcctttgcccctctccaataggtgtggc

SEQ ID NO: 21004 - DNA, 201 bp, Homo sapiens
tcaaacgatcctcctacttcggcttcccaaagtgcagggattaaaagcgtgacccactgcccccagccagaatcagttttcttttttttttttttttttttgagactgagtctgactctgtcgctcaggctggagtgcagtggctcgcggcaacaaggcctgggttcaagggattgtcacgcctcagcctcccgtgtagct

SEQ ID NO: 21005 - DNA, 201 bp, Homo sapiens
agcaagactccatttcaaaagaaaaaaagaaatgattgccggacaagtcacacagtgataggagcaggggtgcagtagtctggcctgaggggtagataggmgaggggtgggaaagaatagcagagccagtgtatcctattctttgggcttcaggtacctaaaacagatccaggacctgcccccaactggcctccctgagat

SEQ ID NO: 21006 - DNA, 201 bp, Homo sapiens
acctctacctgtttgggtgccagtaagcctcccctgggaaggtgcctgcgttttggtagtcttctggggacatcagctcaccccgtcctgagatagcagtraacagagtttccaacaagctagctttcaattaacatcaaaattcagcattaaagttcttttatctcatttgttctgggttaaaatagtgagatgaggaac

SEQ ID NO: 21007 - DNA, 201 bp, Homo sapiens
ctggagatgcagttccagaggatcctggacgacccctccccacctcagcctggggaggagaagctggcagccctcactgcaggaggaaggtattggcctcygggaagggactgtccccaccctgagttcagggctccgtgaggagaggagcgtggccctgcctgccaccctggaactggaggctggaggcacaactagggg

SEQ ID NO: 21008 - DNA, 201 bp, Homo sapiens
tagggtttgggttatagaatagggttaaaagccgggcatggtggcaggcacctgtaatcccagctagtcggaaggctgacgcaggagaagcccttgaaccygggaggttatgggaagctaagatcacaccactgcactccagcctgggcaacagagcaagattccatctcaatttaaaaaaaaagtgagagaaaaagagag

SEQ ID NO: 21009 - DNA, 201 bp, Homo sapiens
gctgtccttccaggaacttacacacaacttgcccatagcagaggttttaaactgctttttagtggtagaacccctttatcaaagcaaaagaagtagaatayaagcacataaaatagcttataaaaaggcagctcgggccgggtgcagtggctcacgcctgtaatcccagcactttgggaggccgaggcaggtggatcacaa

SEQ ID NO: 21010 - DNA, 201 bp, Homo sapiens
gtttcgctatgttggccagggtggtctcaaactcctgacctcaagtgatctgcccgcctcggcctcccaaaatgctgggagtacaggcgtgagccaccacrcccggaccagttactttttaaagtggctctaggtccctttagggaaggattggaggaatatttcttggtatatgctcagatgctggtattgtaagatcct

SEQ ID NO: 21011 - DNA, 201 bp, Homo sapiens
gtctcgtccattgtcctcctctggctttccttgtcgctagaaaacatcatctctcagtcactcccttgaaggtcattttccatgcatctccagctgcattyaggacgcttttgtctttggtgttctgaagtttcaatgtggtctatctaggtgtgggtttattttgtatttttttctgcatgaggttctcaattatataaa

SEQ ID NO: 21012 - DNA, 201 bp, Homo sapiens
tcttttttttttttttttttttgagactgagtctgactctgtcgctcaggctggagtgcagtggctcgcggcaacaaggcctgggttcaagggattgtcaygcctcagcctcccgtgtagctgggattacaggcacaagccaccaaacccggctaatttttgtatttttagtagcgacggggtttcgctatgttggccagg

SEQ ID NO: 21013 - DNA, 201 bp, Homo sapiens
caggcacgccaggccttctttagctctggaaagaataaggctgccttggaggccatcgagcgtgccgctttcttcgtggccctggatgaggaatcctactsctatgaccccgaagatgaggccagcctcagcctctatggcaaggccctgctacatggcaactgctacaacaggtacggcagccccagccccacaggttac

SEQ ID NO: 21014 - DNA, 201 bp, Homo sapiens
aagggatgaaacggtaaccactgctttataagtctttgagggcgaaatacctctgcaattacacctggaatgcagcattgtttctgacttactatcttggraaggtttcagtagggtgaggagtttcaaaggtttctactttgcgcttccttacatatggtaccaaaggcctgggatcaatgtatacgctccgccctctgc

SEQ ID NO: 21015 - DNA, 201 bp, Homo sapiens
ctcaaacgatcctcctacttcggcttcccaaagtgcagggattaaaagcgtgacccactgcccccagccagaatcagttttcttttttttttttttttttttgagactgagtctgactctgtcgctcaggctggagtgcagtggctcgcggcaacaaggcctgggttcaagggattgtcacgcctcagcctcccgtgtagc

SEQ ID NO: 21016 - DNA, 201 bp, Homo sapiens
gctcaaacgatcctcctacttcggcttcccaaagtgcagggattaaaagcgtgacccactgcccccagccagaatcagttttcttttttttttttttttttttgagactgagtctgactctgtcgctcaggctggagtgcagtggctcgcggcaacaaggcctgggttcaagggattgtcacgcctcagcctcccgtgtag

SEQ ID NO: 21017 - DNA, 201 bp, Homo sapiens
gaaagaataaggctgccttggaggccatcgagcgtgccgctttcttcgtggccctggatgaggaatcctactcctatgaccccgaagatgaggccagcctyagcctctatggcaaggccctgctacatggcaactgctacaacaggtacggcagccccagccccacaggttacagcttaaggttaaaagttagggttatgg

SEQ ID NO: 21018 - DNA, 201 bp, Homo sapiens
ggctcaaacgatcctcctacttcggcttcccaaagtgcagggattaaaagcgtgacccactgcccccagccagaatcagttttcttttttttttttttttttttgagactgagtctgactctgtcgctcaggctggagtgcagtggctcgcggcaacaaggcctgggttcaagggattgtcacgcctcagcctcccgtgta

SEQ ID NO: 21019 - DNA, 201 bp, Homo sapiens
acctgggacccacccatcccaaatacctccctgctgaagcatgaccgtggtttccggggtactgaagcatgactgtggggctggtttccagggtactgggyagtgcactgggtgcttctgaagtctacttatccaagagagtgcagctgtctcccacagaaaccttcacatgggctagcttgtcagaaggctagagaaccc

SEQ ID NO: 21020 - DNA, 201 bp, Homo sapiens
cgttacgcagcagccacgctacctcctcaccgtttatcaggatcaagtatcccctcctttgtggcctgctggtccaccagtatgaggagctgagagtaacytggtggtctttgcagattcaggctcagcagaggtatccttcctgcaaccagcaggagtgccctcgtggaagcgttcctacctgggaaacaggctctaatc

SEQ ID NO: 21021 - DNA, 201 bp, Homo sapiens
tccagagatgcctccctcaggggtaaggagtgaaactggaagggcacaggtgccaccagggagggctgggcccagctcccaaggctgaggttcctgagctrggcagatacaggacagcagccattggcagtcacggggcagccctcccctatgacaaccattgtcttagccctacatccgctcatttgatgcagtcagaca

SEQ ID NO: 21022 - DNA, 201 bp, Homo sapiens
cccactcaaagctggcagttttcccgttacccaataaaggggtcagagaggtatcctctagcgcggtgcatgctgactccaaaacacagaggtgcctcaaygctgtgcctctttcttccttgtaaggatgcaggatgcaataacttgtccctggcttgccctcaaacgctgcacccctgagaatgtcactgatatggcagg

SEQ ID NO: 21023 - DNA, 201 bp, Homo sapiens
ccctccccagtcccctggctgcagcttagaataataaatactaggacttggggaggaggagagtgatgggggtatgaagacgaccctgaggtggggatgcygcccggagcaccagcgatcccagaacaggcagcagctgacacatcggtgaccttttccctacatttggctatttttagctctaaagccaccatcctcacg

SEQ ID NO: 21024 - DNA, 201 bp, Homo sapiens
tgcagtgtctagggctggggcccgttcctgcaactcttgtgggaagaacaagtacaatatcagcttggctttcagatcttcaaggtttgatttatgccttyttcacccttcttgttgccctcaggtagcagatgatggctatggagtttcctacatgattgcaggcgagaacacgatcttcttccacatctccagcaagtt

SEQ ID NO: 21025 - DNA, 201 bp, Homo sapiens
tgagatgggcaacctcaggtgagggcaggcaggacaaggctaatggtaatggtgtccgcccttccagtagttgctgagggctggtgtcagggcctggcctrttagggtggctctgatcctcctctagtcactcctgctcaggacccatgctcccatacccctgtaggaagttactagagtctaccccatcgccagtcgtct

SEQ ID NO: 21026 - DNA, 201 bp, Homo sapiens
aaatgattgccggacaagtcacacagtgataggagcaggggtgcagtagtctggcctgaggggtagataggcgaggggtgggaaagaatagcagagccagkgtatcctattctttgggcttcaggtacctaaaacagatccaggacctgcccccaactggcctccctgagatgaacctgctggagatgtacagcctgaagg

SEQ ID NO: 21027 - DNA, 201 bp, Homo sapiens; identical to SEQ ID NO: 3541

SEQ ID NO: 21028 - DNA, 201 bp, Homo sapiens
agcagagggagggctgggcagctcacacaagccttatgtggcatgatgcacaggggaccacggggtggtggccagggagctcctgcaccctcagcagaacygtgtctggctcagagtaggtcgcagacaccacgtgttggacaggtgctttgggtatgtggcctctgaccagctgtggcctccattgcaggtgctctcgga

SEQ ID NO: 21029 - DNA, 201 bp, Homo sapiens; identical to SEQ ID NO: 3543

SEQ ID NO: 21030 - DNA, 201 bp, Homo sapiens; identical to SEQ ID NO: 3544

SEQ ID NO: 21031 - DNA, 201 bp, Homo sapiens
catccaggaaggtaggagaaggcatctgagtctcctaacccaagatggaagagccagagggctctggagtgagcagaacctcaccccattcccccagggamcatcttgctgctctcagagccagaaaatgctgacagcctcatgctggtggacttcgagtacagcagttataactataggtgaggctggaaagatggcttc

SEQ ID NO: 21032 - DNA, 201 bp, Homo sapiens
gctgtggagacagaatgtacaaattctacgtgtaagcactgggaatgatggtgagaagtagctaatcccaacccttgggttcctggacctgtgtctttctkcttggatccacatgaagtatctactgggggcagagcaccatatattagactctgattcagtgtatatatcccaactcctcaggatactgtcctagaacca

SEQ ID NO: 21033 - DNA, 201 bp, Homo sapiens
tggagacagaatgtacaaattctacgtgtaagcactgggaatgatggtgagaagtagctaatcccaacccttgggttcctggacctgtgtctttctgcttsgatccacatgaagtatctactgggggcagagcaccatatattagactctgattcagtgtatatatcccaactcctcaggatactgtcctagaaccaggac

SEQ ID NO: 21034 - DNA, 201 bp, Homo sapiens
aaagaaagaaagaaagaaagaaagaaggaaaagaaagaaagaaagaaagaaggaaaagaaagaaagaaagaaagaaggaaaagaaagaaaagaaagaaagrgaaaagtgaattagaaggaaagatcagaatcaatggaataaaaaatatatacacagttgagggtaatcaatgaaaccaaaagctggttctttaaaaaact

SEQ ID NO: 21035 - DNA, 201 bp, Homo sapiens
tgctctagggatggtatctcagcaggggctcagcactgatcgctttcagcaggagtaatcatgagacaagccttgagaaagaaggcctgtgctggtggacrctaacctgtgctccttctgcatgacgccgccactcacagtccactgttcaagcacaggggtagccaggggcacagctgactgacatcccatccatcctgc

SEQ ID NO: 21036 - DNA, 201 bp, Homo sapiens
gagagatgcacatattgtgtggccactcctgtaggtccatcttcccctcttgctcttttcaggtccctgaccagccagcaggacgtcacaacccagaagtycatatgcgtccctccctcaggccactactctgtccactgcctccatacaaagtggatatccacacgaactgctggaagctcagccccatggaggatttcc

SEQ ID NO: 21037 - DNA, 201 bp, Homo sapiens
agatgcagttccagaggatcctggacgacccctccccacctcagcctggggaggagaagctggcagccctcactgcaggaggaaggtattggcctctgggragggactgtccccaccctgagttcagggctccgtgaggagaggagcgtggccctgcctgccaccctggaactggaggctggaggcacaactaggggaggg

SEQ ID NO: 21038 - DNA, 201 bp, Homo sapiens
ttagggtcaccttgaatgggactgtagtgtacctatggttcattttcagttcatatcaacacatcaaactgacctatatacgaaccagaccagaatgcttrtctgctaagggagaaatatcagtgcaaagcagatgtggggccacactgccacctcttcctgtaaataactgttacccactagacacgcttgggtccaagc

SEQ ID NO: 21039 - DNA, 201 bp, Homo sapiens
gggagaaatatcagtgcaaagcagatgtggggccacactgccacctcttcctgtaaataactgttacccactagacacgcttgggtccaagcccaaggctwcctttttcattgtaccatcaattgctactgagcctctgacctactgacttggaggatctgacaacacctcgcttgggcagaccctgtcgcatggtcgctg

SEQ ID NO: 21040 - DNA, 201 bp, Homo sapiens
ccgttgttgggtgtgtcctttgtcccactgccctcctacacgcagggcttgggccatctcatgatggagcacggcctgttttcctggcttgctcccctgargctccctggagtgctgggccagctttcccgcccacaccccacctgggcctgtggtcctgggactgagcaggagcaacatcctctttgtggtgttggtgtc

SEQ ID NO: 21041 - DNA, 201 bp, Homo sapiens
agccagaaaatgctgacagcctcatgctggtggacttcgagtacagcagttataactataggtgaggctggaaagatggcttcccatagatctgttcccayagggctcttgaaaacaggccagctgcccagggcatttggggactgaatgtccaccttattctcccaggggctttgacattgggaaccatttttgtgagtg

SEQ ID NO: 21042 - DNA, 201 bp, Homo sapiens
caccagcaggtgctcggtctctacctgggtctggtagtgtgcctgatactgctctcacttggcgagtagttctctgctgcagaaggcatggtcttgtccargaactctaggacagtgtactgcaactcttccgttggagtttgccagagatgccatatagggtccttcctaccccaaataagccccccggtaacccattgg

SEQ ID NO: 21043 - DNA, 201 bp, Homo sapiens
atgagctgggtgcagtggcacacacctgtgatcctagcactttgggggccaaggcaggtggatcacttgagtgcaggagctcaagaccagcctgggcaacrgagcgagaccccttcataaaagtagttaggattgtgattagtggttgggtagggctagtggctagggttaaaagctagggtttgggttatagaatagggt

SEQ ID NO: 21044 - DNA, 201 bp, Homo sapiens
ggggtcggggaagagggcccggcaagggagccctcgcgccggagctgcagctgcagccgccgccccgccgccccgccggctcccacggggcagagacgcarctcctctccggtcttcccgtacgctaccgcgcccgggcagttcctcgcccgcgcacgcgccgctccgccaactgattggcctccggcgcctcggattggc

SEQ ID NO: 21045 - DNA, 201 bp, Homo sapiens
ggcaagggagccctcgcgccggagctgcagctgcagccgccgccccgccgccccgccggctcccacggggcagagacgcagctcctctccggtcttcccgkacgctaccgcgcccgggcagttcctcgcccgcgcacgcgccgctccgccaactgattggcctccggcgcctcggattggcccaggccgtccaacagcagc

SEQ ID NO: 21046 - DNA, 201 bp, Homo sapiens
tgaacctgctggagatgtacagcctgaaggatgagatgggcaacctcaggtgagggcaggcaggacaaggctaatggtaatggtgtccgcccttccagtakttgctgagggctggtgtcagggcctggcctgttagggtggctctgatcctcctctagtcactcctgctcaggacccatgctcccatacccctgtaggaag

SEQ ID NO: 21047 - DNA, 201 bp, Homo sapiens
gagcccccaagtgaaactgaggttcaggagaccggcctgttcctgagtttgagtaggtccccatggctggcaggccagagccccgtgctgtgtatgtaacmcaataaacaagcttcttcttcccaccctgtcctggccctgctgagcagcagcagaaagtaccaaaccgagcagtacacacaaagggactcttcagtgctc

SEQ ID NO: 21048 - DNA, 201 bp, Homo sapiens; identical to SEQ ID NO: 3507

SEQ ID NO: 21049 - DNA, 201 bp, Homo sapiens
  misc_feature (1)...(201): n = A,T,C or G, or insertion/deletion polymorphism (see Tables 1-2)
cctccaggcatccatgtccaccatagaatttggttacttggtaagtgaccctggggatgggaatgctagctggggggctggggagcagcagcagccacacncttccaggaggcctggggagtcccgggtggctgtgggcagcctgaggtggatgtagaatgctggtcccacgtcttctcaccactgtgtggggtgggtttc

SEQ ID NO: 21050 - DNA, 201 bp, Homo sapiens; identical to SEQ ID NO: 3546

SEQ ID NO: 21051 - DNA, 201 bp, Homo sapiens
ttcaccccggcagcatgtgcaggatgtactggaagagggagacagaacacctcaggcccccgaatagattggtccttgggtcagcaagactcaggtgacayccagacagaggcccccaccccgcgggctctgttcctctgtaggaccttgtgctcatcaagaatacagacgtgcaggcagcccgcctgggaaacatcatcc

SEQ ID NO: 21052 - DNA, 201 bp, Homo sapiens
ggagctcctgcaccctcagcagaaccgtgtctggctcagagtaggtcgcagacaccacgtgttggacaggtgctttgggtatgtggcctctgaccagctgyggcctccattgcaggtgctctcggaaccctggcgtctctccaccagccagatcccccaatcccagatccgcatgttcgacccagagcagcaccccaatca

SEQ ID NO: 21053 - DNA, 201 bp, Homo sapiens
ggagcagcagcagccacactcttccaggaggcctggggagtcccgggtggctgtgggcagcctgaggtggatgtagaatgctggtcccacgtcttctcacyactgtgtggggtgggtttccttccctaggactatgcccagtctcggttccagttctacttccagcagaaggggcagctgaccagtgtccactcctcatcc

SEQ ID NO: 21054 - DNA, 201 bp, Homo sapiens
ctgaggtggggatgccgcccggagcaccagcgatcccagaacaggcagcagctgacacatcggtgaccttttccctacatttggctatttttagctctaawgccaccatcctcacgagactctggggccccccaggctcccagacctttgagcaaccttcaccgcacagaaacccagccgcgccctgcaattcccaccgcg

SEQ ID NO: 21055 - DNA, 201 bp, Homo sapiens
  misc_feature (1)...(201): n = A,T,C or G, or insertion/deletion polymorphism (see Tables 1-2)
acctcccgccttccggctccataagggcgcctgtttctgcccacagaatggcatcctcaggggcgtgtaccctggcagccccaccagctggctggtcgtcntcatggcaacagtgggttcctccttctgcaacgtggacatctccttggggctggtcagttgcatccagagatgcctccctcaggggtaaggagtgaaact

SEQ ID NO: 21056 - DNA, 201 bp, Homo sapiens
cagcaacttgaccaggatctgggctgtgagcagcagccagtggaggggttcaggcacctgggttgagactctttggactcctttggggttctgagctagasgggagaggcagacagggcactggtgcctggtgtgtggtttgtcctggaggggctgggatggctctgagggtctcagggagttgctggttggtttccattt

SEQ ID NO: 21057 - DNA, 201 bp, Homo sapiens
gaacgtgtcttgctttgtgtccctctgcagagccggacagcagaatggaggccaggctgctgcttttagagctcaggaagtcagtctgcctctgccccatrtaactggcccttctgagtctctgggtctcccagccacctgggctgtatggcatgcctcttctctcctttcccacggtccaaagcacacttgacttgccag

SEQ ID NO: 21058 - DNA, 201 bp, Homo sapiens
tggagatgcagttccagaggatcctggacgacccctccccacctcagcctggggaggagaagctggcagccctcactgcaggaggaaggtattggcctctrggaagggactgtccccaccctgagttcagggctccgtgaggagaggagcgtggccctgcctgccaccctggaactggaggctggaggcacaactagggga

SEQ ID NO: 21059 - DNA, 201 bp, Homo sapiens
cagagcaagattccatctcaatttaaaaaaaaagtgagagaaaaagagagagagaatagggttagtaattagggttaaaggttggggttgcaggtcaggcwcctctggacattcccagctttggttcttcatgtgtctactcttcctgcaggtggtttgacaaatccttcactctcatttccttcaagaatggccagttgg

SEQ ID NO: 21060 - DNA, 201 bp, Homo sapiens; identical to SEQ ID NO: 3526

SEQ ID NO: 21061 - DNA, 201 bp, Homo sapiens
gatctcttccagaaggctgctaagaagcaccagaatatgtaccgcctggccatgaccggggcagggatcgacaggcacctcttctgcctttacttggtctmcaagtacctaggagtcagctctcctttccttgctgaggtcagcaccgttgttgggtgtgtcctttgtcccactgccctcctacacgcagggcttgggcca

SEQ ID NO: 21062 - DNA, 201 bp, Homo sapiens
aaagctgagcccggcctctgggggctgattctccctcagactgtcttttgcgtaccctcctcctgaagatgtcttggccggctgtgccctttctccaccarctaaacgtcatgcctcctagacatgacccagagtcctgcttggagagccctaccctcagctgacccttcccatgtcttggcagtgccaggcggtcatcga

SEQ ID NO: 21063 - DNA, 201 bp, Homo sapiens
  misc_feature (1)...(201): n = A,T,C or G, or insertion/deletion polymorphism (see Tables 1-2)
aactaaacgtcatgcctcctagacatgacccagagtcctgcttggagagccctaccctcagctgacccttcccatgtcttggcagtgccaggcggtcatcnagagttcctaccaggtggccaaggcgttggcagacgacgtggagttgtactgcttccagttcctgccctttggcaaaggcctcatcaagaagtgccggac

SEQ ID NO: 21064 - DNA, 201 bp, Homo sapiens
cagaaggccctggcgactgggctgagcccccaagtgaaactgaggttcaggagaccggcctgttcctgagtttgagtaggtccccatggctggcaggccaragccccgtgctgtgtatgtaacacaataaacaagcttcttcttcccaccctgtcctggccctgctgagcagcagcagaaagtaccaaaccgagcagtaca

SEQ ID NO: 21065 - DNA, 201 bp, Homo sapiens
cacggagaccgggcactgcctgggcaaaccgaaccctgcgctcgcacctcctacacggctgcagtgggacattccaaaacaggtgggttggaagctcccaragcaggtgtgagaccacaaagcagcaggtgggtacagccccgacgaggcctgagcctcctcctcccctgctggcctcactgcctggcccagccctcggga

SEQ ID NO: 21066 - DNA, 201 bp, Homo sapiens
aacaggtgggttggaagctcccagagcaggtgtgagaccacaaagcagcaggtgggtacagccccgacgaggcctgagcctcctcctcccctgctggcctyactgcctggcccagccctcgggaaggcacagggcacgtctcaggatacctgtagagtccaaactggcttcagggaggacagagaccacccaccgcccctg

SEQ ID NO: 21067 - DNA, 201 bp, Homo sapiens
ctccctcaacctcaggacgtccccagcaccgcacctgccagtcccagactcggacgccgcagacctgtgggagcagcgcggaatgccccgccccttttccsgaggacacccaatgagggcgagaggtcacttccggggcgggttcgctaacggaaagggcggggcatccctctcgaggagcggccttgttcctcaagcggc

SEQ ID NO: 21068 - DNA, 201 bp, Homo sapiens
cagtcccagactcggacgccgcagacctgtgggagcagcgcggaatgccccgccccttttcccgaggacacccaatgagggcgagaggtcacttccggggmgggttcgctaacggaaagggcggggcatccctctcgaggagcggccttgttcctcaagcggccgctgggggcgccagagcaggaccggagcgcgggccaa

SEQ ID NO: 21069 - DNA, 201 bp, Homo sapiens
gcagatacaggacagcagccattggcagtcacggggcagccctcccctatgacaaccattgtcttagccctacatccgctcatttgatgcagtcagacatragtgtgcccagggaggttcttccccttggtgtctcccctgagacagttcacagccacccgaggctggcctcaagaggaccccctgcagcctttgcccctc

SEQ ID NO: 21070 - DNA, 201 bp, Homo sapiens
ctccctctctcctcaggtctcagccaattcctcagcaccttccaacaccaagaacaatttttaatttaaaatcgcacagccaggcagggagggtcttttgkgctgttgggctctgttgtcttgggggaatgacacctgctgtgtgcacttggacacagcccagggtgccacctgcacccaccttccccttccccgtcccct

SEQ ID NO: 21071 - DNA, 201 bp, Homo sapiens
ggcagcgttgttgatccagggctctgcctgcgtctacagtaagaaggtgggccctgcttgacgctggtcttggcattttggtggccagtgggaccacagtsggctctccttctggggcaggtgcagtggtcgtcccgtctgtgacctacctccctctctcctcaggtctcagccaattcctcagcaccttccaacaccaag

SEQ ID NO: 21072 - DNA, 201 bp, Homo sapiens
aggttgcagtgagctgagattgcgcccctgcattccagcttgggtgacagagtgagactccgtctcaaacaaaacaaaacaaaacaaaacagaaggttccragttgggaccatagagcagaggagggcaggcagctggagagggaggctggccagcatggaggcctccctctggctccgtttaggattttgggtttttcct

SEQ ID NO: 21073 - DNA, 201 bp, Homo sapiens
aggggtgggtggtgggggttggagatagagtgagctggtcacaggtcccacttgcctggcaggctgacaggtaggcggcccaaagcagcaagtagatgacrgggtggcgcagtgggctcagcagcagggctcccagggccactagtgcacccagcaggctcagcagctccaggccctgggccgtgtccagccccagtctcg

SEQ ID NO: 21074 - DNA, 201 bp, Homo sapiens
tccgtggcgccccgtacctgctctgggctctggatgacattgaatccaggaatagactccagcttatccaaggtgcctcctgtgtgccccagaccacgtcygctgatcattggcacctggtggtcagggatgctgagtaccctgcacagtacccctcccccacctctgtgcatcccttcaccttccctggctaggagtgca

SEQ ID NO: 21075 - DNA, 201 bp, Homo sapiens
aacccctgggagggcagggggctggacaagtgacacgcacaggtggccgtcttcttgcggctgccgtggccaggctcagcagccaggtgctggtcgtccarcagcgcagtggtaagcaccagcgtcatcaggttgaagaagttgtagttgccggtgatgataatcaggacctgcagcagcacctgggggcggcccgctctc

SEQ ID NO: 21076 - DNA, 201 bp, Homo sapiens
caggcttgtacatgaactcgatctcctgccaggcaggccgaggtcagctgggcccgctgacctgggccccaccaccctgcccgccctgggagggctcaccrtccagtggtggccgtcgtaactgccctccagcaccacctcaggccgtccaccaagcccagtcatgcggcggaagaggccgtaggagttggccagctgtag

SEQ ID NO: 21077 - DNA, 201 bp, Homo sapiens
cagcgtctttgccagctcccgggcctgctcctggttggggaagacggcggcccctccgaacttaacgtccaccaccagagcggacagcccctccacgagtytcttactgagaatggaggctttgggggaggcagaggaggttggagacaatggagaacctggagcttcttgggagagttcggggatgccgactttggggtc

SEQ ID NO: 21078 - DNA, 201 bp, Homo sapiens
ggcccgatgcccctgggtgggggcgaggacgaggatgcagaggaggcagtagagcttcctgaggcctcggcccccaaggccgctctggagcccaaggagtycaggagcccgcagcaggtgggacccacatggaggcctgcagaacctgagctgtgaactggcaaccctggctctggggccgagtcaccttgcacaaggagg

SEQ ID NO: 21079 - DNA, 201 bp, Homo sapiens
ataccagggacaaccggtgagcccacagcatagctagagctgcccgtctcgggaggtgctgggcagagaccaaagatgggtggggctgccctggaagaagygagtgcagactgggccttggattccccctgtctttgtgttgtttcttgcagctggatcagatctgcatttcttttgacgaaggcaagaccacaatgaact

SEQ ID NO: 21080 - DNA, 201 bp, Homo sapiens
gccagcacagccgtcagggtgaggtcctggccagccggaaggatttcaggatgaacacgtgcgttccccaccccagaggggccttcatgttggagccagarggcatgtcccccatggaaccagcgggcgtttcccccatgccagggacccagaagggtgagggcttggatgcggggggcttggtgggaaggaagggagggt

SEQ ID NO: 21081 - DNA, 201 bp, Homo sapiens
acagtaagaaggtgggccctgcttgacgctggtcttggcattttggtggccagtgggaccacagtcggctctccttctggggcaggtgcagtggtcgtccygtctgtgacctacctccctctctcctcaggtctcagccaattcctcagcaccttccaacaccaagaacaatttttaatttaaaatcgcacagccaggcag

SEQ ID NO: 21082 - DNA, 201 bp, Homo sapiens
acacgtgcgttccccaccccagaggggccttcatgttggagccagagggcatgtcccccatggaaccagcgggcgtttcccccatgccagggacccagaakggtgagggcttggatgcggggggcttggtgggaaggaagggagggtcttctggttggactcttgtggggtgccctgtgcttgccacctctggtcttggga

SEQ ID NO: 21083 - DNA, 201 bp, Homo sapiens
agggaggaagtagccatcagggtccctttggtgccgtctggtctcggcactccttggagctgatcactctcttgctccctgcctaggcccctctccagaasgcccgatgcccctgggtgggggcgaggacgaggatgcagaggaggcagtagagcttcctgaggcctcggcccccaaggccgctctggagcccaaggagtc

SEQ ID NO: 21084 - DNA, 201 bp, Homo sapiens
cccgccgcctccgctcccctacaccccgtccccctcaccgagcgtggtgaccaggtcccttaagtctggcgggcctgcgccgtccatgcagagcagcgcckcctccacctccagggcgtggcccacgcagcgacccaggggcttgtccatggcggtcagcgctgccgcgacccgaagccctaggctggctcccacgccaac

SEQ ID NO: 21085 - DNA, 201 bp, Homo sapiens
taaagctgagggaggaagtagccatcagggtccctttggtgccgtctggtctcggcactccttggagctgatcactctcttgctccctgcctaggcccctstccagaaggcccgatgcccctgggtgggggcgaggacgaggatgcagaggaggcagtagagcttcctgaggcctcggcccccaaggccgctctggagccc

SEQ ID NO: 21086 - DNA, 201 bp, Homo sapiens
cagcagctcccagaccagggaggccacacccagccacacagtgggcagcgtcagtgtcttcagccactgagaaaactggtggaaggtgaaagctggtggasgaggggggtgtgaggactggtccgcccctgccctctggcccccccaggtcggcactcactggttctggagtggatggtgcgctgctgccagtcaacctcc

SEQ ID NO: 21087 - DNA, 201 bp, Homo sapiens
atcttgttcttttgaaccagtcaacctatggcccctccaagctttttcttggtggaagatcttcatgctttctgcccccacttgggaatcttcttttttgkttttatttatttatttatatattttgagacggagtctcactctgagacggaagtgcagtggcgcgatctgagctcactgcaagctccgcctcctgggttc

SEQ ID NO: 21088 - DNA, 201 bp, Homo sapiens; identical to SEQ ID NO: 3603

SEQ ID NO: 21089 - DNA, 201 bp, Homo sapiens
ggccaatggggttgccagctccggggtcccccaggaggcagagaatgaggtgagtttctttggcatgtggtccccgcccactgtgtgtttgcctgggctcygcccccacgagctctgtctccctccagttcctgtcgctggatgacttccctgactcccggactaacgtggatctcaagaatgatcagacgcccagtgtga

SEQ ID NO: 21090 - DNA, 201 bp, Homo sapiens
gccattttcctgcctcagcttcccgagtagctgggactacaggcacctgccaccacacccggctaatgttttgtatttttagtagagacggggttttaccrtgttagccaggatggtctcgatctcctgacctggtgatccgcccgtgtcggtgtcccaaagtgctgggattacaggcatgagccaccgcgcccagccaaa

SEQ ID NO: 21091 - DNA, 201 bp, Homo sapiens
tcctcatgcctcctgggaaagcagcaccaggcacacagccaagcacaaaagacgcctttattggtgcccagatctaaagggcaggatgggctggtgtgaaratgacgtggaagatgacagtgcttcccctcttcccctgggagtcagcctcttcccctctggcacggggcctagggttgggggctctagactcagaccccc

SEQ ID NO: 21092 - DNA, 201 bp, Homo sapiens
ggctgacctcccagtcggggtcaggaacgcccaaccctccccacgcaccgatctgtgcgccctgcgcgctcccattcaccacagcggccacgaagcccctsatgtccgcttcgctcaggcggcctccgtctcgcttcatgcggatcagctccgggagctgcttgggctctggcgaagggtcgggaagtccctggctccctt

SEQ ID NO: 21093 - DNA, 201 bp, Homo sapiens
gagggtggctgtgcatcccctactcctttgggagggacggctgtgcaccccctacttctccagcgccttcttgtgctctgtgcccaggagactccagaccyctggcagagcctggacccctttgactccttggagtctaagcccttcaagaaaggtaattgggtggaaggtacctccactcaggtacccctggctgggttt

SEQ ID NO: 21094 - DNA, 201 bp, Homo sapiens
ccgctcccgcccaagcactgacaaggtttcgcggcaaaggagctttattgctgcggcggcagaacgagctctgcgaagggcgagggggcggcgaatggcgygcggtcggagagtacgagcgcctcctgcagggcgcggctctgcgggccgctgagcgcggggccgtcccggtgcacgcggagccagggggtccctgcagag

SEQ ID NO: 21095 - DNA, 201 bp, Homo sapiens
ggctacctcctcccctcccagccccggcgtccgcacctcgcggcggggccgcgcgtcagtggaccaagcacgagaggaagcgccgacctccagctccctgsgctctgccccgccggctcagggaaagcgggcgccacacgctcacaggcagggcgcaggcgtccccggagctgcgcatgcgcacacgggcgcagccgctga

SEQ ID NO: 21096 - DNA, 201 bp, Homo sapiens
cggcccaggcccagtgactcatgagtaaccttgaccagtgttctcattagtgaccctaatgatccaccagtgatcttttagtgattctggccagggtctcsatcatcaacctggattaatgactgatccgtggcgccccgtacctgctctgggctctggatgacattgaatccaggaatagactccagcttatccaaggtg

SEQ ID NO: 21097 - DNA, 201 bp, Homo sapiens
tgtcagcacctagaaagtccacaaccaccaccctcacggtggggcctctgttctgtggaggagaaggacaggaagtgagtgacgggctctgtcctgcaggycccgtggcggcaggagctgggacagggcagggccaggacaggaggaggggctggggtgatgctggcgggagcacacgggcggaggagcagcagggctgca

SEQ ID NO: 21098 - DNA, 201 bp, Homo sapiens; identical to SEQ ID NO: 3604

SEQ ID NO: 21099 - DNA, 201 bp, Homo sapiens
tcggcccaggcccagtgactcatgagtaaccttgaccagtgttctcattagtgaccctaatgatccaccagtgatcttttagtgattctggccagggtctscatcatcaacctggattaatgactgatccgtggcgccccgtacctgctctgggctctggatgacattgaatccaggaatagactccagcttatccaaggt

SEQ ID NO: 21100 - DNA, 201 bp, Homo sapiens
  misc_feature (1)...(201): n = A,T,C or G, or insertion/deletion polymorphism (see Tables 1-2)
caggaggaggggctggggtgatgctggcgggagcacacgggcggaggagcagcagggctgcaggccgtcggcagagtgggtgccaagcacgaggggcctcnccaccaaggaccgtgtgatgaggcacactgtgggaaccacagtgctgtcagggtcacacgttgagaaggccacgctcgcggctgcgtggaccatagaggg

SEQ ID NO: 21101 - DNA, 201 bp, Homo sapiens
agctgcccagctcacagctaccccttcccagacgcagtgccgatgtccctgagctacgaggagctggttcgaaggaatgtggtaggcctgggttagagggrgacggggaggggagggggacaggtgagcggtgcccaggcccctgcttgggaggcagtagctcctgctgatcctcccctaggagctcttcatcgccacctc

SEQ ID NO: 21102 - DNA, 201 bp, Homo sapiens
ggagccctcacaaggcctttgtctgcagacatggaggtcctgtactggacacacgtgaaggagcagttggaaactctccggaagctgcagaggagggaggyaagtcccagctggtcagctgtgatctaggaccccgtggtggccctgatgggaggtgacagtgcccctcacagatgctttctctggacaggtggctgagca

SEQ ID NO: 21103 - DNA, 201 bp, Homo sapiens
cccctttgactccttggagtctaagcccttcaagaaaggtaattgggtggaaggtacctccactcaggtacccctggctgggtttcctggggcatgaggtrggggggtgggagtgggctttgcaccctgatcccccagcggctctaagacagtccctgtttgcccccaggtaggccttactctgtgcccccctgtgtggag

SEQ ID NO: 21104 - DNA, 201 bp, Homo sapiens; identical to SEQ ID NO: 3608

SEQ ID NO: 21105 - DNA, 201 bp, Homo sapiens
gggccagaccgggatccacgccctgcgccgccagcatccgctcgaagcggccaagggccgagccgtcgtccagcgccgcggccacccgggcagcgccctgrgcctgagtccccgcgtgtccgctgagccagagcagggcgccccctgcgggcggggacgggtcttaggcgcggccgggtcggggcggccccagcgggaagc

SEQ ID NO: 21106 - DNA, 201 bp, Homo sapiens
tgcagactgggccttggattccccctgtctttgtgttgtttcttgcagctggatcagatctgcatttcttttgacgaaggcaagaccacaatgaacttcaytgaggcagcgttgttgatccagggctctgcctgcgtctacagtaagaaggtgggccctgcttgacgctggtcttggcattttggtggccagtgggaccac

SEQ ID NO: 21107 - DNA, 201 bp, Homo sapiens
ggccacacccagccacacagtgggcagcgtcagtgtcttcagccactgagaaaactggtggaaggtgaaagctggtggaggaggggggtgtgaggactggyccgcccctgccctctggcccccccaggtcggcactcactggttctggagtggatggtgcgctgctgccagtcaacctccaggccaaagtagtgcacagtg

SEQ ID NO: 21108 - DNA, 201 bp, Homo sapiens
tgttaacgtttcttcactctagttggtagatggcatggatatttgtcatattctattcatttttcctagttttgaagaagagtaccccgtgaccactgtttgtgttttctgtttgttttttgagatggagttttgctctgtcccccaggctggagtgcagtggtgcgatcttggctcactgcaagctccgcctcccgggtt

SEQ ID NO: 21109 - DNA, 201 bp, Homo sapiens
gttaacgtttcttcactctagttggtagatggcatggatatttgtcatattctattcatttttcctagttttgaagaagagtaccccgtgaccactgtttgtgttttctgtttgttttttgagatggagttttgctctgtcccccaggctggagtgcagtggtgcgatcttggctcactgcaagctccgcctcccgggttc

SEQ ID NO: 21110 - DNA, 201 bp, Homo sapiens
ccgccgcctccgctcccctacaccccgtccccctcaccgagcgtggtgaccaggtcccttaagtctggcgggcctgcgccgtccatgcagagcagcgcctyctccacctccagggcgtggcccacgcagcgacccaggggcttgtccatggcggtcagcgctgccgcgacccgaagccctaggctggctcccacgccaacc

SEQ ID NO: 21111 - DNA, 201 bp, Homo sapiens
gcctctggcgccttgtggagggagccgctgtgctgccctggttgtttgtagacagtgtgccctgggggccttccacttccaaaacaggtttttgttatagraagtagggggaaacacagagacctgtctctgccccgaaataccagggacaaccggtgagcccacagcatagctagagctgcccgtctcgggaggtgctgg

SEQ ID NO: 21112 - DNA, 201 bp, Homo sapiens
aggttcccttttcttctctgtgtcggggatcttcctgctggagtctgtcagcctctggcgccttgtggagggagccgctgtgctgccctggttgtttgtaracagtgtgccctgggggccttccacttccaaaacaggtttttgttataggaagtagggggaaacacagagacctgtctctgccccgaaataccagggaca

SEQ ID NO: 21113 - DNA, 201 bp, Homo sapiens
gcacacagccaagcacaaaagacgcctttattggtgcccagatctaaagggcaggatgggctggtgtgaagatgacgtggaagatgacagtgcttcccctyttcccctgggagtcagcctcttcccctctggcacggggcctagggttgggggctctagactcagacccccacagcccagggcaggggaagggtcttgagc

SEQ ID NO: 21114 - DNA, 201 bp, Homo sapiens
aggtggccgtcttcttgcggctgccgtggccaggctcagcagccaggtgctggtcgtccagcagcgcagtggtaagcaccagcgtcatcaggttgaagaarttgtagttgccggtgatgataatcaggacctgcagcagcacctgggggcggcccgctctcagtgctcccggagactgacgcctggccccgtggcaggcac

SEQ ID NO: 21115 - DNA, 201 bp, Homo sapiens; identical to SEQ ID NO: 3616

SEQ ID NO: 21116 - DNA, 201 bp, Homo sapiens
cacaggtggccgtcttcttgcggctgccgtggccaggctcagcagccaggtgctggtcgtccagcagcgcagtggtaagcaccagcgtcatcaggttgaaraagttgtagttgccggtgatgataatcaggacctgcagcagcacctgggggcggcccgctctcagtgctcccggagactgacgcctggccccgtggcagg

SEQ ID NO: 21117 - DNA, 201 bp, Homo sapiens
ggatccttccgctcccgcccaagcactgacaaggtttcgcggcaaaggagctttattgctgcggcggcagaacgagctctgcgaagggcgagggggcggcraatggcgcgcggtcggagagtacgagcgcctcctgcagggcgcggctctgcgggccgctgagcgcggggccgtcccggtgcacgcggagccagggggtcc

SEQ ID NO: 21118 - DNA, 201 bp, Homo sapiens
ccctgcagagcgaggggctgttagaggccgcgcggccggagctgggcgggggtgcggggccagcagggcgggggcggcgctcaccacggcgcagcctctgwcccacgtcgaccagcagctctgcgcccacccccaggcggagcggctccccagcgcggctgcgcccggccccgagctcgtgcagcaccagcgccagcggca

SEQ ID NO: 21119 - DNA, 201 bp, Homo sapiens
tccgcagccctggatccttccgctcccgcccaagcactgacaaggtttcgcggcaaaggagctttattgctgcggcggcagaacgagctctgcgaagggcragggggcggcgaatggcgcgcggtcggagagtacgagcgcctcctgcagggcgcggctctgcgggccgctgagcgcggggccgtcccggtgcacgcggag

SEQ ID NO: 21120 - DNA, 201 bp, Homo sapiens; identical to SEQ ID NO: 3606

SEQ ID NO: 21121 - DNA, 201 bp, Homo sapiens
tagtggggcaccgtcgcacccccagggacccaaagtctctcgggctgacctcccagtcggggtcaggaacgcccaaccctccccacgcaccgatctgtgcrccctgcgcgctcccattcaccacagcggccacgaagcccctgatgtccgcttcgctcaggcggcctccgtctcgcttcatgcggatcagctccgggagct

SEQ ID NO: 21122 - DNA, 201 bp, Homo sapiens
tggctctgctctccattttagcctcattttgggctgttttgtatcttgttcttttgaaccagtcaacctatggcccctccaagctttttcttggtggaagrtcttcatgctttctgcccccacttgggaatcttcttttttgtttttatttatttatttatatattttgagacggagtctcactctgagacggaagtgcag

SEQ ID NO: 21123 - DNA, 201 bp, Homo sapiens
tctggaggaggtaagggcggcgggggagtgacgcggggtgggccggcgggtggggctgcggggcgggggctccgggcccggggctgtgggcgccccaccgyctccacgcctatggctatctggcgctctggccgcgcaggtcctcgggctccctgcttcttttcaaactccatctctgcctccccaaatcatcccttgttg

SEQ ID NO: 21124 - DNA, 201 bp, Homo sapiens
tagagtgggagtcctgtgggggtgttggaggggagaacccctgggagggcagggggctggacaagtgacacgcacaggtggccgtcttcttgcggctgccrtggccaggctcagcagccaggtgctggtcgtccagcagcgcagtggtaagcaccagcgtcatcaggttgaagaagttgtagttgccggtgatgataatca

SEQ ID NO: 21125 - DNA, 201 bp, Homo sapiens
ccagctgtaggtgctccacggcaccaaacaggcggtgggccccggtccagaggcgcccgtgggtcccgggctccacgtaggagtacggcacctggagacargtgggaggttctcagggctgccctgcccccagcccatcccccagccctgcagcgctacccaccaggctaatcaggaacaaggccacggtcgcagtgccca

SEQ ID NO: 21126 - DNA, 201 bp, Homo sapiens
agccaggtgagaagagagctccccggtgggactggcagggcagccaaagaggggaccagggaggcagcacccagtggacagggctccaaggggctgctctyagctgccagcctcatgccccttctgtggcccatgggagtgaggcctcgccccggggaagcagccacagcccccggtgagcctcagcccatcttggttcac

SEQ ID NO: 21127 - DNA, 201 bp, Homo sapiens
acagtacccgccctgcccctcccctccccaccccgctccaccccagcccactccacaccccccaagcccgctccgcacctggctccttgccctgcagcagrcgcaagaccaggcttgtgaaccacgggctgtgcgtgtgtgggcccagggctgcaaaccacatctgccagtccaggcgtggctggtggggcaccacaaccg

SEQ ID NO: 21128 - DNA, 201 bp, Homo sapiens
cactggccccggaagtcagccttgcagcgagcccggcctctgtgatccagcaggtggaagtcgccctggcccacagctgcctggcgcagggcttctgttcrcttttgctgctgcagcctctccttctcagccctcagggccagccaggccccaccgagtccagccccgaacaggcctgtgatcagcagccgggttcgaagc

SEQ ID NO: 21129 - DNA, 201 bp, Homo sapiens
tctccagctcgtctgggcagatgtcagggcagtgagtgaagccaaagtacatcagcacccactggccccggaagtcagccttgcagcgagcccggcctctrtgatccagcaggtggaagtcgccctggcccacagctgcctggcgcagggcttctgttcgcttttgctgctgcagcctctccttctcagccctcagggcca

SEQ ID NO: 21130 - DNA, 201 bp, Homo sapiens
cggattcgaggactggctgcctgcccatcatgctcttgctcctgctggcctgtggtgttcccagcctgtggccctttgcacttgctctcttaaagaccccytcatgcgactctgggctcccaccctctctctagtgttcccctctgtgatccaggatttgagtgtggtcggctctgccccaggctgtcactgcacttgttg

SEQ ID NO: 21131 - DNA, 201 bp, Homo sapiens
ctgtttgtgttttctgtttgttttttgagatggagttttgctctgtcccccaggctggagtgcagtggtgcgatcttggctcactgcaagctccgcctccygggttcacgccattctcctccctcagcctcccaagtagctgggactacaggcgcccgccaccatgcctggctaattttttgtatttttagtagagacggg

SEQ ID NO: 21132 - DNA, 201 bp, Homo sapiens
tcatcaacctggattaatgactgatccgtggcgccccgtacctgctctgggctctggatgacattgaatccaggaatagactccagcttatccaaggtgcytcctgtgtgccccagaccacgtccgctgatcattggcacctggtggtcagggatgctgagtaccctgcacagtacccctcccccacctctgtgcatccct

SEQ ID NO: 21133 - DNA, 201 bp, Homo sapiens
agaggaacatttgctaagaaataaaatgaaccaagcagagcatagagcacaggagcacgacgaggatggtgcaaggcacccgccaaatcctctgggctccrtgactaaagctgagggaggaagtagccatcagggtccctttggtgccgtctggtctcggcactccttggagctgatcactctcttgctccctgcctaggc

SEQ ID NO: 21134 - DNA, 201 bp, Homo sapiens
gccctctgactgccctcctgggtctcctctctgggcagatgtggatggctgcatttaaagaggaacatttgctaagaaataaaatgaaccaagcagagcayagagcacaggagcacgacgaggatggtgcaaggcacccgccaaatcctctgggctccatgactaaagctgagggaggaagtagccatcagggtccctttg

SEQ ID NO: 21135 - DNA, 201 bp, Homo sapiens
gtgccctgtgcttgccacctctggtcttgggagctccctgtctctgggtgcctgctctagtctagacaggttggctggtgctcatcccacccatctgctgygccttgattacaagttaacatggtctcagtgccagagacctggtgcctggctcagggccctgctgtctccccccagcccaaggcctggagtctgctggtc

SEQ ID NO: 21136 - DNA, 201 bp, Homo sapiens
accgggcagggaccatcttggagaggggctgggctgaccttgtctgatccctgtctctcccagacaccgggaggactgaggagcagccaatggaagtttcygtgtgcaggagccctgtcccagcactcggcttctcccaggagccaggtgagaagagagctccccggtgggactggcagggcagccaaagaggggaccagg

SEQ ID NO: 21137 - DNA, 201 bp, Homo sapiens
cttccacttccaaaacaggtttttgttataggaagtagggggaaacacagagacctgtctctgccccgaaataccagggacaaccggtgagcccacagcakagctagagctgcccgtctcgggaggtgctgggcagagaccaaagatgggtggggctgccctggaagaagcgagtgcagactgggccttggattccccctg

SEQ ID NO: 21138 - DNA, 201 bp, Homo sapiens
gcccccacagtacccgccctgcccctcccctccccaccccgctccaccccagcccactccacaccccccaagcccgctccgcacctggctccttgccctgmagcaggcgcaagaccaggcttgtgaaccacgggctgtgcgtgtgtgggcccagggctgcaaaccacatctgccagtccaggcgtggctggtggggcacca

SEQ ID NO: 21139 - DNA, 201 bp, Homo sapiens
tgcagcctctccttctcagccctcagggccagccaggccccaccgagtccagccccgaacaggcctgtgatcagcagccgggttcgaagcccagggccctrgggctggccctgcccacctgtctctgcagggccctgccttgacaaaagccaggacctcagatgcagggcctggcctcccagggtcccagggaggacccga

SEQ ID NO: 21140 - DNA, 201 bp, Homo sapiens
ccttgccctgcagcaggcgcaagaccaggcttgtgaaccacgggctgtgcgtgtgtgggcccagggctgcaaaccacatctgccagtccaggcgtggctgrtggggcaccacaaccgggggcggccggctcaggttcccaggcttgtacatgaactcgatctcctgccaggcaggccgaggtcagctgggcccgctgacct

SEQ ID NO: 21141 - DNA, 201 bp, Homo sapiens
tcgtcccgctcggggtccacagtgatgaagacaggctgcactggaggcaaaccaggctctgcttccagctgccgcaccacctgcaccagcttctccagctygtctgggcagatgtcagggcagtgagtgaagccaaagtacatcagcacccactggccccggaagtcagccttgcagcgagcccggcctctgtgatccagc

SEQ ID NO: 21142 - DNA, 201 bp, Homo sapiens; identical to SEQ ID NO: 3611

SEQ ID NO: 21143 - DNA, 201 bp, Homo sapiens
tggtggtagaagaggtagaattatggaatcaggcctcctgtcaggatttctttttgacagtccctctcagacacctctgcctaaggccagctttgccattrcaaactctcccttctccctctctcccttcttctcttcctcttccttcttctcgctctttctctctctctctttctccctctctgtctcttatacacatac

SEQ ID NO: 21144 - DNA, 201 bp, Homo sapiens
ggatttaggaggacccttgtactccaggaaattctccaagtctccacttagttatccagatcctcaaagtgaacatgaagcttcagtttcaaattgaatayattttccatccatggattggcttgttttgttcagttgagtgcttgaggttgtcttttcgacgtaacagctaaacccacggcttcctttctcgtaaaacca

SEQ ID NO: 21145 - DNA, 201 bp, Homo sapiens
ccttctccatgtccctctccatcacctggaagtcacctctgggtgccactctggtgccttccttgtcgaagctgtagctgctcacatgacacctatccctrttatccagtttgcttgactgggacgttttgccttccccttcagccaggaagtgaaagtcccagtttttatttatcacaggtgttggtattggtggtagaa

SEQ ID NO: 21146 - DNA, 201 bp, Homo sapiens
gatggttaaggatgcccagaagattgaataaaattgggatttaggaggacccttgtactccaggaaattctccaagtctccacttagttatccagatcctyaaagtgaacatgaagcttcagtttcaaattgaatacattttccatccatggattggcttgttttgttcagttgagtgcttgaggttgtcttttcgacgta

SEQ ID NO: 21147 - DNA, 201 bp, Homo sapiens
ctcttagaagtatttaaatttcctaaagtaaatttatctcaaccagtaacaggaccctcccaatactggaaagttgagtgtgaccgcatttagtggtgatragtgtgagcttgcttggggagagggcaggacatttaggatttcttaagcttagagtcaatacaataaagattattgagtgctcacttgggtgggctataa

SEQ ID NO: 21148 - DNA, 201 bp, Homo sapiens
ttttcagctcttcagagactgacaccaggtttgttacacggcttaaaatgatgagtatatccattgaatctcaaccttatctctctctagaccttcttggytaagaaaccatgtagtttgtatgaagtaggtactcaaaagatatttgatgatttaatttttactggagaagaaatattcatatatgttttcttattttta

SEQ ID NO: 21149 - DNA, 201 bp, Homo sapiens
ataactttaatacagagcagaaagtaatgaactactgcaatggagttatcacagtgctaaggatgctcagagggcatctctgataggcagaggtgagggtragggaaggaagctgtagtctagctagctagagctgctggaatagacatgacaatggctgctgccaaactgttttctcttctgaggacagatgtcccgtgc

SEQ ID NO: 21150 - DNA, 201 bp, Homo sapiens
ctcttcatccctgtcttctgcaaaggtgagtgagacttttggagcatgaagatggaggaggtgtttctcctacctgggtttcatttgtttcagcagtcaarggcagtgatttatagcaaagccagaagttaaaggtaaaactccaatctggcttggctggctctgtattccagggccagcagggagcagttgggcggcagc

SEQ ID NO: 21151 - DNA, 201 bp, Homo sapiens
gccatgaaggagcatgagttcactgagttccctttggcttttccatgctagcaatgcacgtggcccagcctgctgtggtactggccagcagccgaggcatsgccagctttgtgtgtgagtatgcatctccaggcaaagccactgaggtccgggtgacagtgcttcggcaggctgacagccaggtgactgaagtctgtgcgg

SEQ ID NO: 21152 - DNA, 201 bp, Homo sapiens
tgaaaggttttgctctacttcctgaagacctgaacaccgctcccataaagccatggcttgccttggatttcagcggcacaaggctcagctgaacctggctrccaggacctggccctgcactctcctgttttttcttctcttcatccctgtcttctgcaaaggtgagtgagacttttggagcatgaagatggaggaggtgtt

SEQ ID NO: 21153 - DNA, 201 bp, Homo sapiens
accaagattcttttacccagcattttttttacaaccatttgaattttcttgctatgacagaattagtttcataagagcataattaaggaatctggtaagaygtctttgaaagttctaattacaaccctcatctcttcttatgttaaactgtcttcattcatttacctacctatttaacaaatgtttaaagaatgctcgttt

SEQ ID NO: 21154 - DNA, 201 bp, Homo sapiens
acaagttttgagtttcacttgtcagactgactggagaggggcctggttagttacaggaaggtaatttggcatgcagccactatttttgagttgatgcaagyctctctgtatggagagctggtctcctttatcctgtgggaaaagagaacaaaggagcatgggagtgttcaagggaaggagaaataaagggcagagaggcag

SEQ ID NO: 21155 - DNA, 201 bp, Homo sapiens; identical to SEQ ID NO: 3684

SEQ ID NO: 21156 - DNA, 201 bp, Homo sapiens; identical to SEQ ID NO: 3687

SEQ ID NO: 21157 - DNA, 201 bp, Homo sapiens
tccgcagtcttatccccatgccagcgtatacccaagcctccaacctggaggctcagccacatgcccagtctctatgcagggtcctgactcaggaggttttyaagaacctttattcaaccagagtccatctcttctgtggtctagctctactcttgggtcccacattgttttaactgcttctgtttcagtttctccaccaga

SEQ ID NO: 21158 - DNA, 201 bp, Homo sapiens; identical to SEQ ID NO: 3690

SEQ ID NO: 21159 - DNA, 201 bp, Homo sapiens
ccagctgctagaactagggccctaatccctcctgtcatttttcttgctggagacttgagtattctcccaagcccagccacagggaccacagagaccttgtratctgacattcttccaagggctgcagccatctcagcatcatttccggtcactattctctacctccccttcctttgtgtgataaccctcatccttgtctat

SEQ ID NO: 21160 - DNA, 201 bp, Homo sapiens
taaacattgaaagcaaaatacctaatctttcagtgttaatacctttcaaatttcaattattatttgaaggatttcctattgcagtatgtcctatttatacrtaagtgctttgtgaagggtaggtacttactgaattttgtggaaagagtgagtaggttaatgagaataaatttgtgaatttgtgttacaaaaatgaaaata

SEQ ID NO: 21161 - DNA, 201 bp, Homo sapiens
cgcacactgactaaatacatactacagtttaggcaccgtgccaggcataaagaaggatcaggtactgcctttggcaaggcaagatattttcccagtttggyccctttcaaatacagttgttccctaattcatcctgattttaaagtagtgaatcttgtccaatattgaacttggcttctgaacattaagcattcatccatc

SEQ ID NO: 21162 - DNA, 201 bp, Homo sapiens; identical to SEQ ID NO: 3691

SEQ ID NO: 21163 - DNA, 201 bp, Homo sapiens; identical to SEQ ID NO: 3692

SEQ ID NO: 21164 - DNA, 201 bp, Homo sapiens; identical to SEQ ID NO: 3693

SEQ ID NO: 21165 - DNA, 201 bp, Homo sapiens; identical to SEQ ID NO: 3694

SEQ ID NO: 21166 - DNA, 201 bp, Homo sapiens
catgcagccagttggccatgcggagctctctagctcacatctgaggtcccccttggaggtgcagacagcctcattttcacttctcatgaatgtcagattcytttctaagcatttgctcattagtatgagtaaagctcattgcctgctgcttgggtaagaattttctctctggggctggactctgagtctgcatccataatg

SEQ ID NO: 21167 - DNA, 201 bp, Homo sapiens; identical to SEQ ID NO: 3695

SEQ ID NO: 21168 - DNA, 201 bp, Homo sapiens
acataaacaaatcaagcaaatgattttatgggaaggagaaagatgaacaagtaggtcaccacagaaatcctgcaggtaagtgacaagagtgaagtactgtyagggcagaaggtgaatggtcaatatatcagtgctaattattttcatattttctaacatttctagataaactttagcttcacaagtctgtaaagtaatatt

SEQ ID NO: 21169 - DNA, 201 bp, Homo sapiens
aatggtcaatatatcagtgctaattattttcatattttctaacatttctagataaactttagcttcacaagtctgtaaagtaatattctccagattctagwtggtcagtgttgtagaggtaataatttctaatacttaatatggtttatttgaagtagacaaattacattgatttcaaggtagcctatttaaaactggtca

SEQ ID NO: 21170 - DNA, 201 bp, Homo sapiens
aaaatagctctctggtcaaaaaaaaaaaaaaaaaaaaccctctgcccttcactcaacaaagacatagcctttcctcctctgggccaggtactggcccccartctccatcagactctgtgcatccttctgtaggaatgatcgagattgtgaaagacgccacgacaattgccaaaattcagcaaagcacagtgggcaacacgg

SEQ ID NO: 21171 - DNA, 201 bp, Homo sapiens
ttattttacaggtatgctaattttaagattgttttcaattatctgaaaacaattctatattacatcaaaaacatgctttctcctactggctctattcccastctcttctttcaagtgatgaattgtgatcaaatattacatcatagagagttttcacttggggaatttggctgcagactattagatatgcaatctaatgag

SEQ ID NO: 21172 - DNA, 201 bp, Homo sapiens
ctgcgccaagacatgcttattttacaggtatgctaattttaagattgttttcaattatctgaaaacaattctatattacatcaaaaacatgctttctcctrctggctctattcccactctcttctttcaagtgatgaattgtgatcaaatattacatcatagagagttttcacttggggaatttggctgcagactattaga

SEQ ID NO: 21173 - DNA, 201 bp, Homo sapiens
ttttacccaaatattgaaaatcattctccaactaggactttgtccttgttgtttatagtgatgttttgcaagagaatttgtgtctccaccatgtatattcsttattcattgtgtgtggggaacatgtgactgcttccttacagattgaaaaatgtaaagtaatggcctccaagaaaaaaccactatggcttgagtttaaat

SEQ ID NO: 21174 - DNA, 201 bp, Homo sapiens
ctccatttccttttccctgattcaacgacatagagtacagtcctacaaatgccaatgtgttcttcctttaggctgtgaaatttgaaccataccatgatagygcccttgccagatttctgctgaagcgtggtttaagagtaagtacttccattttgataatagcgtgaaattttaagttgccaagaattaactggtagacct

SEQ ID NO: 21175 - DNA, 201 bp, Homo sapiens
tgcactgttaggtctaataatcagtgaccttctctgttttgccaaaataattcctaaagactggctagccaatgcattgatttttattaaaaaaacaaaayaacaaaataaaattctctgcctttgactggaatgatttttatccattgtctccttcctctagcagacagaggcaacattactatttaggaaaagtaagtg

SEQ ID NO: 21176 - DNA, 201 bp, Homo sapiens
catacacaaagattagatatttccaaatctttacctttttcttcacatctctgaatatgcacatacagttttcaagtttacagtcttataaaatgatgaayttttgagaggctattttaattttttggcatttcttcatctatatatctcagagtgatatatagagatacattcattcttccctatctggggtcctacatc

SEQ ID NO: 21177 - DNA, 201 bp, Homo sapiens
aattattttactttccataatgcttttaagattcattcatgttattgtatgtatcagtaatttgtttctttttatgacttagtagtagtcccttgtatggmtataccacagtttgttttccattcattttttgagtaaatgtttaacagtggggtagttgggtcagatggtgtgtgtgtgtaattttacaagataccattt

SEQ ID NO: 21178 - DNA, 201 bp, Homo sapiens; identical to SEQ ID NO: 3696

SEQ ID NO: 21179 - DNA, 201 bp, Homo sapiens; identical to SEQ ID NO: 3697

SEQ ID NO: 21180 - DNA, 201 bp, Homo sapiens
atgtttctaaaggattgtggtttcttataatgtcaaactaggttccctcctaagttccacaccctacagaccattttcctcccaagtttcacattgcaagrtttgaagaggaggcagattggagagttttacgttacatggttacatggaagggaggggctgtctgggttttggttagcctgggaggctttgcgaatatca

SEQ ID NO: 21181 - DNA, 201 bp, Homo sapiens; identical to SEQ ID NO: 3699

SEQ ID NO: 21182 - DNA, 201 bp, Homo sapiens
tacttgaaacattacatttggctttgttttcatccattaaatatattcagtagttttttcactagttgagatatttgtataacactaaagaattttagaawaattaaagaatcttcagttttctagctctccataacagaaacaacatgaaaaaaacttggatgagctctgttgcaaaccccaaggctaacaggaattatt

SEQ ID NO: 21183 - DNA, 201 bp, Homo sapiens
gttggcaagtgatgcatggagaggaagtgaaccctttgattaaattactgttgccctttgactcttgtttcttcctcatgccattgtgattcactgaatcktcacctaaaatataagcagagcaatgagaaagttggcaattcatagatataatgctaatgaaatcaggcacaactaacttgctctctgaaaatggtttcc

SEQ ID NO: 21184 - DNA, 201 bp, Homo sapiens
aggctactgtgtggcaacctttgttcttggaataggcgacagacacaatgacaatattatgatcaccgagacaggtgagtttatttagtgcagaataaacytttattgtggtaaaatatatataacataacatttactattttaactctaattaactgtaagtgttcagttcagtggcattacatatgttcaccttgttgt

SEQ ID NO: 21185 - DNA, 201 bp, Homo sapiens
cagggacttgacacatttcagtcctgtttttctttaaagttaaaaatcacatgttttgacaacttcctggaacagagaaatggttccaaaaaaaaagaaarccctggaagaatttcaccatttaaaggggggaaaacactcatgtcttctctcctgtcagcggggttcatctgtttgtctgtttgcttcggacaaacagag

SEQ ID NO: 21186 - DNA, 201 bp, Homo sapiens; identical to SEQ ID NO: 3707

SEQ ID NO: 21187 - DNA, 201 bp, Homo sapiens
tgctgacagtaaggctccatcctcaacacaggatattttctgaagcattaatttttgtttcaatagttgatccttgtttggaatataatgtgttacaatgyagtggtacttagtattaaaatcaaaatacctttttattcatctttcaattttaatacttttagcatttcaaccattatttgaagggttacttactgcagt

SEQ ID NO: 21188 - DNA, 201 bp, Homo sapiens
acagttctttgggacagttggtttcacttactaagtataacttcatattttaagagagggaatattggttttaaaagttaagccaagatttgaacataagwttggatcaaatgaaatttgtctttcttatcttcttatcaagctctcctttttggtatacatcaaatgctccactatttcttaaggaaataatgtagtttt

SEQ ID NO: 21189 - DNA, 201 bp, Homo sapiens
aaacattaattttttgtttcaataattgattcgtttagaatataatgtattacaatgtagtgatactaaacattgaaagcaaaatacctaatctttcagtkttaatacctttcaaatttcaattattatttgaaggatttcctattgcagtatgtcctatttatacgtaagtgctttgtgaagggtaggtacttactgaat

SEQ ID NO: 21190 - DNA, 201 bp, Homo sapiens; identical to SEQ ID NO: 3703

SEQ ID NO: 21191 - DNA, 201 bp, Homo sapiens
tatcaatgtatcttacagttctcttctttgttagttattctataatgtagcaaaagaccaaaatgaatgttttaagccacaagagacagttctttgggacrgttggtttcacttactaagtataacttcatattttaagagagggaatattggttttaaaagttaagccaagatttgaacataagtttggatcaaatgaaa

SEQ ID NO: 21192 - DNA, 201 bp, Homo sapiens
ttccaaagtggttataccatttaaattccagcaatgtatacgatgagttctagttgtttcacatcctagcaagcacttgttatcatcagttttttttttgttttttttttttttttgagacggagtctcgctctgttgcccaggccggactgcggactgcagtggcgcaatctcggctcactgcaagctccgcttcccggg

SEQ ID NO: 21193 - DNA, 201 bp, Homo sapiens
ctctgttgcccaggccggactgcggactgcagtggcgcaatctcggctcactgcaagctccgcttcccgggttcacgccattctcctgcctcagcctcccragtagctgggactacaggcgcccgccaccgcgcccggctaattttttgtatttttagtagagacggggtttcaccttgttagccaggatggtctcgatct

SEQ ID NO: 21194 - DNA, 201 bp, Homo sapiens
agagtacagtggcatgatctcagctcactgcagcctccacctcccaggttcaagcaattctcctgcctcagcctccagagtagctgggactacacgtccgygccaccatgcctggctaatttttgtatttttagtagagacagggtttcaccatgttggccaggatggtctctatctctcgaccttgtgatccgcctgcct

SEQ ID NO: 21195 - DNA, 201 bp, Homo sapiens
ccacagctttaacatacatatatgcagaatttccaaagtttacagcatgacaaagatggacagcagagtttttcatcatttgactatgaccttgtggtaatttttttttcttttacatactgctaagccttccaaaaagattttctgtttcttggttttatgttttcttttagaattgaagttcttcaagatcagggacca

SEQ ID NO: 21196 - DNA, 201 bp, Homo sapiens
aggcgcctgccaccacatccagctaatttttcatatttttagtagagacggggtttcaccgtgttaaccaggatggtctcaatctcctgacctcgtgatcyggctgcctcagcctcccaaagtgctgggactacaggcgtgagccagcgtgcccagccccgaatgtgttgttttttaaaattttaaaactagtaaatgttg

SEQ ID NO: 21197 - DNA, 201 bp, Homo sapiens
cgtgttaaccaggatggtctcaatctcctgacctcgtgatctggctgcctcagcctcccaaagtgctgggactacaggcgtgagccagcgtgcccagcccygaatgtgttgttttttaaaattttaaaactagtaaatgttgtttattaaaatcaagagccagcaaaatattgaaaataccaaaagacataaaaattcatt

SEQ ID NO: 21198 - DNA, 201 bp, Homo sapiens
aatcactggctcaaagaaaaatcccctactgaagaaaaggtgagctcatgctttttcccagtctaatggctccttacaagttgtcatttatatagcagtastggcttcaagttttcagagaatctgccagtgtcttgcctcctgacatattagtgaagttttttacttgtgaaataatggaggttttaagtaccctcccgt

SEQ ID NO: 21199 - DNA, 201 bp, Homo sapiens
ggtttttgtctttagttctttgtatgtgagaatcacatttattgatttgcgtatgttgaaccaaccttacatcctggggatgaaacctacttgatcatggkggattagctttttgatgtgctgctggatttggtttgcaagtatttgaagatttttgtattgatgttcaccaaggatattggcctgaagttttcttttttg

SEQ ID NO: 21200 - DNA, 201 bp, Homo sapiens
aatgattgggggtcttaacagaaggtcactggagtccagaaatcctgccttccatcctgtagctcctccattattaagtagagacagatcaaatgaatttwaattaattaattaaacaatgttaaaattacctaaatgttcctattgggagagtacagccttgggtgactcttctaagatactgccctaatatagcagtga

SEQ ID NO: 21201 - DNA, 201 bp, Homo sapiens
aacttcctggaacagagaaatggttccaaaaaaaaagaaaaccctggaagaatttcaccatttaaaggggggaaaacactcatgtcttctctcctgtcagyggggttcatctgtttgtctgtttgcttcggacaaacagagcagcaatgaactgcaacttaaagatcagacatacgcaaggaatttggcctcattgacgac

SEQ ID NO: 21202 - DNA, 201 bp, Homo sapiens
tgcattaccttctacaattggtccaggtaggggatgttggtgttatcaatggaagccttctcaaaaggaattgatttgcatatgcacaggcactccattcrgttgtcatcaaatgccctttgttcagagcttcatcatcggcaaaagtagatatgatgaagctgcctcaaaaagtagtaaactgttccatgtacattttta

SEQ ID NO: 21203 - DNA, 201 bp, Homo sapiens
tatatgcttttataataatctgaacaatgtttgttagtgttgctgcttttaaaattatgaactatttcaaacttacagaaaagcacagagaacaatgaaayacctatgcactcacaagatttaattgtgttttttacattttatcagttcttcctcatcagtaatggagctgtactaagtcaatattctctaacatcagcc

SEQ ID NO: 21204 - DNA, 201 bp, Homo sapiens
tcctttttgccagtaatttttcctagaatgactgcacatctgtcctgttgctgacaacattcccatagaccccctggtgcccatatcaccccgtcagatcycagcagtacttctctttttttgctgttgttgctatttttaagtttcaaaatatgctttcacaaaaaggtttgcagtatagggaggccaaggagaggtttc

SEQ ID NO: 21205 - DNA, 201 bp, Homo sapiens; identical to SEQ ID NO: 3686

SEQ ID NO: 21206 - DNA, 201 bp, Homo sapiens; identical to SEQ ID NO: 3688

SEQ ID NO: 21207 - DNA, 201 bp, Homo sapiens
catctctacaaaaaataaaaaaaaatagccgggcatggtggcacgtgccatagtccccactacttggaaggctgtggtgggaggatcacttgagctcaggrgtttgatactgcagtgagctgtgtttgtgccactgcattccaacctgggctacagagcgagaccctgtttcaaaagaaatgaaaaagaaatctatctaat

SEQ ID NO: 21208 - DNA, 201 bp, Homo sapiens; identical to SEQ ID NO: 3689

SEQ ID NO: 21209 - DNA, 201 bp, Homo sapiens
tgtccttacatcaataccacacattcttgattatgtttaaataacaaagcacttcatatacgtgtgcttatacaggcaacagtatacttccattaaccccygcatcctttgcattatttttattatgatttcaacttctatatatgttataaatggcacaataagttactatttttgccctaaacagttaaaaaatagact

SEQ ID NO: 21210 - DNA, 201 bp, Homo sapiens
tcccaaagtgctgggattacaggcgtgagccaccgcgcccggcctatcatcagtctttttaaacttagccattcaaatgagtatgaagtggtatctcactrttgtttttatttgcatttccataataaggttgagtgtctttctatgtgctcattttccattagagtacattcttctgaaaattttctattcaaatatttc

SEQ ID NO: 21211 - DNA, 201 bp, Homo sapiens
acgtgttaagcatacatgttaaatgcctgtgaatctgtgcacgttgagccttaagcacacatacagcataacaaggtggttgaaaggatgggctttgtagyggagaaacttgagtttgaatgctggacctgcgacttaataaccacatatatgattattattcatcctttcataacatcagtttcttcatctgtaaagtgg

SEQ ID NO: 21212 - DNA, 201 bp, Homo sapiens
attctccaactaggactttgtccttgttgtttatagtgatgttttgcaagagaatttgtgtctccaccatgtatattcgttattcattgtgtgtggggaayatgtgactgcttccttacagattgaaaaatgtaaagtaatggcctccaagaaaaaaccactatggcttgagtttaaatgtgccgatcctacagccctatc

SEQ ID NO: 21213 - DNA, 201 bp, Homo sapiens
tatctgaataaattagaatcaacagaaattctttatgtgagtgaaatagccttcgagaaaagcaggacagttatttcctttaacgcctctccttgggtacrgcagggataggtgaattcctgcatcactgcttaacaagtatttactgagcaccagtggattggtgttataataacttggcctcaggttaatttccctcct

SEQ ID NO: 21214 - DNA, 201 bp, Homo sapiens
attttagcatctgtttttgcattttactttccaacttgtggatcctatttacagcattctatttattaatttttataaaaacctagtttattaaaaactasttacagtaatatttgattttttaaagacaattaggtcatttgtaaataataagttttccttcacttttctgattttattttatttatttatttatttatt

SEQ ID NO: 21215 - DNA, 201 bp, Homo sapiens
ttaacagaaggtcactggagtccagaaatcctgccttccatcctgtagctcctccattattaagtagagacagatcaaatgaattttaattaattaattawacaatgttaaaattacctaaatgttcctattgggagagtacagccttgggtgactcttctaagatactgccctaatatagcagtgacagccagaatgctg

SEQ ID NO: 21216 - DNA, 201 bp, Homo sapiens; identical to SEQ ID NO: 3698

SEQ ID NO: 21217 - DNA, 201 bp, Homo sapiens
attgttggccagaagggaagtctgggatcaaagtgctttggatgttgggttaacaatgcagctcctggactgcaacttctcagatgaaaatgtaagagccrttgcagttcagaaactggagagcttggaggacgatgatgttctgcattaccttctacaattggtccaggtaggggatgttggtgttatcaatggaagcct

SEQ ID NO: 21218 - DNA, 201 bp, Homo sapiens
tgcttctagctaaatattcgagaagatgacagtacagcccttctcctggtaaacagagctagtctgagaatcacttttcaagtacttacagataaaaatcytaattcaaactcatcaaatgcatggccaagtaccagacacactcctcttttggatttaccagaaagtgtgctctcatgcactgttaggtctaataatcag

SEQ ID NO: 21219 - DNA, 201 bp, Homo sapiens; identical to SEQ ID NO: 3701

SEQ ID NO: 21220 - DNA, 201 bp, Homo sapiens
ctttcttgtgacaaatccctgtgtccctccgctcccaggtcgcatagggcatggagctggagaactataaacagcccgtggtgctgagagaggacaactgycgaaggcgccggaggatgaagccgcgcagtgctgcggccagcctgtcctccatggagctcatccccatcgagttcgtgctgcccaccagccagcgcaaat

SEQ ID NO: 21221 - DNA, 201 bp, Homo sapiens; identical to SEQ ID NO: 3704

SEQ ID NO: 21222 - DNA, 201 bp, Homo sapiens
tggtgttgaagctttggggtatgatccagcaggtggcacttaggcttattggtcggttggtagactcttgcttggttgtgtggctcccccatgttaactcmcagttgcagccatgttctctctcaatgctctgaaagtgtgggtttctctcccccttgagtgctgtctgtagatcatgacttggcactcctcggatgccca

SEQ ID NO: 21223 - DNA, 201 bp, Homo sapiens
tataagatcgtttggtatcactgaggcagaagttattgctgtgtatttatatgctgcctaaatttggacatgttttatttcaagttagtgtcaatatcaaygtatcttacagttctcttctttgttagttattctataatgtagcaaaagaccaaaatgaatgttttaagccacaagagacagttctttgggacagttggt

SEQ ID NO: 21224 - DNA, 201 bp, Homo sapiens; identical to SEQ ID NO: 3705

SEQ ID NO: 21225 - DNA, 201 bp, Homo sapiens; identical to SEQ ID NO: 3706

SEQ ID NO: 21226 - DNA, 201 bp, Homo sapiens
acatttccatcagtgctttggatttcattagttcttggcaaacattatttacacttacataaagtttattgattccagtatgatgttcaaaagctgactcrttgctcttcagaaattacagaaatgtctaccctcaatctcttgggaaagaaactgaattaaaaaggtagagtaagaaataagctgaaacttgtctgtatc

SEQ ID NO: 21227 - DNA, 201 bp, Homo sapiens
attagcacttatcccagtttgtaatttaccatttgtgtcttatttgattaatgtctgtctcccatgtccagccttactctccatgaagccagggagcatayttcttttgtgtatcaatatatgcatttagtgacttgcatatagtaatcactcaataaatgtttgctgaaggaaatttaaggtttgtttactgtttccttt

SEQ ID NO: 21228 - DNA, 201 bp, Homo sapiens
  misc_feature (1)...(201): n = A,T,C or G, or insertion/deletion polymorphism (see Tables 1-2)
tatggatccatgttctgcatattagctcactcatactcatccaagactgtaactataggtacccaacacccagaattgagatggccactgaaaactctatncttgaccaacactctaatatcattttattttctttaattgcctttgtaagaagtataatacaaacaaaactccagtaagcaaatggctttaattatttgt

SEQ ID NO: 21229 - DNA, 201 bp, Homo sapiens
actttagtttcctgggatgttatctgtatcatgtaaaagaatgtttgattttgaactaaagttaaattctttctcattcttcatcttttggctcaaaagtyacttcttcaggggatacttttctgggcccccaaatctctctgctatgcagtctcacagtcctctgtactttccacattagcacttatcccagtttgtaat

SEQ ID NO: 21230 - DNA, 201 bp, Homo sapiens
gatccacccaccttggcctcccaaagtgctgggattacgggagtaatccaccacacctggcctttcatgcttttaggaaaaatttgaaattcttttaaacrtgggtcctggagaatcgctgaacttcctttttttttcttctattgagacagaatttctctctgctgtctatgctgattacagactcctgagcttaagaga

SEQ ID NO: 21231 - DNA, 201 bp, Homo sapiens
tcatgaagaagatggtcagaccaaggaagatatcacatttgtgaaaaggagggtattcaaaggccataaaaggcagaacttcaaaatattttaaaaagccraatgaactaaaatgttcacctgtgataaataatagcaacattgaacatttctcaagcacagagagtaatgtcccacccctgtactaagtgtgcacagtga

SEQ ID NO: 21232 - DNA, 201 bp, Homo sapiens
cattcagaaacagattttcaggtattttcagtatttggtggagttagggagctctgtgcaatctttcctatgagtatacatcccaggttaactatgcaccraagagatcaaggtgtgcaggggttgagaggggtcctctgctgattgagagtgattctttatcagtgtggatggagacaagaaagctgtgtgttcctcatt

SEQ ID NO: 21233 - DNA, 201 bp, Homo sapiens
gctttcataatgcattttaaagggtctgaatatccatccttcggccaatttctattaaggaggtgcagttttcaagaaggataaatcatatgtgctcttgygcccctatttttgctccccatcttctgtaaaatataaaactggtgtcactgagcacccaggtccctgagataaacagttggtttccctgtaggtaatgcc

SEQ ID NO: 21234 - DNA, 201 bp, Homo sapiens
ctctctctctctgagtttagttgtttctttttgctcgaatatatactccacttttatagcgtccccagtgcttagaatggtgtttggtttacagtgaatacctaccatttttctggtgaatgaatggattaataatctattaataacatggtatgtgtaataaaaatgtataggatctaggaaacatcctgtgtgtgggga

SEQ ID NO: 21235 - DNA, 201 bp, Homo sapiens
ctcatctgtagaataggaacgatactaatgcctacttgattgagtggctgtgaggatggatgaatccatgtagaatacttggtccagtttctgccacctastaagtgctcatttaatctaagctgtgattattaacactattaacaatattgtgttttctaaatatatagttggctttctatcacatagagaactttcttt

SEQ ID NO: 21236 - DNA, 201 bp, Homo sapiens
gacgaacatgcttgcagtacggtgatttctttatgctgggtcatgttgttgggagtgttttgttttgtttcggttttgttttgttttatccccccgctccsccaccaatgtacctcttttttcaaggagaagagtcactacgtttgatggcagatggaatcagacggtcactagggggtcttggcacaagcctttgtggtg

SEQ ID NO: 21237 - DNA, 201 bp, Homo sapiens
cttttgtttaaaatgatatgaagtagttacatttcagaaagttacattttggaaaagaataattttgattcctctggatcccataaaagagaaaaagttgtttttttattttcttttgttttttttgtgttttttttttttgtttttgtttttttttgcctctagacttatctttttcccactctttagaatattaaaaaa

SEQ ID NO: 21238 - DNA, 201 bp, Homo sapiens
atacattgcaagttacaatagtaaactcatcctcatgtggcattttcacaatcccagaaaagctggccactttaaaatgaaaaaatttaaaatggtgctatatatttagacaaaacatttggtttgttgatggtgtatttcatttttagagtgtgatttttgttttgtatatattcgtataatgttgacagtgtatatggg

SEQ ID NO: 21239 - DNA, 201 bp, Homo sapiens
aggtgggaggattgcctgaacccagggaggtcaaggctgtagtgagctgtgattgtgccactgcactccagcctgggtgacaaagtgagaccctgttttcaaaaaaaaaaaaaacaaaaattaactagatttatatttctcagtcttgttcttcacataacattttttattctataaattctgttgaatttattttcacaa

SEQ ID NO: 21240 - DNA, 201 bp, Homo sapiens
ggtgggaggattgcctgaacccagggaggtcaaggctgtagtgagctgtgattgtgccactgcactccagcctgggtgacaaagtgagaccctgttttcaaaaaaaaaaaaaacaaaaattaactagatttatatttctcagtcttgttcttcacataacattttttattctataaattctgttgaatttattttcacaag

SEQ ID NO: 21241 - DNA, 201 bp, Homo sapiens
ttctcatagtatttttggtaaacttcaagttcgtatgctgagcaacctacctttttttaatttttttatttttatttatttatttattattatactttaarttttagggtacatgtgtacaatgtgcaggttagttacatatgtatacatgtgccatgctggtgcgctgcacccactaactcgtcatctagcattagttat

SEQ ID NO: 21242 - DNA, 201 bp, Homo sapiens
cagtcccaccaacagtgtaaaagtgttcctatttctccacatcctctccagcacctgttgtttcctgactttttaatgattgccattctaactggtgtgaratggtatctcattgtggttttgatttgcatttctctgatggccagtgatggtgagcattttttcgtgtgttttttggctgcataaatgtcttcttttgag

SEQ ID NO: 21243 - DNA, 201 bp, Homo sapiens
agcggcagcaaacttgagaaagcagccccgccagtttcggtgacagcgcaccccacggagaccctgtctttgttcccacgggcgttggtccgatgctcctrgaaagcactttgcgggagaacgaggttctccgccgtttgcagcctgccctccctagcggagttctctgctgggcggcgcggtcccgggctctgctcagag

SEQ ID NO: 21244 - DNA, 201 bp, Homo sapiens
tgactttttaatgattgccattctaactggtgtgaaatggtatctcattgtggttttgatttgcatttctctgatggccagtgatggtgagcattttttcrtgtgttttttggctgcataaatgtcttcttttgagaagtgtctgttcatatcctttgcccactttttgatggggttgtttgtttttttcttgtaaatttg

SEQ ID NO: 21245 - DNA, 201 bp, Homo sapiens
tttgcccactttttgatggggttgtttgtttttttcttgtaaatttgtttgagttcattgtagattctggatattagccctttgtcagatgagtaggttgygaatattttctcccattttgtgggttgcctgttcactgtgatggtagtttcttttgctgtgcagaagctctttagtttaattagatcccatttgtcaatt

SEQ ID NO: 21246 - DNA, 201 bp, Homo sapiens
ttagacatgaagtctttgcccatgcctatgtcctgaatggtaatgcctaggttttcttctagggtttttatggttttaggtctaatatttaagtctttaarccatcttgaattgatatttgtataaggtgtaaggaagggatccagtttcagctttctacatatggctagccagttttcccagcaccatttattaaatagg

SEQ ID NO: 21247 - DNA, 201 bp, Homo sapiens
atatggctagccagttttcccagcaccatttattaaatagggaatcctttccccattgctttttttctcaggtttgtcaaagatcagatagttgtagatayacggcgttatttctgagggctctgttctgttccattggtctatatctgtgttttggtaccagtaccatgctgttttgcttactatagccttgtaggatag

SEQ ID NO: 21248 - DNA, 201 bp, Homo sapiens
tatggacttctttcataaatggtagaacacgtatccatcacaccttattggattaattcagaaatgccagatatatgtactctttgctgatggttactttkttggtctctaatttaagtcttatctctaatcacattagctgagaaaatggagacattatcattctaaaaataagatggttaacttttatattaggacact

SEQ ID NO: 21249 - DNA, 201 bp, Homo sapiens
agtaccatgctgttttgcttactatagccttgtaggatagtttgaagtcaggtagtgtgatgcctccagctttgttcttttggcttaggattgacttggcratgcgggctcttttttggttccatatgagctttaaagtagttttttccaattctgtgaagaaagtcattggtagcttgatggggatggcattgaatctat

SEQ ID NO: 21250 - DNA, 201 bp, Homo sapiens
tttggatcctaaagttttcttatttggagcagagctttgtgatagacaggaaagttctggaaaatgagctgagcgatcagactacaggatcccttaagtcyggtgcagtatttcatttttctgtgaatcttaggctcctactccttttccaatttacttcactccaatgtttatgttcctaagagtttgtctgttttccaa

SEQ ID NO: 21251 - DNA, 201 bp, Homo sapiens
ttgtaggatagtttgaagtcaggtagtgtgatgcctccagctttgttcttttggcttaggattgacttggcaatgcgggctcttttttggttccatatgarctttaaagtagttttttccaattctgtgaagaaagtcattggtagcttgatggggatggcattgaatctataaattaccttgggcagtatggccattttc

SEQ ID NO: 21252 - DNA, 201 bp, Homo sapiens
ggctgggtgtggtggctcatgcctataaatctcagcactttgggagtctgaggtgagcggattgcttgagcctaggagtttgagaccagcctgggcaacayagtgagactccatctctacaaaaaatacaaaaaattagccaggaatggtggtgtgcccttgtggtcccagctacttgggaggctgaggtgagatgatcgc

SEQ ID NO: 21253 - DNA, 201 bp, Homo sapiens
actgcccttttaatggtttaactggtgtttccccttaggtcatttaaattgtaagtaagtcttccaggtgattgttggattaattaagaaaataggaatcrtattcactttctgtttacctgtataatattccttcctgcctaagagtagttcgtgtttaactccaacttgaaaataagagaaacattgaagaaactatta

SEQ ID NO: 21254 - DNA, 201 bp, Homo sapiens
atacctagtttattgagagtttttagcatgaagggttgttgacttttgtcaaaggccttttctgcatctattgagataatcatgtggtttttgtctttggytctgtttatatgctggattacatttattgatttgcgtatattgaaccagccttgcatcccagggatgaagcccacttgatcatggtggataagctttttg

SEQ ID NO: 21255 - DNA, 201 bp, Homo sapiens
gaaagaggtatggctgtttattctgattcagattttctttagtgaaaaaaagaaaaaagagggtaaaagaaagcataataactccataaagaggaaagcgtttttttttttgttgttgttttttttaatcagttctgatttcctttctggtatctctgctggtgttttcaaaacttggcaactttgtggctgtggaagact

SEQ ID NO: 21256 - DNA, 201 bp, Homo sapiens
tagcaaagatggccttatacatggtaccacaacctatgtggtacgatgttaggagccctgataagatactctgttcccctacaatctgctccatcaagccrgtgaggaaggtatgtaggcattaggaatgcctaaaatgccacaattagaaaattcattccttggagggcttctgttttctgctgaaagtgcaaacacccg

SEQ ID NO: 21257 - DNA, 201 bp, Homo sapiens
gctgaggtaggaggatcccttaagcccaggagatgcaggttgcagggactgagaacatgcatggcactccagcctgagtaacagagtgagaccctttctcaaaaaaaacaaaacaaacaaaacaaaaaaaacaaccaatactagtcattcccagcatgggctgggcgtgaaaactggagaatggctaacatgagactcttg

SEQ ID NO: 21258 - DNA, 201 bp, Homo sapiens
caggacctctgggtaatgggcagtagccactcaatcagttccagatgtggttcctcttggttgggagacccataaactaataaacaatcagtgccttctgygcctgataggtattggcggaacaggggcaacacaatagaaataaacactcccattggaaagaaagaattggagactcatggccatcaccaatgtatagca

SEQ ID NO: 21259 - DNA, 201 bp, Homo sapiens
gctattcgaccttggacaaattacttaacttctctgagcctgttttctcatctgtacagtggagtttatggctgaggaagtaaaagtacttcataacactraggtatcctgtaaatacagagcgctgtttccctcaaatgatcaatatttttagaaaatccatgaaagacctgtgagaataatgatccaagggcaaactgc

SEQ ID NO: 21260 - DNA, 201 bp, Homo sapiens
acttaacttctctgagcctgttttctcatctgtacagtggagtttatggctgaggaagtaaaagtacttcataacactgaggtatcctgtaaatacagagygctgtttccctcaaatgatcaatatttttagaaaatccatgaaagacctgtgagaataatgatccaagggcaaactgcccttttaatggtttaactggtg

SEQ ID NO: 21261 - DNA, 201 bp, Homo sapiens
gtgagcggattgcttgagcctaggagtttgagaccagcctgggcaacatagtgagactccatctctacaaaaaatacaaaaaattagccaggaatggtggwgtgcccttgtggtcccagctacttgggaggctgaggtgagatgatcgcttgagcccaggaggtcgaggctacagtgagctgtgatcatgccactgcactc

SEQ ID NO: 21262 - DNA, 201 bp, Homo sapiens
caggaatggtggtgtgcccttgtggtcccagctacttgggaggctgaggtgagatgatcgcttgagcccaggaggtcgaggctacagtgagctgtgatcaygccactgcactccagcctcagcgacagagtgagaccctgtctcaaagaaaataaatacatagttgaaaagatacagataattaggttgatccatttgaga

SEQ ID NO: 21263 - DNA, 201 bp, Homo sapiens
gagccaggtgttacttattataatggatttagcctcttgtctaccttgataaaaacttcaaaaagtggacaagatgtcatctttcttaaggctcaaacaayaacaaaagcttgcctatgggatggtcatcaataaaaggaaggtaacaaggccctctagctcccactccactgagaataagatttgaggcccagtagtcca

SEQ ID NO: 21264 - DNA, 201 bp, Homo sapiens
atcatttgtttgaacaatggtgttttagaccaaaaaagtaagttttcatgaattctcctcctgcgtcagaaaggtagtgtgtaaagccatggattaaaaakaaaagttaaataaaatgcttatatactttatagtttgcacaacatctagaaattactaatcactaattttcctgtttcacattaaaaacataaaattctg

SEQ ID NO: 21265 - DNA, 201 bp, Homo sapiens
agaaagttacattttggaaaagaataattttgattcctctggatcccataaaagagaaaaagttgtttttttattttcttttgttttttttgtgttttttktttttgtttttgtttttttttgcctctagacttatctttttcccactctttagaatattaaaaaaatgcttgggtcagatactgtttgcattgcattgat

SEQ ID NO: 21266 - DNA, 201 bp, Homo sapiens
gagtccagaaaggcgcttgctcaaggtggaaggtgagtttgacatagtaggacttcctgaggtgaaagtatgtcttaggtatttgggcacaactggagccrtgaagagatattgcttgtgccaaggactgttaagggacacacacaggcacattgagagcatcaggaatggccaccttacagcatgcgaaggaagacagtg

SEQ ID NO: 21267 - DNA, 201 bp, Homo sapiens
gtgggaaagatatactaagtaggcacaagatcagagaagcagagtcacaggggccattgactggaggggcaggcagctcatcaacaggcgctaatgtaccrttggagtccagtgtggtgtacgattgtgtgtttattgtggtggtcctgaggaagaaggaggaggtgaaggagcagggactcagcagtaatttaaaaagta

SEQ ID NO: 21268 - DNA, 201 bp, Homo sapiens
cccctcccccgaccccaccacagtccccagagtgtgatattccccttcctgtgtccatgtgatctcattgttcaattcccacctatgagtgagaatatgcrgtgtttggttttttgttcttgcgatagtttactgagaatgatggtttccaatttcatccatgtctctacaaaggatatgaactcatcattttttatggct

SEQ ID NO: 21269 - DNA, 201 bp, Homo sapiens
attgcagaaggagaaaggaggacatgccttctctgtttaaaggagactttccagaagtcccacacaacactactgcttgcatttgatctcatcgattaagrcttagtcctatgatcacatttggctgaagtttggaaaatgtagctttttagctcagcacatagttcacctgagtaacactgggttctattactgaggaga

SEQ ID NO: 21270 - DNA, 201 bp, Homo sapiens
gcagggactcagcagtaatttaaaaagtagataaatgctatcaggaaaatacactctgtgggtgattcatcctctgatgagtggacattgctgagaggtgrtagtttgtgaactgacaatgcaaagacattcaagaggtggagctgtcttcttttgtagtgaagctgcagtagaatatgctttgtttgtatttaagtaata

SEQ ID NO: 21271 - DNA, 201 bp, Homo sapiens
actgagaatgatggtttccaatttcatccatgtctctacaaaggatatgaactcatcattttttatggctgcatagtattccatggtgtatatgtgccacrttttcttaatccagtctatcattgttggacatttgggttggttccaagtctttgctattgtgaatagtgccacaataaacatacgtgtgcatgtgtcttt

SEQ ID NO: 21272 - DNA, 201 bp, Homo sapiens
atttctgtggttcttcacatgttcctaatgcaaatgtttccgaagtaatttcttgacagttacagtgttttgagatgaagtgggaagggcttgtgattttraagttggaggatcttggtttgattcctacctctgccatttattatctgggaaatccagtaccacacatgctgggtgctctggggcagttttcttatctgt

SEQ ID NO: 21273 - DNA, 201 bp, Homo sapiens
ctcctccttcatcttcttcttctccaaaagcatcactgaagtgtttaagacacattgttcgattttttaaaattgaaggtatacaacatgacattttgatrtacttatatatagtgatgtgttataatcaagcaaattaacatatccgttatctcacatagttatctttaaaaaaattatttttgtggtaagagcacctaa

SEQ ID NO: 21274 - DNA, 201 bp, Homo sapiens
taatcaagcaaattaacatatccgttatctcacatagttatctttaaaaaaattatttttgtggtaagagcacctaaagtctactgtcttggcaaattttygggaatgaaaatacattagcattttttctagcaccattcaggtataaaggaaagaaattaacctcaggttgcaaatattatttatgtgatcataaagata

SEQ ID NO: 21275 - DNA, 201 bp, Homo sapiens
tcgcaattaaaatggactgcagttttgcatttaagattctgaaatagtcattgactcattcctaataaccctgcccaggatctcaccagcattagaaagaytggagatgtttcagcatccgagttctgggatgcttcttgataatgatcagctagtagttgttttgaaatgtcaagagcatttctgtggttcttcacatgt

SEQ ID NO: 21276 - DNA, 201 bp, Homo sapiens
tagtagaataagggctttcagtttaaacagaacccacatgagtgtttcattaatcatgttcacgtgttaatggattctcttgaggcctttggagtcattgyttttgcaatatttccttagggcctttttcttcagtccagattaatctaaaatacattgcactgatccagagatgtcaccaaattctcctgaaaagccctt

SEQ ID NO: 21277 - DNA, 201 bp, Homo sapiens
atgcgctttcagcttggtccagaactgatgccatgtcagtgcccctactcccaaagaccatacctccagatccatttttcaaattcttgagccatcaaagygcattcctgaagatctttgggttttgtagtgcaggctgctgtaagactaggttttcagtcttactaaaggtaattattaggtcataatcattgttcatgt

SEQ ID NO: 21278 - DNA, 201 bp, Homo sapiens
ttctttttctctttcttttgctctgggtttgctctgtcagtcaggctggagtgcagtgcagtggcatgatcatagctcactgtagcttcaaactcccgggygcaagcgatcctcccacctcagcctcctgaatagctaggactacaggtgtgcaccatcacacctggttaatttgttttgtttttgtagatactggctctc

SEQ ID NO: 21279 - DNA, 201 bp, Homo sapiens
ataattgttgaaaatgtcttaaaaacacagctagtatcaaccagagaaataatttagcaaagagttaatttatttcactaagtagtgatatatttttgaaygcatgtggaatagatgtgtgcctataaacttgactttgtgaattaagttttatttttctagttcagttttactttgaatatggatatgttgttgttttgt

SEQ ID NO: 21280 - DNA, 201 bp, Homo sapiens
aactctgagaaggtttggtgtggtgtacaaggcaaaagaatggttctgtcatgagcgagttgactagctacctggaacctatccattacttgatgagggcrgtagtccttttctgttttcttttcaagtatttggcatcaggattggtgcagccatactggttattgaatactgaactacttccatgaggttggtagatag

SEQ ID NO: 21281 - DNA, 201 bp, Homo sapiens
tcacagccctcctgcatcttgcagctgtgctgcctggaacacatggcttccaaggttgctgcagcagcacaggagacacggaggaggcacgtgtgcttttcattgcttcagcccagtagtgacacatggcacctccaactgacagtacgttggctagaactggtcacatggtcctaacccagctgcaagggagactgggaa

SEQ ID NO: 21282 - DNA, 201 bp, Homo sapiens
acaacagataaggtcatttggggacaaatcaaggagggcctttaatatcatgctaagaagttgaactttattcttttgagtgataaggagcaagtagggattttttttaaaaaatttcaacttttattttagttatagggggcacatgtgcaggtttgttacatgggtatattgtacccagatagtgagcatagtacccaa

SEQ ID NO: 21283 - DNA, 201 bp, Homo sapiens
atatgcctgtgctcttaaaagattttgctttaggaatagaaacgtataacttatttttgtttaaaggttacttagctattttattatttttacatattatygtctaaaccttttttagtatggaaggttttttttaacatatacaaaagaagcatgaagtgtatagtgaacccctttgtatgcatcactcaattacatcaa

SEQ ID NO: 21284 - DNA, 201 bp, Homo sapiens
ttttggtatatgcagagttgtgtatccatcatcataatcggttttaaagcattttttcatcaccctacaaagaaaccctgttcctctgagccaccattttyctgccctcagtacctgctaatctgctctctgtctctatagatttgcctattctggacatttcctacaaatggaatcctacagtatgtggttctttgtgac

SEQ ID NO: 21285 - DNA, 201 bp, Homo sapiens
aaaatccacacattcgtcagtagaatttaaaacttggcctatgcctgatgactggtttagactacaggctgcaaagcagcggctggtgggccaaatatggyccataggacatatttggctgggacaacacagagctttaagatttttttttttttaacatagtgctgacatttaaaatttaagaaaagaaagaaaacctgt

SEQ ID NO: 21286 - DNA, 201 bp, Homo sapiens
gtctgttgttcccatgtgtatgtccatgtgtgctcaatgtttagctcccacttataagtcagaacatgtggtatttggttttctcttcctagcaaggaatyctgaggaagggagtgaaagaaccaaatttgtgttttagaaaaattggtcaggattgatgtggagagaggccagggccagggagaccagttaggagaaaat

SEQ ID NO: 21287 - DNA, 201 bp, Homo sapiens
gcctgatgactggtttagactacaggctgcaaagcagcggctggtgggccaaatatggcccataggacatatttggctgggacaacacagagctttaagatttttttttttttaacatagtgctgacatttaaaatttaagaaaagaaagaaaacctgtatttcttgctttggaaatcagaggagcggattacactgggta

SEQ ID NO: 21288 - DNA, 201 bp, Homo sapiens
gtgctcaatgtttagctcccacttataagtcagaacatgtggtatttggttttctcttcctagcaaggaatcctgaggaagggagtgaaagaaccaaattygtgttttagaaaaattggtcaggattgatgtggagagaggccagggccagggagaccagttaggagaaaatggtcttaatggatgtaggctggagtcctc

SEQ ID NO: 21289 - DNA, 201 bp, Homo sapiens
attttcccagttcttaagtccaaccatttcattcatgttctagatctcattccctctcacctctctgcaattgtcccctctttcttttatgaaatcctctrttccacattaccttctaactatcactctattttttcggttccactttacagtaaaattcttgtacagatgtgcctatatccactgtaattacctttcaat

SEQ ID NO: 21290 - DNA, 201 bp, Homo sapiens
ttttaatgcaaaaagatctcttttaggtcaggtaaggagacagattatttggcatcatatttctattacaagttccagattactcagtggctgtttgttcrtaatccagttatagactggattgatctgtaaccttgagtcattctcctctctcgtgtctcttatgaattctaagttgaaagcctgatgctagggaagttg

SEQ ID NO: 21291 - DNA, 201 bp, Homo sapiens
atatagaattccttagaaaatcccattgttttgatcttcaaaatacatctagaatccaactacttttcaccatcttcacttctgccaccctgattcaaccractgccctctcttgcctcgacgattgcaatggcttccatactgatttccttgctgtagcaacttttttagaacatcagtcagatcacagcacccctctgc

SEQ ID NO: 21292 - DNA, 201 bp, Homo sapiens
tgagattgcccaatcctaggtgctcttattgatgggtgggaaggagtgggattgctgtttaagaaattttattatctttagaagggaagaatgtattatgttttttttttttagatgatctctttcatgtgggctaagataattttgagctctgactgtccaagctgcttagaggttctgagttgttctccactgggggtg

SEQ ID NO: 21293 - DNA, 201 bp, Homo sapiens
ttgtccaggacaagatcttctggccctgcggcttaactattgactaccccaacagactgctctacttcatggactcctatcttgattacatggacttttgygattataatggacaccatcggagacaggtgatagccagtgatttggtaagttggtggtgaggaaaaccaaattaaaactacagtcgtggataggtagaaa

SEQ ID NO: 21294 - DNA, 201 bp, Homo sapiens
tacagataagcaattagcccaggagggagaagaaaggggctgagaggatgaaagggaaggcggttaataggtttcttgcctaaggacatctagcctgtgayagagctaagatataaatttgcagtggaccattttttagattcatgccttctgaatgtccccagcctgtttggttggttgagatttctagattccttttgg

SEQ ID NO: 21295 - DNA, 201 bp, Homo sapiens
tcaaaaatagaaatggggtctcactgtgttgcccaggctggtcttgaactcttggcctcaaatgatcctcctacctctgcttcccaaagtgctgacattayaggcaggagccaccttacctggtccaacattatattctttaatccaataaaaatgtggtaatgtttttaagagttagtatcagcttttatgacaattaca

SEQ ID NO: 21296 - DNA, 201 bp, Homo sapiens
atgacatcttgtaagcataaagagataaaatatgccaagtgcttagcatggtgtaaagcatatagacagtgaaaataaactagaaaataatctaaaaatayaatatttttattatatttatcaacccttaaagtaacatattgttttgcttcctattcctatttccatttccaattttcaaatatacaaaggaaagtcttc

SEQ ID NO: 21297 - DNA, 201 bp, Homo sapiens
aatttgactttagggtcacttttaacctttgaccttatatagtacagatgcataccatatagatgtatccataagtttgtgcttttgaggttaaaatattrcttattctctggttacttcatattggaattctctttactgagggttgctatggtgataacacccttagcagtctgcattttgaaaagctttggacttttc

SEQ ID NO: 21298 - DNA, 201 bp, Homo sapiens
ctacagaaaggtcagtgagatgttcaataggtgagaaagctgtcaagctagacttggttaataattacagttaaaataatcactgatgtatttctttcacrcacgtttattgcaagctttttttttatcaggaactgacatgcatagatgaataagacatgcaaataaacaattgtgctacagggtgagaggtctataata

SEQ ID NO: 21299 - DNA, 201 bp, Homo sapiens
atttgtgtgacggagacaatgactgtggagataacagtgatgaaaaccctacttattgcagtgagtaagataaaactgctttctttctatcgttccagagrtgcatgttgtgagctaatacaaagatatgaagcgtgggtattcgggctgatttcaattgtcatttcacattgaccttctaagtagaggtggtaggcagtt

SEQ ID NO: 21300 - DNA, 201 bp, Homo sapiens
cttttatttgttcatttttatttacgcagtgttccttgctcatttttgaagtaattcaaaatgacactcacggtaagcttgcaaggctgcctttcctttaytataacggagaaaaaattctggaaagaaggcagctctttcagtatagtcatataagaacaaaatttccccaaacttggcttgtggctagattggaatccg

SEQ ID NO: 21301 - DNA, 201 bp, Homo sapiens
ggtgatcgcatttgtaatctgtatagacctgggaaagttacttaatatctcaagcctcagacatctcatctgtaaaatggagctactactagggttcttgygaggagtaagagaaacaatatgtaaaaatcccttagcatgaggcatggtgcaagctaagtctagcttagcttgggactaaggaaacgtatcattttacca

SEQ ID NO: 21302 - DNA, 201 bp, Homo sapiens
ctccaggctcatgtttcttatattctaaattctagaactttgatcagtttcatcagcataaccactcttgtaactgctgggctcccttttcagccatggcwgtaaagccacactgtgtctctcgccaatacccagcccagatcctggcacagagcaggcacttgaggcaggtttttggagtgaaattaaaccagctacatc

SEQ ID NO: 21303 - DNA, 201 bp, Homo sapiens
taactatattcaacaaggtactttaagatcaagtgacttaagtgaactctggaataatttaagaaggcccccaaatttctaatcattttaaaacattttayaaataaaagttatgatctgcaactggacttaaataagattgcaggacacattttgtgttttattgttatcattaccattatattgggaatgcattcaagt

SEQ ID NO: 21304 - DNA, 201 bp, Homo sapiens
ggttttataattattatatcttatcacatgataatttctatatgtttgaattttcaagtaccaccttgaaaactgtcactgtctacttatcttttacatatttttttttttttagagacaggggtcttgctttgctgcccaggctggagtgcagtggcatgattatagctcactctaactacataaaaagagaagtttttt

SEQ ID NO: 21305 - DNA, 201 bp, Homo sapiens
acacttggccaaacccagagtggatggaagaaatagactccatctattgatgggaagagcctaacaattttttagcaactccccgttcctaatccctaacrcacacacagggaggattgtttcaatggcaattttgatgaccttaaagatgttctggagattttattacctggcttatacttatggaaaaaggccttgtct

SEQ ID NO: 21306 - DNA, 201 bp, Homo sapiens
ctcctgagtagctgggactataggtgtgcaccaccatgcccagctaatttttaaattttttgtagagacacgatcttgttacgtttcccaggctggtctgraatcctgggctaaagtgatcctcctgccttggcctcccaaaatgttgggattataggcatgacccccccatgactggcctgaaaataattttagatgaga

SEQ ID NO: 21307 - DNA, 201 bp, Homo sapiens
tgggtgactgggactggaaatgtgctctgaaatgggaatgatttgtagtttttgcacagggtgtgtcaaatcatgaggtgctgaagggcatgttattcttstaagtagtttgattcattgggtccttatttacctgggcaggcaggccatcttaaattttcttctgtttggatagtgttcttttcaacatcctgtaagtgt

SEQ ID NO: 21308 - DNA, 201 bp, Homo sapiens
catcttccattctatgataataatatataataataatgtgtatagtaatagtaacctagcatacacatatatgtggcaggctttgttctaagcactttatrcttattgactcaattaatcttcataatatcccttggaagtaagtactcttattatcactgttttacagatgagaaagtggaggcacagaacaattcagta

SEQ ID NO: 21309 - DNA, 201 bp, Homo sapiens
cgcggagatggatcgcgggccggcagcagtggcgtgcacgctgctcctggctctcgtcgcctgcctagccccggccagtggccaaggtaagagcccagccrgagcctctcgtggagcccccacttccccggctgtggcagggtcgggtccgcgggaggccggaggggagagcgtccgggcaggggctagggccgggcggcg

SEQ ID NO: 21310 - DNA, 201 bp, Homo sapiens
ccggggaaggaacggcgaggccggggaccgtcgcggagatggatcgcgggccggcagcagtggcgtgcacgctgctcctggctctcgtcgcctgcctagcsccggccagtggccaaggtaagagcccagccggagcctctcgtggagcccccacttccccggctgtggcagggtcgggtccgcgggaggccggaggggaga

SEQ ID NO: 21311 - DNA, 201 bp, Homo sapiens
aagatcctaaaatgggtggggacagttggcttcccagttctccctgaccagtagctggcctgacataggtgctgagtgcttgctggataataaatgaaacrttgactaagcattcctattgtatgtatcaattcctgttttacgtatcctacatgtcaaaaagtatagtgattaatgatttccaggaacagaactgagcat

SEQ ID NO: 21312 - DNA, 201 bp, Homo sapiens
tttaaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaaggga

SEQ ID NO: 21313 - DNA, 201 bp, Homo sapiens
tatatatatggagagaatatatatataaaaaatatagagtatgtatctatactatatggtatatagaatctatatagattctatatatgatctatatagawtctatatatgatctatatagatatagaatatatattatagaatatagaatatatatttatagaatacagaatatatatctattatatatagaatatagaa

SEQ ID NO: 21314 - DNA, 201 bp, Homo sapiens
tatagaatatagaatatatatttatagaatacagaatatatatctattatatatagaatatagaatttatatatctgtataggatataggtatattctatrtatctacctatgtgtgtgtgtatgtatgtatgtatctatttatttacgtagcaaggttctgaactcagcatcccctcgtagctacacattcttctctaat

SEQ ID NO: 21315 - DNA, 201 bp, Homo sapiens
tggtaagctttggagattaaaaagaagtgatgatgtgtgtgaaaacactttgcagagttgggtgcatgtgtgcaatgacgaggaagctcttgttacatggtatggtttctgtacacacatctgacagggcacagcttctaaatctacgtgcttgttagtggtgtgactctccaacctttctcctagtgtagttcccttatt

SEQ ID NO: 21316 - DNA, 201 bp, Homo sapiens
ttaagctctttccccaaaatggccttcataggagaggagagagaacttgtgtttgcattattacccttcctagaatagttgactattttaggagggctaayagttaattaacaggacaggttttagtttctctctcccagtcgaaggtattgactacaaggcattggatagggaggttgaggaaaggaagccaagaggctg

SEQ ID NO: 21317 - DNA, 201 bp, Homo sapiens
ggatagttattttcagtgtaaattctttttcaccttttaaaaaatgtggctggtgttcctggaagagcatctttgaagaagctaattgggtcccgctgtgyctgcaggctaacaggagactcattttagcattttcagtcaagaaacagggccttagagtactgttgctagagtcaggaactcaaaactccagacattaac

SEQ ID NO: 21318 - DNA, 201 bp, Homo sapiens
tgttaagttttgggggtacattccttaacagatctaattttatcagaaaaccaagttttgctgaacctaaatatctatactacatataagtaaaagaagckctgtaggctgggagcctcggatccctgacagttttgcagaacgctgatatctatggactctaaaatagacttcatttatagatacccacggaccactaat

SEQ ID NO: 21319 - DNA, 201 bp, Homo sapiens
agaagctaaaaatcttgaaaaaagattagatgaatggctaactagaataaccagcatagagaagaccttaaatgacctgatggagctgaaaaccatggcaygagaactacgtgatgcatgcacaagcgtcaatagccgtttcgatcaactggaataaagggtatcagtgattgaagatcaaatgaatgaaatgaagtgaga

SEQ ID NO: 21320 - DNA, 201 bp, Homo sapiens
aaatataaaactggtgtcactgagcacccaggtccctgagataaacagttggtttccctgtaggtaatgccctgtgctctgctgtagtggagaagtcttaycaggtgagatgctacagtgaagaaatcttctgttataggcttatgttctggactgactggggaaaggaacctaaactcgagtctgcctggatgaatggag

SEQ ID NO: 21321 - DNA, 201 bp, Homo sapiens
aaacagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatgcttattgactcaatta

SEQ ID NO: 21322 - DNA, 201 bp, Homo sapiens
attttgtcaccaccaggcctaccttacaagaaatcctgaaggaagcactaaacatggaaaggaacaactggtaccagccactgcaaaaacatgccaaattstaaagaccatcaaggctaggaagaaactgcatcaactaacgagcaaaataaccagctaacatcataatgacaggatcaaattcacacataacaatattaa

SEQ ID NO: 21323 - DNA, 201 bp, Homo sapiens
aacagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatgcttattgactcaattaa

SEQ ID NO: 21324 - DNA, 201 bp, Homo sapiens
ctctgctgtagtggagaagtcttaccaggtgagatgctacagtgaagaaatcttctgttataggcttatgttctggactgactggggaaaggaacctaaamtcgagtctgcctggatgaatggagaggaccgcaacatcctggttttcgaggaccttggttggccaactggcctttctatcgattatttgaacaatgaccg

SEQ ID NO: 21325 - DNA, 201 bp, Homo sapiens; identical to SEQ ID NO: 3768

SEQ ID NO: 21326 - DNA, 201 bp, Homo sapiens
gactcccacacaataataatgggagactttaacaccccactgtcaacattagacagatccacgagacagaaagttaacaaagatttccaggaattgaactsagctctgcaccaagcagacctaatagacatctacagaactctccaccccaaatcaacagaatatacattcctctcagcaccacattgcacttatttcaat

SEQ ID NO: 21327 - DNA, 201 bp, Homo sapiens
gttcaagtgcccattctcacgcacagagattctgcatttctaacaagctctaggtaggccacagggtcttggaccacactttggggagcaaggagttagaraattggcagcagcattttcctactcacctggtattgttgattacaacagggctgtgggagaagagctgtctgcagggctgctttagtacaaggcactcgt

SEQ ID NO: 21328 - DNA, 201 bp, Homo sapiens
acagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatgcttattgactcaattaat

SEQ ID NO: 21329 - DNA, 201 bp, Homo sapiens
caatattgaccacatagttggaagtaaagcactccccatcaaatgtaaaaggacagaaattataacaaactgtctctcagaccacagtgcaatcaaactaraactcaggattaagaaactcactcaaaaccgctcaactacatggaaactgaacaacctgctcctgaatgactactgggtacataaagaaatgaaggcaga

SEQ ID NO: 21330 - DNA, 201 bp, Homo sapiens
gaacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttga

SEQ ID NO: 21331 - DNA, 201 bp, Homo sapiens
agccaaatcatgagtgaattcccattcacaattgcttcaaagagaataaaatacctaggaatccaacttacaagggatgtgaaggacctcttcaaggagarctacaaaccattctcagtgaaataaaagaggacacaaacaaatgaaggaacattctatgcttatggataggaagaatcaatatcatggaaatggccatac

SEQ ID NO: 21332 - DNA, 201 bp, Homo sapiens
aacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaa

SEQ ID NO: 21333 - DNA, 201 bp, Homo sapiens
catgagccactgtgtctggcccctagtttctctgaaaagttcttacaagtctagcgtttatgaatttttccagaagttccttgagtttttaatatatatayattttaatatatacatataacatatatttctgacaggccttttcgtgcagtcctgcatttcataaatttactatgtgctgtataaagatatagtcatgtg

SEQ ID NO: 21334 - DNA, 201 bp, Homo sapiens
atctatttatttttaattttactttaagttctgggatacatgtgtgacgttcccctctctgtatccatgtgttctcatcgttcaactcccacttatgagtragaacatgtggcgtttggttttctattcctgtgttagtttgctgagaatgatggcttccagcttcatccatgtccttgtaaaagacatgaacttgttcct

SEQ ID NO: 21335 - DNA, 201 bp, Homo sapiens
tgtgaaacaggtaaaagctcattttcccccttagttcttttattattcaatctggtcatctgtaaaatggcatctcatattaaacagcttgtcaattaacttttttttttttttaaggaacagagagattcaaaactgcggtccattttacttctaatgggattagcatcaaggaaaaaccactcatgcagggtctaagat

SEQ ID NO: 21336 - DNA, 201 bp, Homo sapiens
attagattttgtcttttgttctgcccaggtgggtccctgggaataactactaaagtatgaaaccatggtgttgtctggctttcaatgaaaacatgtagccycgtgccactaaacatgatgtacattataaacatttgtttaccccttagaaggcatcttacttctttgtactattccttggagcatttgatgcacattttt

SEQ ID NO: 21337 - DNA, 201 bp, Homo sapiens
tcaggcaggagaatcacttgaacctgggaggcggaggttgcagtgagccgagatcgcaccactgcactccagcctggccacagagtgagactctgtctccaaaaaaaaaaaaaaaaaaaaaagtctggatcaatgtacacacttttcatagcagcttctgaaagagcctgtttcttgttactgttatgatataggctgtgt

SEQ ID NO: 21338 - DNA, 201 bp, Homo sapiens
acttttaaatccagttttgggggtctgtctacacactgttgctactaggcatgtgggtcatgctggttttgttgcctgattgggctccattgcttggctttggtctagagtcatggacttcatagtattcatgaaatgtagtccaagtccaagcacatgatgctcactttctgaatgtggtctattttccaaggtgtaatc

SEQ ID NO: 21339 - DNA, 201 bp, Homo sapiens
cttttaaatccagttttgggggtctgtctacacactgttgctactaggcatgtgggtcatgctggttttgttgcctgattgggctccattgcttggctttggtctagagtcatggacttcatagtattcatgaaatgtagtccaagtccaagcacatgatgctcactttctgaatgtggtctattttccaaggtgtaatca

SEQ ID NO: 21340 - DNA, 201 bp, Homo sapiens
ttttaaatccagttttgggggtctgtctacacactgttgctactaggcatgtgggtcatgctggttttgttgcctgattgggctccattgcttggctttggtctagagtcatggacttcatagtattcatgaaatgtagtccaagtccaagcacatgatgctcactttctgaatgtggtctattttccaaggtgtaatcac

SEQ ID NO: 21341 - DNA, 201 bp, Homo sapiens
ttggcctcccaaagtgctgggattacaagcatgagccactgcacccagtggttggccactcttaatagcaaccttcacagtataacaatgaactgtctctrgtttcctttgtcaccttaaagcggcatggagggaggggtgttatgcctcttgagtagataatggaacatcattttcattaccaacagggtatggaaatct

SEQ ID NO: 21342 - DNA, 201 bp, Homo sapiens
acacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaat

SEQ ID NO: 21343 - DNA, 201 bp, Homo sapiens
atttgcctgcctgtaccaggaggattgttttcctgcgcctgtgccactggatttaaactcaatcctgataatcggtcctgctctccatataactctttcaytgttgtttcaatgctgtctgcaatcagaggctttagcttggaattgtcagatcattcagaaaccatggtgccggtggcaggccaaggtatgccaactcca

SEQ ID NO: 21344 - DNA, 201 bp, Homo sapiens
cacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatg

SEQ ID NO: 21345 - DNA, 201 bp, Homo sapiens
ggtcctgctctccatataactctttcattgttgtttcaatgctgtctgcaatcagaggctttagcttggaattgtcagatcattcagaaaccatggtgccrgtggcaggccaaggtatgccaactccaatataagtaagatttgacttcatctggcaccaggttgaaatccctggtgccatgaaaacatttcttcatgtgt

SEQ ID NO: 21346 - DNA, 201 bp, Homo sapiens
acaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatgg

SEQ ID NO: 21347 - DNA, 201 bp, Homo sapiens
aggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatggat

SEQ ID NO: 21348 - DNA, 201 bp, Homo sapiens
cttagaaggcatcttacttctttgtactattccttggagcatttgatgcacatttttccatcttgttgctcggtcacttttgtaatagagcttgtgtgagttttttttttttttaaggaatttagaactatgtcagtttttatctcctttgcagtttttggtgatagctctgttatgggaagaaggcagtgctgtggatct

SEQ ID NO: 21349 - DNA, 201 bp, Homo sapiens
tcatctctagctacactgcctccttggtggcctcatcctgtctcatggccctctttgaagcagggagtggtttcccaattcagggaggcggcatggactckggtggaaagaacatcacatgtcaagtcaggacattcatggatcttgttcctgaagaaagaaggaaaaataggcacaaccaaagagggccccaggctgctg

SEQ ID NO: 21350 - DNA, 201 bp, Homo sapiens
ccttggagcatttgatgcacatttttccatcttgttgctcggtcacttttgtaatagagcttgtgtgagttttttttttttttaaggaatttagaactatrtcagtttttatctcctttgcagtttttggtgatagctctgttatgggaagaaggcagtgctgtggatctggactccttggagcaaccctctcaggcacat

SEQ ID NO: 21351 - DNA, 201 bp, Homo sapiens
gtgtgtgtgtgtgtgtgtgtgtgtgtgtgtgatggagtcttgctctgtcacccaggctggggtgtagtagtccaatctcagctcactgcagcctctgcctsctggtttcaagtgattctcctgcctcagcctcctgagtagctgggattacaggtgcatgccaccgcgcctggctaatttttttgtattttcagtacagat

SEQ ID NO: 21352 - DNA, 201 bp, Homo sapiens
aactttatggcctgttttttggtattgactctcctgtttgtcctggtactccttctggaaagttatttttcctgtgtaggtttcctagaattcctagaatwtatcatattgaagtactttgttaactatgccataagttgtgggaaactagagttggcctcacttttcccttcttcctaatgtggatgggaaactgactgg

SEQ ID NO: 21353 - DNA, 201 bp, Homo sapiens
gaagtctcacttagtcacccaggctggagtgcaatggcactatcttggctcactgcaacttctgcctcctgggttcaggagattctcccagctcagcctcycaagtagctgggactacaggtgcatgccaccatgcctggctaattttttgtatttttagtagggatggggttttgccatgctggccaggctggtcttgaa

SEQ ID NO: 21354 - DNA, 201 bp, Homo sapiens
gacataccttttccttggttaaaaagaaatcagaagatgacctgataatcactacaaaaataatctttcatgaagaagatggtcagaccaaggaagatatcacatttgtgaaaaggagggtattcaaaggccataaaaggcagaacttcaaaatattttaaaaagccaaatgaactaaaatgttcacctgtgataaataat

SEQ ID NO: 21355 - DNA, 201 bp, Homo sapiens
tggggaaatgccgtctctactaaaaatacaaaaatattagccaggtgtggtggcgcacacctgtagttccagctactcggtaggctgaggtggaaggatcrcttgaacccgggaggcggaggttgcagtgagccgagactgtgccactgcactccagcctgggcaacagactgtgactccatctcaaaaaaaaaaaaaaaa

SEQ ID NO: 21356 - DNA, 201 bp, Homo sapiens
agagttgcttattgatgttgaagcattggtttcgttagagtaaattatgtatatatatgtgtatgtgcatgtacgtatgtgtgtgtatatatatatgtatmtacctgatctctactttctgaaaatttacacatttagaatgggaggttatttagttcctagcatgtaacttgtgacttataaacccacttagcaattaca

SEQ ID NO: 21357 - DNA, 201 bp, Homo sapiens
cgggaggcggaggttgcagtgagccgagactgtgccactgcactccagcctgggcaacagactgtgactccatctcaaaaaaaaaaaaaaaaaaaaaaaaragaaaaaaaagaaaaagaaaagaaaagagaagaaacttggccttttggtgggttatggaatggtgggccacccagcaggaatggttgaacccaattcaca

SEQ ID NO: 21358 - DNA, 201 bp, Homo sapiens
agcggggaaataggatttgccacagaaattaccttactctgttaactttggacaatgttccattgactaccacttgtctttgtcttataagaatagaattkatggaaggagaaagaaacttacaaggaacgggtaaaagaatgaaactgctattaatatgactcaatgtttttttctttctttttttttttttttgaaaaa

SEQ ID NO: 21359 - DNA, 201 bp, Homo sapiens
tgtcttataagaatagaatttatggaaggagaaagaaacttacaaggaacgggtaaaagaatgaaactgctattaatatgactcaatgtttttttctttctttttttttttttttgaaaaaaacttctagatattccccttttttcagattattccagattccatttttctttctatggatttaagatggtaaatttctat

SEQ ID NO: 21360 - DNA, 201 bp, Homo sapiens
tatatatttcaaatttcaaggagaaattctttgtattgtatttttacctggtatacaaagatacttaaacggcaatatttgaatgtagaatatggctttcttttttttttttttttttgagatggagtctcactctgtcacccaggctgaagtgcagtgatgcgatctcggttcactgcaaactccacctcccaagttcaa

SEQ ID NO: 21361 - DNA, 201 bp, Homo sapiens
cttaaacggcaatatttgaatgtagaatatggctttcttttttttttttttttttgagatggagtctcactctgtcacccaggctgaagtgcagtgatgcratctcggttcactgcaaactccacctcccaagttcaagtgattctcctgcttcaacctccccagtagctaggattacaagcatacaccaccatgcctggc

SEQ ID NO: 21362 - DNA, 201 bp, Homo sapiens
aaaagcactctctgtagactaagaacacagcctatgtagagttcggtactatctgaggtttcatgcatcccttggtgatcttggaatgtatcccccatggwtgagtgcagatgactgtttttatttctgccaaatgaagaaatagggaaaaggtgtcccaggcagagaaaagagctctcactggaacagcgcttgagttta

SEQ ID NO: 21363 - DNA, 201 bp, Homo sapiens
caggcagagaaaagagctctcactggaacagcgcttgagtttacaaagatctttcactagcatctaatttaatcctcacaacattcctgagggcaggcagktctggtagccatttgtgatgagagggaaatttgcagtgtgcacaagtatctcaagccaggtagaattatcaggtgttaacatgaagggccccttggaggc

SEQ ID NO: 21364 - DNA, 201 bp, Homo sapiens
ctacactgaaattagaaacaacttttttctccaatattaataaatatttctgctgtcagcactagggtgtttggtttccaaagcccttgcatttgatatarctttttaaaccaccattacgcacattggaagatactgttggctctcagttatcttaatttttccagtagtggagacggaatatcttctccatgttttctt

SEQ ID NO: 21365 - DNA, 201 bp, Homo sapiens
agaattatcaggtgttaacatgaagggccccttggaggctcctctggttcaaactcttttttttatttttatttttttacatcagaaaccaaggcccacaraagctaagaagatgtcttaaatggtcagcttcactgctctaattcctgagcagtattctctctttgcacttttataaactacaactccggcaatccagac

SEQ ID NO: 21366 - DNA, 201 bp, Homo sapiens
tatttgactgataaagttcaaagaggtgaatttatttgcctcagattgtacagtcaggacctggcagggcagagatttcagctcatgtgtttcagtttagkttgttgacttggaacagaattcactgtacctctgagtaaatttggactattttgatcaactgtgttggcagtaactggccaccgagtgccttggtggggt

SEQ ID NO: 21367 - DNA, 201 bp, Homo sapiens
gtcagaacatgtggtatttggttttctcttcctagcaaggaatcctgaggaagggagtgaaagaaccaaatttgtgttttagaaaaattggtcaggattgrtgtggagagaggccagggccagggagaccagttaggagaaaatggtcttaatggatgtaggctggagtcctccggtctgtttgattggctatttcattct

SEQ ID NO: 21368 - DNA, 201 bp, Homo sapiens
atgggttgcaggagtgatcccattttgttttccttctttgtttaaagctcttgtggaaagtgggaaagggaactgccagtcaccgagcaccagccaccacyttacccacttttcacgtcaatgctgcaaggtgggtatgaggaccagctctgttttacagagattgtaaagattatcaagatgtaagagtaggggagccag

SEQ ID NO: 21369 - DNA, 201 bp, Homo sapiens
agggaaaagatattagtgttaactatcaaagtctctgaagtgaaagaggaaaaccaccttaaaattttttttaaatttatttttatttatttatttatttwttttttagacaaagtctcactctgtcgcccaggctggagtgcagtggcaagaccttggctcactgcaacctctggctcctgggttcaagcaattctcctg

SEQ ID NO: 21370 - DNA, 201 bp, Homo sapiens
cacgctttcctgatggtgcatactgccaggctactatgttcgaatgcaaaaaccatgtttgtatcccgccatattggaaatgtgatggcgatgatgactgyggcgatggttcagatgaagaacttcacctgtgctgtaagagggagagaaacggagtgaatgggagtggtgttgtctgtcaaatctcattgtttcttacgt

SEQ ID NO: 21371 - DNA, 201 bp, Homo sapiens; identical to SEQ ID NO: 3765

SEQ ID NO: 21372 - DNA, 201 bp, Homo sapiens
cctggagagggtgccttatgctgcatgaggaaagtaaaaccagacccgtcgaatgaagtgtgtcccccgtattttctacatgacaccaccttaaagtgggmattattgcacacagtcttgcaccctctgttgcctcactgcaggaagacaaacttcctgttttcccctgccctcatttgcctgaagaaaggtgacttctaa

SEQ ID NO: 21373 - DNA, 201 bp, Homo sapiens
tgtcctgcaagtagacacaatggggtcaacacacatggatgactgagtgtttctaatgcatatgagactctaatgtctttgtgtgtgcttgtgtgtgtgtytgcctgtatgtgtccaggtatagggactgctgatggcattgcctttgactggattactagaagaatttattacagtgactacctcaaccagatgattaat

SEQ ID NO: 21374 - DNA, 201 bp, Homo sapiens
cttgtcctgcaagtagacacaatggggtcaacacacatggatgactgagtgtttctaatgcatatgagactctaatgtctttgtgtgtgcttgtgtgtgtktctgcctgtatgtgtccaggtatagggactgctgatggcattgcctttgactggattactagaagaatttattacagtgactacctcaaccagatgatta

SEQ ID NO: 21375 - DNA, 201 bp, Homo sapiens
gctttgataatcccagaggacttgcccttcaccctcaatatgggtattgtctccctgcaatcctgggcttttctttcacctccttcttctgcctctgttamcgagaaggctgttcatgtaactatctcaaggccaatgtcttgctggggtttgtcttctgcttttcctacttggtaaattgtttagtgtaatgagtagaag

SEQ ID NO: 21376 - DNA, 201 bp, Homo sapiens
atttctttactggactctcgaagtcaaagccactgaaatccagttaactatgtttatttgtgagcattttctgtacattgtccccttcctttttctttttwagattatttgctgttagctctctttcttttctgaatgcagaaaagaattcagaatgcagtctgctctacagaatgcagactccatttctctaaatggaga

SEQ ID NO: 21377 - DNA, 201 bp, Homo sapiens
aaatactcattgtaaaaagatgatacacattattaatcaaaaattaaacaacaatacccatattgaattttgctagttatggcctagttggaccatagtawtgtcttctgcataagcatttatggataacgatccaggaacagcctgttgcactcagaagcatggaaatgccattcattcagtagaactatttcaaatttt

SEQ ID NO: 21378 - DNA, 201 bp, Homo sapiens
acaatttacccttgtgtcactaaatactcctttatgattttcttctcacacacagaacacccttaaccccttcccaagggacatagctcatagtccattcmgaaactgaaatccaggacctctgggtaatgggcagtagccactcaatcagttccagatgtggttcctcttggttgggagacccataaactaataaacaat

SEQ ID NO: 21379 - DNA, 201 bp, Homo sapiens
tgttaaaatgacatgttactaagttacacctttgtagtccatttatgactcataaagtgctttcacatacattatttaatgtgttactcaagttagccccrttgagttgcttttattgtctatgtaataaagctcagagagcttaagtaacttccttgtggtcacacagaatgtcagaggcagaattggagcagtcatgta

SEQ ID NO: 21380 - DNA, 201 bp, Homo sapiens
catgttactaagttacacctttgtagtccatttatgactcataaagtgctttcacatacattatttaatgtgttactcaagttagccccgttgagttgctkttattgtctatgtaataaagctcagagagcttaagtaacttccttgtggtcacacagaatgtcagaggcagaattggagcagtcatgtaagtccaggtta

SEQ ID NO: 21381 - DNA, 201 bp, Homo sapiens
gaggtgggaggatcacttgaacccaggaggaggaggttgcagtgagccaacattgtgcaactgtactccagcttgggcaacagagtcagactatctctagwtaaataaataaataaataaataaataaataaataaataaatcagatggtgactaatttctggtcatttacctgcatccttatcaacaaaggccaagcaca

SEQ ID NO: 21382 - DNA, 201 bp, Homo sapiens
atggtcagtgtatcccaagtgaatacaggtgcgaccacgtcagagactgccccgatggagctgatgagaatgactgccgtgagtctgttttagtccttgcrctgtatttggtttcacccttgtccctttggcattttaatcaatttgttagatttgttgatggacataaatgcctacaatatgcctcttgttattgcaatc

SEQ ID NO: 21383 - DNA, 201 bp, Homo sapiens
aatgagcaacgaacttagaggttaaacgaattggccaggtcttactgtcattaagaggttgactcaggatttgaactctggtctgtttcactgcagagcamgtcctcttcccagtccactgggtgcctcttagcactttaaggctacatattttgtttattagtctgcacattatggtgggaggatgggggagggatagca

SEQ ID NO: 21384 - DNA, 201 bp, Homo sapiens
aagcacagcaggcgactcctgcctctcagcttctgcgctagctcttccctctacctggaacatctctcttccagatctctgcatgagttgcttcgcgtgcyatttaggattctacccaaatgtcactttctcagagaggccctcattgaccgctctacctaaaatagccaccccctcataattcttttgctctttaccctc

SEQ ID NO: 21385 - DNA, 201 bp, Homo sapiens
gttgcggttcatccttcgaaacaaccaaattgtgagtgatacagagaaacatcctgcctgggagtagcttgaaaaacactgaccctgggaatgctaaatgyacactgttacagacccatttgtttggacaatacattttccttttctctttacaaaccaccccactatatactttccctagtcctgacattgccattactt

SEQ ID NO: 21386 - DNA, 201 bp, Homo sapiens
cttcgcgtgctatttaggattctacccaaatgtcactttctcagagaggccctcattgaccgctctacctaaaatagccaccccctcataattcttttgcyctttaccctcatgttctgaaacctctctctctctctctgagtttagttgtttctttttgctcgaatatatactccacttttatagcgtccccagtgctta

SEQ ID NO: 21387 - DNA, 201 bp, Homo sapiens
tcagcaggtgagtgctttagcgggtgcagacctatgaggcctcatttaatgctctgtagaagaattccccaattcttattttcactattacctatgcagawctaaatccaattgctactaaatgccatcataaaactccatatgtgcttgcctgaacctgaaccctgatattattaacatacagacttccacagagcatta

SEQ ID NO: 21388 - DNA, 201 bp, Homo sapiens
tgactataatattccattgagtggttatagtatcatcaaattaactgcctctattattaagcattaggttgcttttattttattcctctatagtatatatcattgcagtaaatattaacatcgtatttaaaacattttattttcaggatattttcttaggatcattagtatagttttatagctgaagtcaaactattttca

SEQ ID NO: 21389 - DNA, 201 bp, Homo sapiens
acttcccaaacaatacttttatatcaccctggcagacaatctcaaccaatcactgctcctagaacacagctcaaaacacccactctttatttgtttattgttttttttttgtggaggaaatttattcatcatattaagagcacattttcagtttgtatttggatcttaagaaacctgttctatcttgccaagttatgtttt

SEQ ID NO: 21390 - DNA, 201 bp, Homo sapiens
tagaagagtgacttattttaattcagtatttattgaacagtggtgttctaggaacttttgggctgtgtcagtgaataagacaacaatccctacccacatgragctaatattctaaagaggggagacaggcaaccaatcagtaaattgtctagtatgttgaaaggtggtgctaagtgttatggaaagaaggaaagggagcaa

SEQ ID NO: 21391 - DNA, 201 bp, Homo sapiens
aattgtgagtgatacagagaaacatcctgcctgggagtagcttgaaaaacactgaccctgggaatgctaaatgcacactgttacagacccatttgtttggrcaatacattttccttttctctttacaaaccaccccactatatactttccctagtcctgacattgccattacttttatttaccatggaaatttcaaaccta

SEQ ID NO: 21392 - DNA, 201 bp, Homo sapiens
atgtagttggaaaagcactaaatttggaggagaaagacctaggtttgaagccccagctcttcacctagttctatgactttgagacatccagttaaccatctttgagcttcagttttctcatctatacaaatggtgtaaaaatacctatttcacattgtgcttgtgtgattatactttgtaaactaaaaaaagttaccaaaa

SEQ ID NO: 21393 - DNA, 201 bp, Homo sapiens
taaccatctttgagcttcagttttctcatctatacaaatggtgtaaaaatacctatttcacattgtgcttgtgtgattatactttgtaaactaaaaaaagktaccaaaatataaggcattcggtatccagttaacaaaatggtagtggttttctgaagccctaagggaaaaagtatgaccattctaatgtattttatggaa

SEQ ID NO: 21394 - DNA, 201 bp, Homo sapiens
ctttcttcacaattacatgcacacattttgctgtaaatcatgttgacaaggccctgggtttatggatggcagtgctggttagcaggcctggttataggtcrgttgtaaaactgaccacattcaccgttgttgccttcacattttgtaatgctctatgtgccgctcctatgctttctatgataaattgttcaaaaccattag

SEQ ID NO: 21395 - DNA, 201 bp, Homo sapiens
atatagtcttgaaaataagccaacttccttttctggggaataaagggttattatgcttgtgctttttcttagaatggctttatggggaatttcagctgtgrtctattaggaaggcctcaaagatagaacttaaaagcttctagtatggctgtccttcctctagttagcaattgaaactgagttgttacaacaaaaggaaaa

SEQ ID NO: 21396 - DNA, 201 bp, Homo sapiens
aacaggtcagggtgttcagttcttatctcttaagtctgtatgcaataaagagatatttaagaatttgggagacagtaatagtcaaaagaagaagtgctccrtgtagtagtactgactgataagtacattaggaaataagtcctctaaaaagaaatcatgatcctgctatccaggattcactgatgtcaattaggagctttc

SEQ ID NO: 21397 - DNA, 201 bp, Homo sapiens
ataaaatctgtcaggaaacagtaaggaatgagacttttctggtaaacttttagtaagactataaaagtatttcttctgtgagatagaatgtctgcagtctwgtctgttttgatgtcagtaaataaaaacaattcagtgaaaatgaggactgtacgtagggttctcagtctagctttgttccatactaccactgagtacaaa

SEQ ID NO: 21398 - DNA, 201 bp, Homo sapiens
caatgtccgaattcgaaaatataatctctcatctgagaggttctcagagtatcttcaagatgaggaatatatccaagctgttgattatgattgggatcccraggacataggcctcagtgagtataaactttggcatctttcattgatattaagtgactttatagaattttaaggtgttgacttttaaggaatttattgttt

SEQ ID NO: 21399 - DNA, 201 bp, Homo sapiens
tacgtatttttaaaaggcttcttagccttttagtttagtcccctggttgagaactactgattttaatgaagtgaacgtaaatagagtttgttgcagtcatwttgctacatgctttgagtcattggaggaactctagggtaatagttctcaaaagtgtcttacctggactaggaatgtcagtgccacttgggaatatgttag

SEQ ID NO: 21400 - DNA, 201 bp, Homo sapiens
tcttcaaggaagaggtttgcactgacttacattggtgggaaaatgattccttgaaaatgaaccaataatgcaaacatgtttgagggggaaggttcaggagwcactactctcctggagaatggatagttattttcagtgtaaattctttttcaccttttaaaaaatgtggctggtgttcctggaagagcatctttgaagaag

SEQ ID NO: 21401 - DNA, 201 bp, Homo sapiens
ggtcaaagtcactcatgagttccatgttgttaaatccaatgatctattttcagctctggtccttatttaactggttagcagcatcacacacagtgtatccwgacttcctccttgaaacacttagttagattttcaagaaactgccttctcctggtttcttttcttccttgctggcctacccttggtatctcatgcttgttc

SEQ ID NO: 21402 - DNA, 201 bp, Homo sapiens
atatccactgtaattacctttcaattttttctcaaatccatgccattttgctttagccctcatccttgatagatatttttttggtcaaagtcactcatgasttccatgttgttaaatccaatgatctattttcagctctggtccttatttaactggttagcagcatcacacacagtgtatcctgacttcctccttgaaaca

SEQ ID NO: 21403 - DNA, 201 bp, Homo sapiens
tctcacatgtagagtgagctttttaaaactgtgaaaatggaagcaaccagaagagaattccataaacttctataactcaaccatcatcatttgaacttcgkcttatatcttctgtctttcctcctattactctggaagaattttcccagttcttaagtccaaccatttcattcatgttctagatctcattccctctcacct

SEQ ID NO: 21404 - DNA, 201 bp, Homo sapiens
tttccttgtgtactaatttatggctctaagagcagttgtatgatttagaactctatgtattttactgcaccctggtcaacacttgatatacatgtatatatttgtgtgtgtgtgtgtgtgtgtgtgtgtgtgtgtgtgtgtatataatcaattggtcaatgttagggaaattatagtcttcttaaaattttataatttcct

SEQ ID NO: 21405 - DNA, 201 bp, Homo sapiens
ccttgtgtactaatttatggctctaagagcagttgtatgatttagaactctatgtattttactgcaccctggtcaacacttgatatacatgtatatatttgtgtgtgtgtgtgtgtgtgtgtgtgtgtgtgtgtgtgtatataatcaattggtcaatgttagggaaattatagtcttcttaaaattttataatttcctcct

SEQ ID NO: 21406 - DNA, 201 bp, Homo sapiens
caattggtcaatgttagggaaattatagtcttcttaaaattttataatttcctcctatttgtaactttgttctaacctatctgtatccatgtcttttattwatttatttatttatttatttatttatttatttatttatttctatctgttatctatctatcgatctatcatctatctctctatctatctattgatctatct

SEQ ID NO: 21407 - DNA, 201 bp, Homo sapiens
caactttgtggctgtggaagactgttgatgagagggttgggcgatgatacctcagggttaccctcaggtcgtacctggtggtgtcagcttatcagagccgwctccgggtggtagtaggtgaactcaggtatctcttcttcagatattctacagtgagaaatttttttctggaaggttggacatgggagtaaatccaggcca

SEQ ID NO: 21408 - DNA, 201 bp, Homo sapiens
tttaagaatgaaagtattttatcagaaatatggcaatcctacccacattttaatctcactagaaggggggtgatacatgctagcaagtactcccacactgrtttaattttgatgtgaggaagggtgtggagaatactttttgttgcaagaaacagaaaacccaactcaaaatggcctacacaataaagggtatttcttggc

SEQ ID NO: 21409 - DNA, 201 bp, Homo sapiens
ttgcttccttatatcttctcctctttcctcaaacctctgacatcaccttctcacatgtagagtgagctttttaaaactgtgaaaatggaagcaaccagaaragaattccataaacttctataactcaaccatcatcatttgaacttcggcttatatcttctgtctttcctcctattactctggaagaattttcccagttct

SEQ ID NO: 21410 - DNA, 201 bp, Homo sapiens
ggtgcagtcagggctccagttctctttctttgtgttttccttgaccctactcccccctaagtttcacctttgtgtgcggtctggcttcccatatgattctratatggctgccagggcaaatggggctacgtgtttccttgatcctatccagggggaatccaactttgagaaggttttagttatgttctcaaaagtattatt

SEQ ID NO: 21411 - DNA, 201 bp, Homo sapiens
ttttagttatgttctcaaaagtattatttcatcacaataacttacagattgttagaatttctaaggaccctagacaaagtcagctagctccccaaacttgrcatatcatcaaaatcacctgaggaacttaaaaaagtatagagattcttaaatcaaaactcacccttactaaagcaggggtatgaaaatctgtgtttttta

SEQ ID NO: 21412 - DNA, 201 bp, Homo sapiens
agtgttcagtatgccaaagtcccaggttgaatgctatggatatgtggcctttgacaagttactcccttcctgtccccatatgtgagtcatgggtggagtcyggggttgtcttgagtctgctgatattttgagaccttgatcagccttgaaaaattgcaactcaaagctgagactcccatgagatgacaggggtggcaaatg

SEQ ID NO: 21413 - DNA, 201 bp, Homo sapiens
tacttcctgagtccctcctacatgcccagcgtgatgacaagcagcaggggttttgaggggaacaaggcagacatggcccttgctctcctgaagtacatagscttgcttacaatacttgtcattggccgggggcagtggctcacgcctgtaatctcagaactttgggaggctgaggtgagaggatcgcttgagcccagaagt

SEQ ID NO: 21414 - DNA, 201 bp, Homo sapiens
tccatgttcaaattttgtcacttatccccaaaatgtatttttactgttctctgttcaagttagggttcagatgagatctacaactgattttgattgttatmattcttcaatctcttttatgccacaacacttcccactttttaatgtcattgattcattagaaagattaggtgatttgtcctgtagaatatctcacattct

SEQ ID NO: 21415 - DNA, 201 bp, Homo sapiens
tgttcagaaatatatttcatagatgcataaagcaatagatttttatagagcatgcaattgattccttgtacatcttgggatgcaccaacacatcactggarctgtgcctgtagttctactcttacttttttttttgagatggaaattcgctcttgttgcccaggctgaagtgcgatggcgtgatctcggctcaccacaacc

SEQ ID NO: 21416 - DNA, 201 bp, Homo sapiens
tctggcacatagtttttaatacatgttattgatgatgatgatgatgatgatgatgatgattgcttgtttaactttgtgggtagcgcttgaagtaagtgctkttggccaaactggtagattctttctggcaaatcattacattgactggattaatctgtcttggagccagaggaaataacataaagtaacttataaaggatg

SEQ ID NO: 21417 - DNA, 201 bp, Homo sapiens
ctggcacatagtttttaatacatgttattgatgatgatgatgatgatgatgatgatgattgcttgtttaactttgtgggtagcgcttgaagtaagtgcttktggccaaactggtagattctttctggcaaatcattacattgactggattaatctgtcttggagccagaggaaataacataaagtaacttataaaggatga

SEQ ID NO: 21418 - DNA, 201 bp, Homo sapiens
taccattgtacaccttgaaaatttctactcagacctcaaagacccagtttaatgtcaccacctctgtgacaacttctatcactccttctggcagagttctwtgattgctcaccatgaatctatgtcattttatggcacatgttactctaagttatatagctagttgaccacataatatctttctatcctctagacatctgc

SEQ ID NO: 21419 - DNA, 201 bp, Homo sapiens
tccgggcaggggctagggccgggcggcggcgcgggagctgctcccggtggggcgctcaggttgcttcgcgaagccggagggggagcgcccctcttcgctcrccaggaactgagcggcagcaaacttgagaaagcagccccgccagtttcggtgacagcgcaccccacggagaccctgtctttgttcccacgggcgttggtc

SEQ ID NO: 21420 - DNA, 201 bp, Homo sapiens
agttgggaaataagccacaataaaagtgactaaattatttgagtgctttctataccaggcattggcctaagtgttttgtaggtattagtttacctacttaygtagtaacagtaaaaattttatggataaaggaccaagacaatgacaggtgaggtaatttgcccaaagcaattcagttactaagtggcagagccaacattt

SEQ ID NO: 21421 - DNA, 201 bp, Homo sapiens
gtagagatggggttttcccatgttgcccaggctggtctccaactcctggcctgaagtgatccacccaccttggccccccaagtgctgggatgataggtgtsagccaccatgtctgacccatctctttatttctgctcccactgccaacatctctcatttgggtgtcagcagtagtctctgggttggcctccctgcctccag

SEQ ID NO: 21422 - DNA, 201 bp, Homo sapiens
caattttcaaatatacaaaggaaagtcttctttaagcatttttcactaacagttctctgaagacttctcagaccctagcatgtgattggaagattttttcytttttttttttttttttgagaaaatcgtattggccttaaacaaagttgtattctgtttactaattaaaaaaacttatttttcaaaaatagaaatggggtc

SEQ ID NO: 21423 - DNA, 201 bp, Homo sapiens
agaattctacacttcctgacgaacatgcattagctattccataagcacccggtgctgtgccagaggctgtaaatgacacagaggaatgctctcaatccagygttgttccttgctgtggaaaacaaacaggcaaatgactcctcttctctgggcgctatctgttactctaatatcttatcttaacacattcttagtccaaca

SEQ ID NO: 21424 - DNA, 201 bp, Homo sapiens
cacttctgatataagaatttacttcttccctaatatttggttcagtgaagtgttgaaagaatttgctaagtaatcattgaaagctaagattctagtgaaamacaaaatgcatggtttaaaaattgaacgtactaactgaaagacagtggaagttagatgcttcttgctgtaaataattaaacccaacagtgcagacgagag

SEQ ID NO: 21425 - DNA, 201 bp, Homo sapiens
cataagcacccggtgctgtgccagaggctgtaaatgacacagaggaatgctctcaatccagtgttgttccttgctgtggaaaacaaacaggcaaatgactyctcttctctgggcgctatctgttactctaatatcttatcttaacacattcttagtccaacacttacccaggaagcttgggatatggctacttatgaagaa

SEQ ID NO: 21426 - DNA, 201 bp, Homo sapiens
gaaaaaaattagccagatgtggtggcatgtacctgtagtccccactacttgggaggctgcaatggaaggattgtttgagcccaggagatccaggttgcagygagctatgaccataccactgcactccagcttgggcaacagagtgcaaccctatctcggaaaaaaaaaaaaaaaaaaggttacaaacgtgtgtgtatttta

SEQ ID NO: 21427 - DNA, 201 bp, Homo sapiens
tgcacagacttctctttgccactcccctgtgctggaacttctgtttgtggcaggccatttatttctttttctagatttatttcctcattttgctgaaacamgttacatgatagcttcctgagaaacataagtaggtggcatatattttgagtctttgaatgtctgtgagtgttttattttgctctccatcttgactgtttg

SEQ ID NO: 21428 - DNA, 201 bp, Homo sapiens
ttgctagagtcaggaactcaaaactccagacattaacactctcttctgaaaaccaaccagggaatggcagatctgtcttcttgtttgaagttttacctctktctcagccttaatgaataagagaattaagaaagtggtggaactttttctgcttgtaagagactgagacctgcagcctcagaagtggaaataaggcaggac

SEQ ID NO: 21429 - DNA, 201 bp, Homo sapiens
agaattcccctgtacatacagaatgggtcattctgctatttttaggacagatttgatacagtagcttttacaaaaagataagccaaagtttttagacttcrtgttagtggactgtcattctgtatttaaacagaacacaaaagaaagctgtctgagaccatgacacagtgaaaacagccttgatcaaacaaaaggccctct

SEQ ID NO: 21430 - DNA, 201 bp, Homo sapiens
atagttaaaaggttaatgggcagaacttccatggcgcttcttagggagcatttaatgtagaagctgttgcaagtgctattgtggaggggtcaatgtgaacsgtggctgcatccatcttttacttcttctgggattatctttcttcaggtccaaatggtgccgagtgccagtgtccacatgagggcaactggtatttggcca

SEQ ID NO: 21431 - DNA, 201 bp, Homo sapiens
aggagtcccctcaattccttactcttccaagtgtaacctgccaaacatgtccccttggctgtagttcccccaagagagggggactatggtctgatgatagktatctgagcagctgtctcaccagccaaacgaaatgctctcatcttcaaacctcttacccagtaatgattactctaggctttgcagttgtttaactttgtc

SEQ ID NO: 21432 - DNA, 201 bp, Homo sapiens
aatctaactaattaaaagtgttatctcactttgcatgcagtccattttgcagcgttttttgccttggaaggtaaattcaaagtgtctcttttatttaattrtatctttttaaaaattaggataatgttttaatcaagagggtttgttctcatgtttttcctgttcttagcacttcacacctgctcaccgacagccttcacc

SEQ ID NO: 21433 - DNA, 201 bp, Homo sapiens
ccacaggtataaggtacttagagaaaatatgaaattatttagtgttagaagtaggctgacttgaaaaattttgtttgctgttccagaattataagacaccrttttgctaattaaacagaaagaaggaacaaaatgacaaggaagatataatcaattaagcatggagaagggtgttaattatggttttataattattatatc

SEQ ID NO: 21434 - DNA, 201 bp, Homo sapiens
gtaaaaacaaatgtcttcatgaccagtttgttactattgtagataatacctgttcatcttcggcgttcacctgtggccatggggagtgcattcctgcacamtggcgctgtgacaaacgcaacgactgtgtggatggcagtgatgagcacaactgccccacccacgcacctgcttcctgccttgacacccaatacacctgtg

SEQ ID NO: 21435 - DNA, 201 bp, Homo sapiens
ttgccgtaagtttatcttaagtgcttattgtgattttgggtctgaagtcttggatcacaggagatgaaattattatataaaaaaaaggctttccaaaaatraaaaccctaagtatttatctaaaacgtaaatttttggctaggcgcggtagcaagtatcaacaaataccaatcttgtttcatttttctctccttttttcta

SEQ ID NO: 21436 - DNA, 201 bp, Homo sapiens
cctccactgtttttttcatagaaattcttttttttttttaatttttttggagatggagtgttgctctgtttcccaggctggagtgcagtggcatgatctcrgctcactgcaacctctgtctccaagattcaagtgattctcctgcctcagcctcctggcagctgggattataggcacccaccaccacactgggctaatttt

SEQ ID NO: 21437 - DNA, 201 bp, Homo sapiens
acgtaaatttttggctaggcgcggtagcaagtatcaacaaataccaatcttgtttcatttttctctccttttttctagtattttaaagtgactcctagtcmtgcacttcactgataacattttggaaaataactaccatgccattataatgcctggcaaaatcaaaagtgcttactaaatatccctgagtacctagtccat

SEQ ID NO: 21438 - DNA, 201 bp, Homo sapiens
ttgtttcatttttctctccttttttctagtattttaaagtgactcctagtcatgcacttcactgataacattttggaaaataactaccatgccattataaygcctggcaaaatcaaaagtgcttactaaatatccctgagtacctagtccatgttcaaattttgtcacttatccccaaaatgtatttttactgttctctgt

SEQ ID NO: 21439 - DNA, 201 bp, Homo sapiens
cccagaccaagaggtattttagtttcctgacttggggcatgtgagtaaagtcaatttgccagtcctgggcgggggaaaaaccccgagcttgaggtgtaggkaagggagggggcctgagaaattcctgaggagtagtagaatagcagatggaacactgagaagtgatttccttgaggatagatttccacaatggaaaggaaa

SEQ ID NO: 21440 - DNA, 201 bp, Homo sapiens
ctcgcgtttatttgtgtgacggagacaatgactgtggagataacagtgatgaaaaccctacttattgcagtgagtaagataaaactgctttctttctatcrttccagagatgcatgttgtgagctaatacaaagatatgaagcgtgggtattcgggctgatttcaattgtcatttcacattgaccttctaagtagaggtgg

SEQ ID NO: 21441 - DNA, 201 bp, Homo sapiens
tgcaaagagttttttggacagacaccgtgcaaaataaggtaaatagaaatttcagtagctgaatggaaccctgagcacaaagtgttgatagcttttcactyttagagggagtagaggggaaagttcctttgttttctaacaaaaaaggcccttgagatattttatgttaatcagcaccttttccatgctatactattacat

SEQ ID NO: 21442 - DNA, 201 bp, Homo sapiens
ctataatataagatacaaagggagaattgtcatgaggacactgctgaaaaacactgtgatagttctcctaccttacaagggttcagggaagctctatggaraaagtatcactgaactgaatgttgaaggttgggatccactggtagtataaccagtgataaagtatgtgacatgtgaggtcaatgtgggtgagagtgagaa

SEQ ID NO: 21443 - DNA, 201 bp, Homo sapiens
ttagagggagtagaggggaaagttcctttgttttctaacaaaaaaggcccttgagatattttatgttaatcagcaccttttccatgctatactattacatstgacctattaaacaaagcagtctattatatggattagccttgagcaacttttaattttattcgaagtggagtccaggagcctaattaaaagaaatagtag

SEQ ID NO: 21444 - DNA, 201 bp, Homo sapiens
acaaacctgcacgctgtgcacatgtaccccagaacttaaagtaaaataataataataaaaaaggaattataaaaaaaagaagttttgtaaaaattgagagsaaatcttttttcttccattaggggattatattatattttttagatgatcacgttttcccccaaagctctttgtatgtagacaatttaaaatcccaggata

SEQ ID NO: 21445 - DNA, 201 bp, Homo sapiens
taatacgattctcatttatttaaatgataacttgcatgaaatttctgaaaattgagaatttagatttttagcacttctgatttgattatagctaaaaaaawtcaaaacaaaccacgtagttagtgatgctgaagaaatataataattttggtttttctttcaggttttttcagttgacattaatggtttaaatatccaaga

SEQ ID NO: 21446 - DNA, 201 bp, Homo sapiens
atcagttcactggattttatctgttttatccggaggcaaatttcatgaactgctgatgccctgctttcacctatactaatcaacatgggatgaaatcaagstagcttaaatttttttctctttataaaattgatacatggtcaatgtaggcagtttatagaatagaggaaactatatagaaaaaaataaaatcactcatat

SEQ ID NO: 21447 - DNA, 201 bp, Homo sapiens
ctcatttatttaaatgataacttgcatgaaatttctgaaaattgagaatttagatttttagcacttctgatttgattatagctaaaaaaaatcaaaacaamccacgtagttagtgatgctgaagaaatataataattttggtttttctttcaggttttttcagttgacattaatggtttaaatatccaagaggttctcaat

SEQ ID NO: 21448 - DNA, 201 bp, Homo sapiens
atttaatgagggggacacattctgagaaatgtattattaggcaattttgttgttgtgtgaacgtgatagagtgttgttaaacaaacctggatggtatagcytactgcacacctagggtaaacagtatataccctaggcatatactgttgctcctaggctacaaacctgaacaccatgtttccgtgctaaatactacaggca

SEQ ID NO: 21449 - DNA, 201 bp, Homo sapiens
aatttctgaaaattgagaatttagatttttagcacttctgatttgattatagctaaaaaaaatcaaaacaaaccacgtagttagtgatgctgaagaaatayaataattttggtttttctttcaggttttttcagttgacattaatggtttaaatatccaagaggttctcaatgtttctgttgaaaccccagagaacctggc

SEQ ID NO: 21450 - DNA, 201 bp, Homo sapiens
agcaaaaatatggtattataatcttaggggaccactgtagtacatgtagtccatgcggtctgtcgttgaccgaaagagccatatgcggttcctgactgtasttccttttgtttgctcttaaatttatatttcaaacttcaagaaattatcccagtattccattaattggtgagcagatttttgtgtaccttagaaatcttg

SEQ ID NO: 21451 - DNA, 201 bp, Homo sapiens
ggcatcctagaggaattgccgtggacccaactgttgggtaagtgatgtgaaaacatattgattcctgtatttttagaattttctctctccctctatacackgaacatctactggattaatcaaaggctcattctgatttcttttaggctgtatactctagaagccatgtctattttatgcccttatttatagaagctttaa

SEQ ID NO: 21452 - DNA, 201 bp, Homo sapiens
tcaccgtgccacctgaaaaggttgactgactcatgtgagctccgtcttcattatcaatgaaaggggcacagtgacattttcctgacctgctgcttggtgtsgttgtgatgatcaaatcagaaaatagaagtgaaaaatctctgtaagggatagagggctgtataaatgtgagacattataattaggagaatattagtgttt

SEQ ID NO: 21453 - DNA, 201 bp, Homo sapiens
ggatgattgccataatgagtcctcttttggtttgttttagctgttgtgacctgccagcagggctatttcaagtgccagagtgagggacaatgcatccccarctcctgggtgtgtgaccaagatcaagactgtgatgatggctcagatgaacgtcaagattgctgtaagtgtttggagaggaatcttgctttggctttgtgg

SEQ ID NO: 21454 - DNA, 201 bp, Homo sapiens
ataagatacaaagggagaattgtcatgaggacactgctgaaaaacactgtgatagttctcctaccttacaagggttcagggaagctctatggaaaaagtakcactgaactgaatgttgaaggttgggatccactggtagtataaccagtgataaagtatgtgacatgtgaggtcaatgtgggtgagagtgagaagggccac

SEQ ID NO: 21455 - DNA, 201 bp, Homo sapiens
ctgatgagctgatgcacctgtgccacaccccagaacccacgtgtccacctcacgagttcaagtgtgacaatgggcgctgcatcgagatgatgaaactctgyaaccacctagatgactgtttggacaacagcgatgagaaaggctgtggtgagtacaacagaggatttgggaaaaggaaacaggggagactgaatatggatt

SEQ ID NO: 21456 - DNA, 201 bp, Homo sapiens
agcaaggagtggtatgaggaaggatattctcacctttttgtgttagaaaaaaccttaaaggtctgaggcttaatttatagctacttgttgatctttccatyaaaaccaaattcagaaggaagagtttccttggtgttcttatatatggtctcctctcatattgcactttaccctatacttaaattcttgcaggacattata

SEQ ID NO: 21457 - DNA, 201 bp, Homo sapiens
aattcagacacttaagtgccttctggaaaaatctatctattctgcctttattaatagaagtaaaattggacccacaggtataaggtacttagagaaaataygaaattatttagtgttagaagtaggctgacttgaaaaattttgtttgctgttccagaattataagacaccattttgctaattaaacagaaagaaggaaca

SEQ ID NO: 21458 - DNA, 201 bp, Homo sapiens
gagaatgactgccgtgagtctgttttagtccttgcactgtatttggtttcacccttgtccctttggcattttaatcaatttgttagatttgttgatggacrtaaatgcctacaatatgcctcttgttattgcaatctcttggcagattcttttgtggattaggggtgatgttctgataagagtctatttttaacaagacat

SEQ ID NO: 21459 - DNA, 201 bp, Homo sapiens
aagtggcttcacgtcttggataattacacatttctaattgcaatttaaccctgtgcatttttccttccagctaccaatccgtgtaaagataacaatggggrctgtgagcaggtctgtgttctcagccacagaacagataatgatggtttgggtttccgttgcaagtgcacattcggcttccaactggatacagatgagcgc

SEQ ID NO: 21460 - DNA, 201 bp, Homo sapiens
tcttcgcagcacaaagtacatgctcaagtcatcagataacatgctccaatggtcagtgtatcccaagtgaatacaggtgcgaccacgtcagagactgcccmgatggagctgatgagaatgactgccgtgagtctgttttagtccttgcactgtatttggtttcacccttgtccctttggcattttaatcaatttgttagat

SEQ ID NO: 21461 - DNA, 201 bp, Homo sapiens
tcctcctgcttaagcctcctgagtagctgggactataggtgtgcaccaccatgcccagctaatttttaaattttttgtagagacacgatcttgttacgttkcccaggctggtctggaatcctgggctaaagtgatcctcctgccttggcctcccaaaatgttgggattataggcatgacccccccatgactggcctgaaaa

SEQ ID NO: 21462 - DNA, 201 bp, Homo sapiens
aacagataatgatggtttgggtttccgttgcaagtgcacattcggcttccaactggatacagatgagcgccactgcattggtaagaagtctgttttggacrttgttggcaggtgacacaggtgtatgtgtgtccaaacctctaactagactaactgctactcttgaactggaccagctccctgtctaacttcttgactgca

SEQ ID NO: 21463 - DNA, 201 bp, Homo sapiens
ctgggcaggaatttttaatcaagtttttttttatttaaaaaaatttaagtacaaatagttggtgaaataatgattcactaaggaaagaaaaccaaatttgkcttactgtttctggaatcatacaagtcatgaacccttcagggcacactgtgacctaaaatgaatcacatgcatgtaagggattttgcagtgaggcattct

SEQ ID NO: 21464 - DNA, 201 bp, Homo sapiens
tctatttctcagaaatagaatggcctataggaatgaatatattaggtacctggaaaccacctaaaaatagtaatggatgttggaaaagctccaaagaaggrctcaattcttccctctaatattcaaaaggattagggagcttgatgttgtagtttgtagccctgcctgtcattccagacccctaggttgtagttcataccc

SEQ ID NO: 21465 - DNA, 201 bp, Homo sapiens
caagagttctgaaagttgagcatgcctcagaattatctggagagcttgttaaatatagattcgtgggccccatctgttgcacttctgatgcaatatgcctkaggtggcctaagaatttgcatttctagttctcctgtgacgttgatgctgctggttcagtgaccacattttgagaaccgctgctccagtcccttgctactc

SEQ ID NO: 21466 - DNA, 201 bp, Homo sapiens
tgttttcctaagagcttgaaactgtatgtcttttacagtcattgaaaagtgatgccctagggatttaggtaagttcagcaaatataagattgaactgtatwagttgaaatcaccttaaattttatttcttttttcctccaaaaaactttattctgggggagtaaaaaaaattgtttttaaacccaaaacatttcttctaac

SEQ ID NO: 21467 - DNA, 201 bp, Homo sapiens
aaaatttttgaatatatatatattaaaacctgtgaaacaggtaaaagctcattttcccccttagttcttttattattcaatctggtcatctgtaaaatggmatctcatattaaacagcttgtcaattaacttttttttttttttaaggaacagagagattcaaaactgcggtccattttacttctaatgggattagcatca

SEQ ID NO: 21468 - DNA, 201 bp, Homo sapiens
cattgaaaagtgatgccctagggatttaggtaagttcagcaaatataagattgaactgtataagttgaaatcaccttaaattttatttcttttttcctccraaaaactttattctgggggagtaaaaaaaattgtttttaaacccaaaacatttcttctaacttttggctttctcagtcttcactgaagagtagttttttt

SEQ ID NO: 21469 - DNA, 201 bp, Homo sapiens
ttttattattttagtgcttcacgattgtactgggtagatgcctattttgataaaattgagcacagcacctttgatggtttagacagaagaagactgggccrtatagagcagatgacacatccgtttggacttgccatctttggaggtatgttttaaagcaataaaagtatgtattgtttttatacattgcaagttacaata

SEQ ID NO: 21470 - DNA, 201 bp, Homo sapiens
ataattttttctcttcgcagcacaaagtacatgctcaagtcatcagataacatgctccaatggtcagtgtatcccaagtgaatacaggtgcgaccacgtcrgagactgccccgatggagctgatgagaatgactgccgtgagtctgttttagtccttgcactgtatttggtttcacccttgtccctttggcattttaatca

SEQ ID NO: 21471 - DNA, 201 bp, Homo sapiens
tgctctttagaatttaaacatttttctttatatctttaactgctgaaactccagctgagggaacagtgggaggggaataaaaagatggttaaagtcatttygtggactgtgagggtgcatgaagaacatgttcttcaaactcagttccacatttaagctgcccagcgagccttgcccttgctattctctctctccctgaag

SEQ ID NO: 21472 - DNA, 201 bp, Homo sapiens
ttatacttctgtttttgctttgtaagctcagcttggtggtagccaggtactttaccttgtgtccctatgaactttatgctttccaatatccttgttaatgmcaatagattagtctgtgtctagcaataattataaattaagtaataattttttctcttcgcagcacaaagtacatgctcaagtcatcagataacatgctcc

SEQ ID NO: 21473 - DNA, 201 bp, Homo sapiens
gggaccgtcgcggagatggatcgcgggccggcagcagtggcgtgcacgctgctcctggctctcgtcgcctgcctagccccggccagtggccaaggtaagarcccagccggagcctctcgtggagcccccacttccccggctgtggcagggtcgggtccgcgggaggccggaggggagagcgtccgggcaggggctagggcc

SEQ ID NO: 21474 - DNA, 201 bp, Homo sapiens
ggccggaggggagagcgtccgggcaggggctagggccgggcggcggcgcgggagctgctcccggtggggcgctcaggttgcttcgcgaagccggagggggmgcgcccctcttcgctcgccaggaactgagcggcagcaaacttgagaaagcagccccgccagtttcggtgacagcgcaccccacggagaccctgtctttgt

SEQ ID NO: 21475 - DNA, 201 bp, Homo sapiens
ctattctctgggcattttgataacattatacttctgtttttgctttgtaagctcagcttggtggtagccaggtactttaccttgtgtccctatgaactttwtgctttccaatatccttgttaatgacaatagattagtctgtgtctagcaataattataaattaagtaataattttttctcttcgcagcacaaagtacatg

SEQ ID NO: 21476 - DNA, 201 bp, Homo sapiens
ttggcgggttgatttccaagaggaagctactttttagtattgggtctgaaaaatgttttgtcctgtttgttttccttcacaaatcaaacccgtgacctacytagtgaaaatgtacatgactgactccctcggggctttgcttttgcaggttctaacgcctgtaatcaacccacgcatcctaacggtgactgcagccacttc

SEQ ID NO: 21477 - DNA, 201 bp, Homo sapiens
aaacatgtctgcagtcttcctgtcaagataataatgaacagtgccttatatttgtatcttactctgcttaaaatgatttccattctaagaggtctacaagrtcttcaaactacatttctacaccctcctccctgattatgtaaacagaactatagcatagaaatttcttgcttcaaaccaaatcattaacagtgaaaaaat

SEQ ID NO: 21478 - DNA, 201 bp, Homo sapiens
cttaacatgcactttgaaggcttttaggaagctaagcaagaaatttcattcataatgttatggatggtttctggccttgatttagactatcttcaacaatwtttttccttgacattggctgtttggaccaatgcagtcattatgtcttggcaaactcctcaaaaagtcaaatcgaaataaactagatctgaccaggcaagg

SEQ ID NO: 21479 - DNA, 201 bp, Homo sapiens
tagagatgaggtctcaccatgttgcccaggctgatctaatttttaatcttgaaaaacagaaaccggcacctgagttcatttcctggacccaaagctgctgktatcttcttctttctctctcttttttttcctcctttttaaaaatttttgtcaagatgtctaagggattaaattgatatagaaatttcaatttctaggagt

SEQ ID NO: 21480 - DNA, 201 bp, Homo sapiens
aaagaactgggtctgtgacacagacaatgattgtggggatggatctgatgaaaagaactgcagtaagttttgagctggtttcccttggttggtcagcctcstaaatagacttcaacaaccaaatggccttgcattctttcctctaaggctcatgcaattttcattgtctctttagtacttctattccacttgtcaatctct

SEQ ID NO: 21481 - DNA, 201 bp, Homo sapiens
acccaacttcaccagctgctgatggaactcaggtaacagttgccgactcctgaaataatgtgggatttggaaaaactttgggatgactgggtttttattamccttaagcaaacaagggagattctggaaggctcaaagatctcaagatgtgttgacagttaataaatataattttttaaaaagtcatagattgaaaaactt

SEQ ID NO: 21482 - DNA, 201 bp, Homo sapiens
tctgagcagagtggccacaaatagtcttctttatgaaaaaccgtgtatggtgaccttgggggaataaatggctgattcctgttacattgtattcttagatrgagaacgagcaaaaggaaagtgttgctgcgacaccacctccatcaccttcgctccctgctaagcctaagcctccttcgagaagagacccaactccaacct

SEQ ID NO: 21483 - DNA, 201 bp, Homo sapiens
agacgtgccagtgacattgatgaagaatgtgactttttcttggacatgccttgcacttccctgtttctgtgccagttctagtttgtttcctctgtgaggcrtcccctcccctcagatccatctatctgtagcttaaatgcacctttctctacaggacctttcttgatatccactgaatgttatctgaacctctcttacagc

SEQ ID NO: 21484 - DNA, 201 bp, Homo sapiens
gggtctgtgacacagacaatgattgtggggatggatctgatgaaaagaactgcagtaagttttgagctggtttcccttggttggtcagcctcgtaaatagwcttcaacaaccaaatggccttgcattctttcctctaaggctcatgcaattttcattgtctctttagtacttctattccacttgtcaatctctgtgtcaat

SEQ ID NO: 21485 - DNA, 201 bp, Homo sapiens
tagttttaaaatctatattgtattctttacacatgttgataacgtaattgtgtacatagcatgcttgagtgtggacactattctctgggcattttgataayattatacttctgtttttgctttgtaagctcagcttggtggtagccaggtactttaccttgtgtccctatgaactttatgctttccaatatccttgttaat

SEQ ID NO: 21486 - DNA, 201 bp, Homo sapiens
ttgatgggtgcagcaaaccaccatggcacgtgtatacctatgtaacaaacctgcatgttctgcatatgtactccagaacttaaagtataacaacaaaaaakaaaaatctcagtgtttagtcattttagccctgagctaatttctaatgcttttctctttcattcttagtattaaactgtactgcttctcaattcaagtgtg

SEQ ID NO: 21487 - DNA, 201 bp, Homo sapiens
tttttaacaatttttcttagcacagacattttttcttagaaattatttgcttggttaaattggacacacacttagattattctgagcagagtggccacaartagtcttctttatgaaaaaccgtgtatggtgaccttgggggaataaatggctgattcctgttacattgtattcttagatggagaacgagcaaaaggaaag

SEQ ID NO: 21488 - DNA, 201 bp, Homo sapiens; identical to SEQ ID NO: 3767

SEQ ID NO: 21489 - DNA, 201 bp, Homo sapiens
ggggggcggcggctacttgtctttcattacagtacactgatgggtgccctgatctctgacatctaggaggttgcacttgtggagagtcgtcatggtctgtyataacaaagagcaacccagacctcacagaaaacctggcaaatagggaattttaactctgagaaggtttggtgtggtgtacaaggcaaaagaatggttctg

SEQ ID NO: 21490 - DNA, 201 bp, Homo sapiens
gaagactctatatcatttagccttaaatattaatttggtcatagttgttactataaacctactattggatccaaaatcatttcctctgagtctagactatraaagggatcacaaattacattcacaagccgatttaccccatgttttccttctagcaaccaggcctcctggtatgtgccactcagatgaatttcagtgcca

SEQ ID NO: 21491 - DNA, 201 bp, Homo sapiens
gttgaaaccactgatgaaggagtaagttggtgaggaagttgaaaaatagtgacttttcaataatccacagtctttggaagtctttgttgtctgtcttagcmtgattcattaagaattggcactgtttagtagaaatgttgactttgaaccattatagtgagttggtcgttgatattttaggatctctaagaactgcttttt

SEQ ID NO: 21492 - DNA, 201 bp, Homo sapiens; identical to SEQ ID NO: 3771

SEQ ID NO: 21493 - DNA, 201 bp, Homo sapiens
tgctttttacctacaggcattaatgaatgccatgacccttcaatcagtggctgcgatcacaactgcacagacaccttaaccagtttctattgttcctgtcrtcctggttacaagctcatgtctgacaagcggacttgtgttgatattgatgaatgcacagagatgccttttgtctgtagccagaagtgtgagaatgtaata

SEQ ID NO: 21494 - DNA, 201 bp, Homo sapiens
caactatttcctcatatctctcctctctgacttcagaaatgatttctcccaatgagatttttgattttgatgccagctttatatctcactgtgattaggayggggccttatgatgggagaattagacttgaccaactatcatcagtttttgttttctcagtgagtttttggtgctctgatcttttttccttctatctgatt

SEQ ID NO: 21495 - DNA, 201 bp, Homo sapiens
ccccagtggccgatgcatttatcaaaactgggtttgtgatggagaagatgactgtaaagataatggagatgaagatggatgtggtaaggaggggaagagaytcctactgaaaagcattttcttcaagtgttttccagcgcttgttttttctcctttcctttttagaaattttgtgtgacaagcaagcctcaggattggctg

SEQ ID NO: 21496 - DNA, 201 bp, Homo sapiens
atattgaaggtggcatgagactgcataataaatattgcataagagtgaatcaaagaagcaaagattcttgattttcttttttcattattctctttcttttytctagatgggaacagctgctcagatttcaatggtggttgtactcacgagtgtgttcaagagccctttggggctaaatgcctatgtccattgggattctta

SEQ ID NO: 21497 - DNA, 201 bp, Homo sapiens
attttttttttttttttttttttttgtagagatggggttttcccatgttgcccaggctggtctccaactcctggcctgaagtgatccacccaccttggccycccaagtgctgggatgataggtgtgagccaccatgtctgacccatctctttatttctgctcccactgccaacatctctcatttgggtgtcagcagtagtc

SEQ ID NO: 21498 - DNA, 201 bp, Homo sapiens
ataggccatgaagtcctttcaggaaaagtgatttgttctttcagaatcgctaattcagtcttgtgatgccccacaagctgttctcagttttttgttccacsctagagcccagataacacattttccatattttccaacatataagtctgtggtgagccttgggttgtatttccaaatgtctagggttttctaaatgtcaga

SEQ ID NO: 21499 - DNA, 201 bp, Homo sapiens
ttttttttttttgtagagatggggttttcccatgttgcccaggctggtctccaactcctggcctgaagtgatccacccaccttggccccccaagtgctggratgataggtgtgagccaccatgtctgacccatctctttatttctgctcccactgccaacatctctcatttgggtgtcagcagtagtctctgggttggcct

SEQ ID NO: 21500 - DNA, 201 bp, Homo sapiens
tcttacttgccaatgattctaagacctgtgaagacatagatgaatgtgatattctaggctcttgtagccagcactgttacaatatgagaggttctttccgstgctcgtgtgatacaggctacatgttagaaagtgatgggaggacttgcaaagttacaggtaattgctgaactaacccgagccagtttatcagcacatccc

SEQ ID NO: 21501 - DNA, 201 bp, Homo sapiens
gacatgctgtttgttgacagaatgacatcgtggtgcagagtgagggcagggaggtcattcagcatggtggggtttcacacagccagatggatcagagggtrgccaaggggggctcagttaaaaaggggtttttgagtcattttcacagcagtatttgttggtgggaggagacaaagaataaaaaggaaagaaaaatagata

SEQ ID NO: 21502 - DNA, 201 bp, Homo sapiens
ttgtgttttctcccagtatcattgacatttttgcatttttttcttgaacagcatctgagagtctgctgttacttgtggcaagtcagaacaaaattattgcsgacagtgtcacctcccaggtccacaatatctattcattggtcgagaatggttcttacattgtagctgttgattttgattcaattagtggtcgtatctttt

SEQ ID NO: 21503 - DNA, 201 bp, Homo sapiens
gttttatataactttttattgaaagcttcttcaaattacttttggactggggaaggatatgcttctctgtttttttccttgtatattactgcattccctargagctagtccatgatggcagtcactttagggacttgaaattcaccaggaatgggggtttggggagtcgtggtggtaccttcatgagactaactttatggc

SEQ ID NO: 21504 - DNA, 201 bp, Homo sapiens
tgttgacagaatgacatcgtggtgcagagtgagggcagggaggtcattcagcatggtggggtttcacacagccagatggatcagagggtggccaagggggkctcagttaaaaaggggtttttgagtcattttcacagcagtatttgttggtgggaggagacaaagaataaaaaggaaagaaaaatagataaaggtattgga

SEQ ID NO: 21505 - DNA, 201 bp, Homo sapiens
atgaagtaagacttttttttaaaattatgttgccttgacatggttatgatgagggaaaaacaacagtaacatgatgtagctgatatgcatgttgctgataygcaaaatttaaaatgatcccttgtttaaacatggtaggtgtccaactgggtgttgctatctctccttcatctgaatcatcctcttcataaagtacataag

SEQ ID NO: 21506 - DNA, 201 bp, Homo sapiens
taaccacaaacaaaatatgccacctctgtattcactaaagttaccagataactcctgattgccaatgggcacttttccttccttctcacactggatgggcrtttagattgcacttgactctggagaccattcctccttcttgacaccactcccttggctgccatgactcccagcagtcctggctctcttttgagctgcttt

SEQ ID NO: 21507 - DNA, 201 bp, Homo sapiens
ctagtcctctactgatcaatttttatatcattccttatcttttgctattgccaataagactgcaattaataccttgttcatatatcattttgcatacctgsgagtaaacagacagaacagatttggaaccaccattaccatctttttcagagtgatttcctggtaatctttaaaatgtcttctgtgtttaacaaaatctaa

SEQ ID NO: 21508 - DNA, 201 bp, Homo sapiens
tatgacagttttactttgtgacacttagaggaaacaataaactctgtgaatatattctgaaccagagatgatttattttaagcagggcataaacaggatgwtgtattatttaaaatgacagttatttttaatatttaaatacgtcccctccaattggtaactcatttcctttcccagtgagcatctactgttctggtctga

SEQ ID NO: 21509 - DNA, 201 bp, Homo sapiens
cagaatgcttgaattcttaccaaattcttcctaacttactgagattttggacgcttcattaagcctttttgtgcctcaatttgcccttctgtaaaatggayagaatgctagctatctgtctgcctcagaggtttatgttaaaatcaggtaagacaacctagaagatagcatttgaaaaagcagaaagcatatcatttgtaa

SEQ ID NO: 21510 - DNA, 201 bp, Homo sapiens
attctgaaccagagatgatttattttaagcagggcataaacaggatgttgtattatttaaaatgacagttatttttaatatttaaatacgtcccctccaaytggtaactcatttcctttcccagtgagcatctactgttctggtctgactggggccaccaccctcgcatcgagcgagccagcatggacggcagcatgcgca

SEQ ID NO: 21511 - DNA, 201 bp, Homo sapiens
ttattataccattaatacgattctcatttatttaaatgataacttgcatgaaatttctgaaaattgagaatttagatttttagcacttctgatttgattakagctaaaaaaaatcaaaacaaaccacgtagttagtgatgctgaagaaatataataattttggtttttctttcaggttttttcagttgacattaatggttt

SEQ ID NO: 21512 - DNA, 201 bp, Homo sapiens
aattttctctctccctctatacactgaacatctactggattaatcaaaggctcattctgatttcttttaggctgtatactctagaagccatgtctattttrtgcccttatttatagaagctttaagagagtttattaaatataatcctatttgaggacatgttacccaaacacacctagtggtgtactaaaaatacttgtt

SEQ ID NO: 21513 - DNA, 201 bp, Homo sapiens
ttgctcataaggttgttgagagaatttttggctaatgcatgtaaacacctagagtaatggctagaaaatagtaaatattcagtaaatgttggatatcattwtatctgttatcaatataaaaccatattgcccaccctcccctgcccctaatccagacctgctctggggagggaacagctcttttgactatttcttcttttg

SEQ ID NO: 21514 - DNA, 201 bp, Homo sapiens
agggtatctagactctttaaataatatacacatgtaacctatacttattaagcatcttcaatataaaagacactgaagcactaattccccatcaggcacaycctgggagtatgtacaggcctagctgggagcagggacttggagtaagggcagtttgggaggacttgaaaactcaggagctctctagctaactgcctatca

SEQ ID NO: 21515 - DNA, 201 bp, Homo sapiens
taagtgctggaggtaacagaggtgaacaaaacagacaaaaccccctgtgtgtattgagtttacattctaagaggacaataaatagagaagtcaataaatayatggtagttcaggtggtactatggagaaaatgaaggcagaggaagagggatgaggatggggtgagtggggattgtcctttagatagtgttcagggaagac

SEQ ID NO: 21516 - DNA, 201 bp, Homo sapiens
gaagagtgagtttttataagacctctacctcaagctggattcccattgccccagaatccactcaaccttaattgtagctcctcagggtagagaaccatgtycagttttgacaactgaaaaagggctaccttttgaaaagtgctttatattatcaggagacgaagaccagcatgaggaagctgtggtttaattctagtccca

SEQ ID NO: 21517 - DNA, 201 bp, Homo sapiens
ccagtatactttggatagaccatatgttatgatctgtccagttttgggtagtgacaaatcttggtataatatgtggatctcactggtcttttgaaccatckcaagttgtttagcactgagtagattttgaggttaggcagtgaaccagatacccaccttccaaacctctcagggcagcagagaagataagtgatgccaata

SEQ ID NO: 21518 - DNA, 201 bp, Homo sapiens
atgtctccttggagggttggggtggaaatcacatccagtatactttggatagaccatatgttatgatctgtccagttttgggtagtgacaaatcttggtayaatatgtggatctcactggtcttttgaaccatctcaagttgtttagcactgagtagattttgaggttaggcagtgaaccagatacccaccttccaaacct

SEQ ID NO: 21519 - DNA, 201 bp, Homo sapiens
cttgggatccttatgggagctggctagaaatgcagtctctcaggcccaccccagaccttctgaatcagaatctgcattttagcaagattccccaggtgatkgatagcacattcaagtttgaaaatctccactctggagggccgacgaaatggtaatgagacagatattgatggaggcttttggaagatgtgttactaattt

SEQ ID NO: 21520 - DNA, 201 bp, Homo sapiens
ctcaggttacctgtgcgctaatttatccttcagcagtgtgtggagcaagatgaaaggcaaagggaagtgaggaaaggaaatagccttttactaagttcttrtgtcaaattctctcttcagtgttaattcagccatctattacttcaattaccttataaagacctcccaaaccttataaagacattttattctcatctcaaa

SEQ ID NO: 21521 - DNA, 201 bp, Homo sapiens
catcagcaggtaagtaaaaatattagccctcatcattgtttggagtgatggatatgtacttctaggccacagaatccagcagacatcagtcccctgctaartgtgagttgggttaacaagtcacaaaatgggtttcataggcatcagaaatcttatccttcccattgcaaggctaggctagtcaggtcaacctgagatatg

SEQ ID NO: 21522 - DNA, 201 bp, Homo sapiens
caaagctgctgttatcttcttctttctctctcttttttttcctcctttttaaaaatttttgtcaagatgtctaagggattaaattgatatagaaatttcawtttctaggagtactgcttaggcagtgaggtgagagcactttcagtttttcccggtgatttgtgtctttggagtgcagctgttgctttattccagactatc

SEQ ID NO: 21523 - DNA, 201 bp, Homo sapiens
gcctttgcactgcctggagagggtgccttatgctgcatgaggaaagtaaaaccagacccgtcgaatgaagtgtgtcccccgtattttctacatgacaccaycttaaagtgggcattattgcacacagtcttgcaccctctgttgcctcactgcaggaagacaaacttcctgttttcccctgccctcatttgcctgaagaaa

SEQ ID NO: 21524 - DNA, 201 bp, Homo sapiens
aggctgatctaatttttaatcttgaaaaacagaaaccggcacctgagttcatttcctggacccaaagctgctgttatcttcttctttctctctcttttttwtcctcctttttaaaaatttttgtcaagatgtctaagggattaaattgatatagaaatttcaatttctaggagtactgcttaggcagtgaggtgagagcac

SEQ ID NO: 21525 - DNA, 201 bp, Homo sapiens
attggtgagtaggtgattgaggggtttggcaaggttgccttgggttatgtgcatgtcatgattgtctttaagcatgaacttcgtgatttacaaaaagtttrttgcacttgttagtgttttcttcaaagcatatgctgaaagttgacagtaggcaaatatctttagagtttatcccccttcccctgggaaagactacctaga

SEQ ID NO: 21526 - DNA, 201 bp, Homo sapiens
ctccttagaatctcagtaaaagactagtggtagagttagaaatcactaacttattgtaaaatgtagatcatttatagatttctcttgttcaacttgctctrcatcctctgtaaaccactgattaacaaagagctggctgtacctcccctatggcctgtaactctctctttttccccccacagaaagcggtcctcatgatgt

SEQ ID NO: 21527 - DNA, 201 bp, Homo sapiens
ttgcacaatgacttccttgtgtttttattaaataatgacatgttaaaggaaaccgtcttcttgagcagatatcctctttgactcagtgcaccttggctttsatttttggatgaggtctcactgttctcttctgcctcacagattatacggcacccctatgccctaactctctttgaagactctgtgtactggactgaccgt

SEQ ID NO: 21528 - DNA, 201 bp, Homo sapiens
ttcaacttgctctacatcctctgtaaaccactgattaacaaagagctggctgtacctcccctatggcctgtaactctctctttttccccccacagaaagcsgtcctcatgatgttcataaatgttccccaagagaatggtcttgcccagagtcgggacgatgcatctccatttataaagtttgtgatgggattttagattg

SEQ ID NO: 21529 - DNA, 201 bp, Homo sapiens
aattctaagttgaaagcctgatgctagggaagttgaaagtgtgagtagttcagtgaaaacaaaacaaaagaaaacaacagaggtaacaacgtacttaagcmcccctgtactggggcctctggaaggacactaagagcatgactctgttttgattttaatgtggaggttttccacttactggtgctttcttctctttctcat

SEQ ID NO: 21530 - DNA, 201 bp, Homo sapiens
tccattacaagtatgatcagttgatagttccatcaagcagatgcataagagtggtagtggcattgcttcttgctttccttacagtgacatcaggaacagaygtgggcgtttgctggggcttgaaccctaccactcactgtcctgctccctaattgctaggaaatgctcaatggtgcagtgggaaatagttggcaaaggcat

SEQ ID NO: 21531 - DNA, 201 bp, Homo sapiens
aagtacattatatttattgctgcaatgctgcaatgtcattttagcccatatgatggtaacaggctattgccttccattactctaaatgtctgggaatagtrggatatgattttgactgatattcttctattttcacagatgatcaacctttcttaataactgtaaggcaacatataatttttggaatctcccttaatcctg

SEQ ID NO: 21532 - DNA, 201 bp, Homo sapiens
tatgatcagttgatagttccatcaagcagatgcataagagtggtagtggcattgcttcttgctttccttacagtgacatcaggaacagacgtgggcgtttkctggggcttgaaccctaccactcactgtcctgctccctaattgctaggaaatgctcaatggtgcagtgggaaatagttggcaaaggcatcttttcccaga

SEQ ID NO: 21533 - DNA, 201 bp, Homo sapiens
ttagatgttgaatttgatgatgctgagcaatacatctattgggttgaaaatccagtaagttttgaataacattcaaagtatataatttattcttgaagagmctgcctgcactgatgttttcttataagcaaacttttgtcatgtgagtaaaagggaaacaatgtggaaataaatttatccctaagttttttgattcaatga

SEQ ID NO: 21534 - DNA, 201 bp, Homo sapiens
tccttacagtgacatcaggaacagacgtgggcgtttgctggggcttgaaccctaccactcactgtcctgctccctaattgctaggaaatgctcaatggtgmagtgggaaatagttggcaaaggcatcttttcccagacttccaaagtcttggtatactctttcacttatggtattcaaaatgctatttcacatcttagcct

SEQ ID NO: 21535 - DNA, 201 bp, Homo sapiens
aaggcaacattagtgagtcttttctggagatggtcaatttctccttcatagatgcctccattttccttcatgaggtaaggggaagatgtggggagatggtkgtctgttctgggggtgattaatttctcctccatagatgccttcattctccttcttggagtaaggggaagatgtgggaagatggtggtctgttctgggggt

SEQ ID NO: 21536 - DNA, 201 bp, Homo sapiens
cagacacatatcgccagaggcggtttgcttggtaacatggtcattgttattcctcagtaccacaacctcaatgtgacaatggaaaggtgctttcttgtacyttcagttctgactttgatgcctcctcccttttcagtgagctctgcccatctctgtgacaacttcacagaattcagctgcaaaacaaattaccgctgcatc

SEQ ID NO: 21537 - DNA, 201 bp, Homo sapiens
aatccaccttctgttttgttacatgctggtgtttttcatggttgtaggaagctgtactggtcagaccaaggaactgacagtggggttcctgccaagatcgscagtgctaacatggatggcacatctgtgaaaactctctttactgggaacctcgaacacctggagtgtgtcactcttgacatcgaagagcagaaactctac

SEQ ID NO: 21538 - DNA, 201 bp, Homo sapiens
agttgataaggccactggggccaacaaaatagtcttgagagataatgttccaaatctgaggggtcttcaagtttatcacagacgcagtaagtatttgtcaytgaaatacattcatgggtgtataatgcatattcacacataactcacatttgtaagcacacacccacacacagtttcacgtacatacacgtgcatacaaat

SEQ ID NO: 21539 - DNA, 201 bp, Homo sapiens
tttgatgcctcctcccttttcagtgagctctgcccatctctgtgacaacttcacagaattcagctgcaaaacaaattaccgctgcatcccaaagtgggccrtgtgcaatggtgtagatgactgcagggacaacagtgatgagcaaggctgtggtaggaggggccacaggggagtggagggagggacaagaaagtgcacatg

SEQ ID NO: 21540 - DNA, 201 bp, Homo sapiens
aaaagagggaatgttgaccatgaatgttgctggcattcctctctttgggagcttcaagagtgagctaatacaattctcagactgtctcacaaggaagccartactactttgtgcatttctctgccaatggtttatgaagtctttgcaatgactgctttgcagaggagaggacatgccatcctgtgggggatttccgctgta

SEQ ID NO: 21541 - DNA, 201 bp, Homo sapiens
tgttgtttttagattgctaactcagctactatatgttggttattaatttttagaataaattatttggtgacccaattaaagaaatttgagatggggtggcragtagctaggatcaaaagttacaaatggattttgttttcatttagatgccgccgaatcctcaaatggctgtagcaacaacatgaatgcctgtcagcagat

SEQ ID NO: 21542 - DNA, 201 bp, Homo sapiens
tagaataaattatttggtgacccaattaaagaaatttgagatggggtggcgagtagctaggatcaaaagttacaaatggattttgttttcatttagatgcygccgaatcctcaaatggctgtagcaacaacatgaatgcctgtcagcagatttgcctgcctgtaccaggaggattgttttcctgcgcctgtgccactggat

SEQ ID NO: 21543 - DNA, 201 bp, Homo sapiens
acttggcatatcatcaaaatcacctgaggaacttaaaaaagtatagagattcttaaatcaaaactcacccttactaaagcaggggtatgaaaatctgtgtkttttaaaaattttattttattttactttcagttctgggatacatatgcagaatgtgcaggtttgttacataggtatacatgtgccatggtggtttgctgt

SEQ ID NO: 21544 - DNA, 201 bp, Homo sapiens
gaggagaagaaagtcttgagcttagtttccttccacgtgtagggaaggttcctctccaggaacctcagtgacttagctgatagaggaggcactgcatgagstattcagggggagcacagaaaagactggtacaaatacactttcagtgctttgatgctggctaacaggaagttttcattgctcagcgttcttggtaaaaac

SEQ ID NO: 21545 - DNA, 201 bp, Homo sapiens
atcaaaagttacaaatggattttgttttcatttagatgccgccgaatcctcaaatggctgtagcaacaacatgaatgcctgtcagcagatttgcctgcctrtaccaggaggattgttttcctgcgcctgtgccactggatttaaactcaatcctgataatcggtcctgctctccatataactctttcattgttgtttcaat

SEQ ID NO: 21546 - DNA, 201 bp, Homo sapiens
tgttacaagctagctacaacaagaaggacaggactcttttaagtctgagggtgacatgaagtactaccctcattcctggccacctccttttttggccagcrtggcaggtcctgaacctctccctaaatatgccactgtttgtgtcttaattgtatgttttgttcttaccttggtcacctttgaagttccccccagaccctc

SEQ ID NO: 21547 - DNA, 201 bp, Homo sapiens
gaagaaagtcttgagcttagtttccttccacgtgtagggaaggttcctctccaggaacctcagtgacttagctgatagaggaggcactgcatgagctattyagggggagcacagaaaagactggtacaaatacactttcagtgctttgatgctggctaacaggaagttttcattgctcagcgttcttggtaaaaacttgga

SEQ ID NO: 21548 - DNA, 201 bp, Homo sapiens
cttcaaccttatatattttgttctgaatttgtaaagttctccctttttttcttcttggttctccattgatcagcatgcactttcatttttcccataggaamtctttatttcaccaatgcctttgtttctgaaacactgatagaagttctgcggatcaatactacttaccgccgtgttcttcttaaagtcacagtggacatg

SEQ ID NO: 21549 - DNA, 201 bp, Homo sapiens
cagatgtcaccatgggtgctaagaaggggcatcctcagctcatcaccattccctggtactaccagcccttaattcctcgaggcccctggaggcccagtcarggtcctgatggagaaaaaggaaaattgctgtctctatcaaagcaagtggcttagcaacgctgtttctctcgatctgactccccccttttctccaccccag

SEQ ID NO: 21550 - DNA, 201 bp, Homo sapiens
ctgagatatgcttgcacaatgagttttcatgtggcaatggagagtgtatccctcgtgcttatgtctgtgaccatgacaatgattgccaagacggcagtgaygaacatgcttgcagtacggtgatttctttatgctgggtcatgttgttgggagtgttttgttttgtttcggttttgttttgttttatccccccgctccccc

SEQ ID NO: 21551 - DNA, 201 bp, Homo sapiens
ggaaggtggcttggttgccagattgctccccaaggcaacattagtgagtcttttctggagatggtcaatttctccttcatagatgcctccattttccttcrtgaggtaaggggaagatgtggggagatggtggtctgttctgggggtgattaatttctcctccatagatgccttcattctccttcttggagtaaggggaag

SEQ ID NO: 21552 - DNA, 201 bp, Homo sapiens
caagctaatctcttggtgcatgaaaggggtatatgtgtatgtacgtttgctgggggagaggaacgttttaaccattttcaccaaagaaagataaaattggwggtcaaatgaaattatgcaaaccatcagcaggtaagtaaaaatattagccctcatcattgtttggagtgatggatatgtacttctaggccacagaatcca

SEQ ID NO: 21553 - DNA, 201 bp, Homo sapiens
ggaagatggcagtagataacaacaagctaatctcttggtgcatgaaaggggtatatgtgtatgtacgtttgctgggggagaggaacgttttaaccattttmaccaaagaaagataaaattggtggtcaaatgaaattatgcaaaccatcagcaggtaagtaaaaatattagccctcatcattgtttggagtgatggatatg

SEQ ID NO: 21554 - DNA, 201 bp, Homo sapiens
tgagaagggccacttcccagagaaagtgggactgacatagaacctagatggatgtcttgggtactgataggcaaaggagccaggccggctgttcagaagcycaggcaatagcataaacgaagtcatggaggaaacaaaaatcattctgtgtaccttttgtgtgttttttccattccattccctacgttttgttttttttag

SEQ ID NO: 21555 - DNA, 201 bp, Homo sapiens
cttggtgcatacatacatagtacaaaatttctttccttgtgtactaatttatggctctaagagcagttgtatgatttagaactctatgtattttactgcamcctggtcaacacttgatatacatgtatatatttgtgtgtgtgtgtgtgtgtgtgtgtgtgtgtgtgtgtgtatataatcaattggtcaatgttagggaaa

SEQ ID NO: 21556 - DNA, 201 bp, Homo sapiens
agggacatagctcatagtccattcagaaactgaaatccaggacctctgggtaatgggcagtagccactcaatcagttccagatgtggttcctcttggttgrgagacccataaactaataaacaatcagtgccttctgtgcctgataggtattggcggaacaggggcaacacaatagaaataaacactcccattggaaagaa

SEQ ID NO: 21557 - DNA, 201 bp, Homo sapiens
aagtggtctgcagtttggaaaatgtgcctctgggatttcagtttgttctatagagttgtgcccatgactgcagatctctgctgacataattgtttacaagrccatgcaaacacatgcattgcttacatgtaaccctgcctgtttcttcctgtctcatttgagcatgatgctggcaaatccattaatttttcagtctttgtt

SEQ ID NO: 21558 - DNA, 201 bp, Homo sapiens
agagatcagatcattgacagagtaatcctaaacccaaagtaatttttatagctctttactgatttggtgttgggtcttaggaaaattagaaaacattgaarattggggaattccgatttctgaggaaaagcttaagagctggagattatttaatattagggagctaggtacttccatctctgtatgttgagtggggaaagt

SEQ ID NO: 21559 - DNA, 201 bp, Homo sapiens
cctgtggtaccaacaatggtggctgttctcatctctgcctcatcaagccaggaggaaaagggttcacttgcgagtgtccagatgacttccgcacccttcarctgagtggcagcacctactgcatgcccatgtgctccagcacccagttcctgtgcgctaacaatgaaaagtaaggctctctttcccctctcctcagtgcct

SEQ ID NO: 21560 - DNA, 201 bp, Homo sapiens
gaaaatactgtagtgagtatagacatttacctgggtagctttcagataaagatatttctgttttctagaacagacgttcaaatacagtgtatctgttggcrtttgcataacaaagcaccccaagacttagtggcataaactgagaaacgtgtcttatttctcacagttctgtgggttggctaggtagttcctctggcctgt

SEQ ID NO: 21561 - DNA, 201 bp, Homo sapiens
tcacagaaaacctggcaaatagggaattttaactctgagaaggtttggtgtggtgtacaaggcaaaagaatggttctgtcatgagcgagttgactagctayctggaacctatccattacttgatgagggcggtagtccttttctgttttcttttcaagtatttggcatcaggattggtgcagccatactggttattgaata

SEQ ID NO: 21562 - DNA, 201 bp, Homo sapiens
tgacagtgtaggggcttcaaattagtgtttataaggcttttagaggaaaattatttttgtatatgtgtaatatgtaaaccttagcataacacagtatcttytgctctgtattttctatgcattattcttaactcatagcagtctagattagtcataattgaggaaaatagcaaggaattttaaacatttaattttaatatc

SEQ ID NO: 21563 - DNA, 201 bp, Homo sapiens
aatcagcagtgcattccctcgcgatggatctgtgaccattacaacgactgtggggacaactcagatgaacgggactgtggtaactgtcatttgagaagctyaccatagaattttgtactgtgacagtgtaggggcttcaaattagtgtttataaggcttttagaggaaaattatttttgtatatgtgtaatatgtaaacct

SEQ ID NO: 21564 - DNA, 201 bp, Homo sapiens
agctttttccaagtgtctgagttgctagtttggtattaagggtgaggttataaaacctgacccaaaagtctgtacatgtggataggccttgtcagctggtragcttcaggcaggaaggtggcttggttgccagattgctccccaaggcaacattagtgagtcttttctggagatggtcaatttctccttcatagatgcctc

SEQ ID NO: 21565 - DNA, 201 bp, Homo sapiens
ggtttgctgtgagccagtcacagggtgtagataggaatgtgatggagtaaccactatactccaggtacctaatatctgtctgaaaatgacaaggccttctyggaatgacaatcttttctcttcagagatgaggacctgccatcctgaatattttcagtgtacaagtggacattgtgtacacagtgaactgaaatgcgatgg

SEQ ID NO: 21566 - DNA, 201 bp, Homo sapiens
ttacatgatagcttcctgagaaacataagtaggtggcatatattttgagtctttgaatgtctgtgagtgttttattttgctctccatcttgactgtttggstgggtacaggttgcaagttaatttaaacctggaatttgaagacattgctctagtgacgtctaatatctagtgttgagtccagtgccattctgagtaccat

SEQ ID NO: 21567 - DNA, 201 bp, Homo sapiens; identical to SEQ ID NO: 3776

SEQ ID NO: 21568 - DNA, 201 bp, Homo sapiens; identical to SEQ ID NO: 3777

SEQ ID NO: 21569 - DNA, 201 bp, Homo sapiens
tagggatttggtcatatttcatttaaaaattaaacatttatatccaaaatatataaatatttaaaatgacacatgtataaatatatattatccatttgtakaaatattccaatttgcaatttatctataaatcatctcagtgtaaatgagaacaagttttgttatttttctctacatttcaagacatttatttgaataatc

SEQ ID NO: 21570 - DNA, 201 bp, Homo sapiens; identical to SEQ ID NO: 3779

SEQ ID NO: 21571 - DNA, 201 bp, Homo sapiens
tgatgactgtggcgatggttcagatgaagaacttcacctgtgctgtaagagggagagaaacggagtgaatgggagtggtgttgtctgtcaaatctcattgkttcttacgtgtagcatgtgagcctggagagcagttgtacaattgtttaggaatggacacaggatcagcgttggtgttatttcactgggtcttccagcttc

SEQ ID NO: 21572 - DNA, 201 bp, Homo sapiens
gtcctgctggtgtttgcaaagttaaccctgcaggcctgtaagttgtgttcccctcaggttatactgagaatgcaactatctcctagaataacgtcccctcyggaatgttaatgagaaggtagaattccagtataatattgctatcttctgatttcttccaatggtgttggaagaaacaagaatggtgttcaccccaggata

SEQ ID NO: 21573 - DNA, 201 bp, Homo sapiens; identical to SEQ ID NO: 3781

SEQ ID NO: 21574 - DNA, 201 bp, Homo sapiens
ttgacagtaggcaaatatctttagagtttatcccccttcccctgggaaagactacctagaactcttcatcttcttaaaactcgctcaattcttcaagatcrtctttttttttttcctttgtttttgataagatttaacagttatcatgttgccatatttacttcatctatttctatgggaagactgaagtattttaaagga

SEQ ID NO: 21575 - DNA, 201 bp, Homo sapiens
ctggaactgtgcctgtagttctactcttacttttttttttgagatggaaattcgctcttgttgcccaggctgaagtgcgatggcgtgatctcggctcaccrcaacctctgcctcctgggttcaagcaattcccctgtctcagcctcctgaggagctggtattacaggcgtgcaccaccacacctggctaattttgtatttt

SEQ ID NO: 21576 - DNA, 201 bp, Homo sapiens
actcatgaggctgaggtaggaggatcccttaagcccaggagatgcaggttgcagggactgagaacatgcatggcactccagcctgagtaacagagtgagaycctttctcaaaaaaaacaaaacaaacaaaacaaaaaaaacaaccaatactagtcattcccagcatgggctgggcgtgaaaactggagaatggctaacatg

SEQ ID NO: 21577 - DNA, 201 bp, Homo sapiens
aattgcgactgaacatgtgctgtgtcctttgattcctcaggtgtctgcagaatgatgtgtgttgtatggggtgatgtcactgtgtgccttggttgtaatayagtttctgtatatggaactaatgttatctgtgcatgtaattgaacaatctgtaacctcatattttctctcacctgggtacagttagacttctctgacaag

SEQ ID NO: 21578 - DNA, 201 bp, Homo sapiens
aaaattagccaggaaaggtggtgttcgtctgtagtcccagctactcatgaggctgaggtaggaggatcccttaagcccaggagatgcaggttgcagggacygagaacatgcatggcactccagcctgagtaacagagtgagaccctttctcaaaaaaaacaaaacaaacaaaacaaaaaaaacaaccaatactagtcattc

SEQ ID NO: 21579 - DNA, 201 bp, Homo sapiens
agaccagcctgggcaacatggcgaaatctgtctctaaggaaaatgaaaaaaattagccaggaaaggtggtgttcgtctgtagtcccagctactcatgaggytgaggtaggaggatcccttaagcccaggagatgcaggttgcagggactgagaacatgcatggcactccagcctgagtaacagagtgagaccctttctcaa

SEQ ID NO: 21580 - DNA, 201 bp, Homo sapiens
gttcaagaccagcctgggcaacatggcgaaatctgtctctaaggaaaatgaaaaaaattagccaggaaaggtggtgttcgtctgtagtcccagctactcaygaggctgaggtaggaggatcccttaagcccaggagatgcaggttgcagggactgagaacatgcatggcactccagcctgagtaacagagtgagacccttt

SEQ ID NO: 21581 - DNA, 201 bp, Homo sapiens
aagaggaattgcaagggaagagagttcactgttgctggccattcacttaactggagatgatatgaagggacgattcatgcattcattggtgcattcagtcrttacttcctgagtccctcctacatgcccagcgtgatgacaagcagcaggggttttgaggggaacaaggcagacatggcccttgctctcctgaagtacata

SEQ ID NO: 21582 - DNA, 201 bp, Homo sapiens
ttacaggaccagccagagggacatgtagtgttgtgttgcacctagtgttgagctcatgccatctcgtgagaggcaaatgtgtgtatctctttgtggttccrtgttcagtgatgtcacactggaagcctgagcttgaccatggtgtgaacagtcacactggaacatgctacaaatcagagcatttagaaaatttttcctgag

SEQ ID NO: 21583 - DNA, 201 bp, Homo sapiens
aaactgttggtcgctggtactagtcttattggaggactaccctagatgtatataattaaataatgctctgtttcaggttttctagacaacccatgctacarccagcttgtctccagattcctggactgtaaaccactttttttcactgagaatgctattgatcttttcaggtcactctgagcgaacatgcctagctgatga

SEQ ID NO: 21584 - DNA, 201 bp, Homo sapiens
tgtgctgcctggaacacatggcttccaaggttgctgcagcagcacaggagacacggaggaggcacgtgtgcttttcattgcttcagcccagtagtgacacrtggcacctccaactgacagtacgttggctagaactggtcacatggtcctaacccagctgcaagggagactgggaaatgtagggaagcacttgtttatttg

SEQ ID NO: 21585 - DNA, 201 bp, Homo sapiens
taatagctgtagagtgtcaggcttcatagttgtgcagtccagaattggatgctctgaggataagcctaggagtgctgcatataatgtgaaaattgcctcamagttttagcattatatgcatttatctaaatggtattcagatcacgatcagaaataggaatcctgactcccccagtgccctctgtcctctccaaggcttat

SEQ ID NO: 21586 - DNA, 201 bp, Homo sapiens
tagtgacacatggcacctccaactgacagtacgttggctagaactggtcacatggtcctaacccagctgcaagggagactgggaaatgtagggaagcactygtttatttggtaagcacaaactgtctctgtcaaagaaggaagtatcttgcttcataaaagaaaaagttttgattttaacttgtttttacattgcaggtag

SEQ ID NO: 21587 - DNA, 201 bp, Homo sapiens
ttctctgtgtttttaagttgctttggttcatgagtttgttgtgatgctgttgctgagcttatttgacagtgaactctgactggcgtccacagactctagtrtaagggttgtttactatttgccttcaaataaattgagcaggagtttacatgatacactcttctggaacaagcattgcttgctagtataatggggaggatg

SEQ ID NO: 21588 - DNA, 201 bp, Homo sapiens
tgccagcagggctatttcaagtgccagagtgagggacaatgcatccccaactcctgggtgtgtgaccaagatcaagactgtgatgatggctcagatgaacrtcaagattgctgtaagtgtttggagaggaatcttgctttggctttgtggacacctaaaacccaacctgtcgcaaagaagttacacacaatgggatgattc

SEQ ID NO: 21589 - DNA, 201 bp, Homo sapiens
ctccaggtgctgcttgtcctgcaagtagacacaatggggtcaacacacatggatgactgagtgtttctaatgcatatgagactctaatgtctttgtgtgtrcttgtgtgtgtgtctgcctgtatgtgtccaggtatagggactgctgatggcattgcctttgactggattactagaagaatttattacagtgactacctca

SEQ ID NO: 21590 - DNA, 201 bp, Homo sapiens
gaagcacttgtttatttggtaagcacaaactgtctctgtcaaagaaggaagtatcttgcttcataaaagaaaaagttttgattttaacttgtttttacatkgcaggtagaaaaccgacccctaaaccttgtacagaatatgaatataagtgtggcaatgggcattgcattccacatgacaatgtgtgtgatgatgccgatg

SEQ ID NO: 21591 - DNA, 201 bp, Homo sapiens; identical to SEQ ID NO: 3755

SEQ ID NO: 21592 - DNA, 201 bp, Homo sapiens
atatgtatatacctgatctctactttctgaaaatttacacatttagaatgggaggttatttagttcctagcatgtaacttgtgacttataaacccacttarcaattacatactgcttcaatctgaatttgggccatagctaaataagggtgagttgccattttgtaccaaattgaggttaaggtgcaagatgccaggtgtc

SEQ ID NO: 21593 - DNA, 201 bp, Homo sapiens
ctggactgacttgtacacacaaagaatttaccgagctaacaaatatgacgggtcaggtcagattgcaatgaccacaaatttgctctcccagcccaggggartcaacactgttgtgaagaaccagaaacaacagtgtaacaatccttgtgaacagtttaatgggggctgcagccatatctgtgcaccaggtaaggcactgac

SEQ ID NO: 21594 - DNA, 201 bp, Homo sapiens
gccactgcacctggcccgatttctcttttttcttttgtacaaaaaatgtcatgctccctaacttactgtccatgtttgaggttcccaaagaagctgagggrcaatatgcaactcgtaccacctgctgcttcataactgtggatctttttccagaatctctcctcaggtttctaagaccagaacccaagtctccccattccc

SEQ ID NO: 21595 - DNA, 201 bp, Homo sapiens
gcattacatttgtttctctatagggaaattaaaatcatgattatgctatattagcaaattgcttataaaacaaattacaatttttgattgtaggataagawgtactcttgtagccccctccctccctccctccctcccttccttccttccttcgttccttccttccttccttttcttccttccctccttccttccttgtag

SEQ ID NO: 21596 - DNA, 201 bp, Homo sapiens
aagggctcatatacttggtcttgccctctagatgctgcgttccttgaggataaagcctctacctggtctgtagatgtatgcttattgcctgtggcacttcrtggtacatggtggcactcagtaaatgttgagtgaatgacaagctctccaatatccatttttgttacttccccagtcctctgatttttacccgtttgctcc

SEQ ID NO: 21597 - DNA, 201 bp, Homo sapiens
ggcaaccaatcagtaaattgtctagtatgttgaaaggtggtgctaagtgttatggaaagaaggaaagggagcaaggaagcgggcatggggagtgcaggcgrggggagactttgcacaaaacaaaatggttttggatgaaaagtagattttaaaatagaaacatgtgaaatagtaggtaattcatatctttcctgggaaaag

SEQ ID NO: 21598 - DNA, 201 bp, Homo sapiens
  misc_feature (1)...(201): n = A,T,C or G, or insertion/deletion polymorphism (see Tables 1-2)
tgttaagactgatgggaacatgcttgtgttttgctcatgggttttatcttctttccctcctgcagccactcacacgtgcagcagcagtgagttccaatgcncatctgggcgctgtattcctcaacattggtattgtgatcaagaaacagattgttttgatgcctctgatgaacctgcctcttgtggtaagagagtaagcaa

SEQ ID NO: 21599 - DNA, 201 bp, Homo sapiens
tacacaagcatccattttccaggctcagtcttccttttttggtaactattatctagctcagagatagaggcagattgttaagactgatgggaacatgcttrtgttttgctcatgggttttatcttctttccctcctgcagccactcacacgtgcagcagcagtgagttccaatgcgcatctgggcgctgtattcctcaaca

SEQ ID NO: 21600 - DNA, 201 bp, Homo sapiens
aaacggccttatagaccagaagaattacaagactttaattagatgtgcacccacataacaatttggaaaatgcatataaccagagctacctaaaattactsgagaaaagagtcaatgttcaaacataggcagagtttcccacttactcaactaaaagtctggtattccaaggatgaatacgaagataactttgccaacttt

SEQ ID NO: 21601 - DNA, 201 bp, Homo sapiens
agagtgggggtcacaaggtgctcagtgggggggagtttttgagccagatgagccaggaaaaggaatttcacaaggtaatgtcatcagttaaggcaaggacmggccattttcacttcttttgtggtggaatgtcatcagttaaggcaggaacaggccattttcacttcttttgtgattcttcagttacttcaggccatctgg

SEQ ID NO: 21602 - DNA, 201 bp, Homo sapiens
gccgcccttccagtggtttgagttccacaatagatgtgttagcacggatactgttcataatacatatttggtggatatattcctaatatttatctggttgyctttttcaagctgatcgcacttgccagtctggatacacaaaatgtcataattcaaatatttgtattcctcgcgtttatttgtgtgacggagacaatgact

SEQ ID NO: 21603 - DNA, 201 bp, Homo sapiens
aaaaaatttttgggggggtggcatggagagataatgcgcagtgtttctcagggctgctcaagtgggattaggggcggtgtgggaacctagagtgggagagmttaagctgaaggaagattttgtggtaaggggtgatattgtggggttgttagaagaaacatttgtcgtgtagaattattggtgatggcctggatacggttt

SEQ ID NO: 21604 - DNA, 201 bp, Homo sapiens
gaaaagacaacatatagtgacccagacttcaaccttatatattttgttctgaatttgtaaagttctccctttttttcttcttggttctccattgatcagcrtgcactttcatttttcccataggaaatctttatttcaccaatgcctttgtttctgaaacactgatagaagttctgcggatcaatactacttaccgccgtg

SEQ ID NO: 21605 - DNA, 201 bp, Homo sapiens
gccaaccctggattaaaggattggaaatgagcaaatgcatacatagcaagtagagttaggtaatgaaaaaatgtatcagtaacatatttcacattggcctsatttctctagaggtggtttgaatcagatataggaacaaaatatgtgtgtcttggtagtagcattgatagttcaacaacagactttcaactacatgaaatc

SEQ ID NO: 21606 - DNA, 201 bp, Homo sapiens
agcactttaggaggctgaggcaggcggatcacctgaggtcaagagttcgagaccagcctgaccaacatggtgaaaccccatctctactaaaaacacaaaarttaaccaggcatggtggcgtacgcctgtaatcccagctactcaggagcctgaggcaggagaatctcttgaagccgggaggtggaggttgcagtgggccga

SEQ ID NO: 21607 - DNA, 201 bp, Homo sapiens
tggtctaagaaccatttgccttgtgtgggaagagattgataggtggaagtttcagcgggggactaggtgggagtgactaatgtgaaggagaaaaactgacygtgagggacagaagttggaacgctagctgcttttttagctaatttatcagcataagcattgtcctgagcgatgggatctgatgcctttttgatggccctt

SEQ ID NO: 21608 - DNA, 201 bp, Homo sapiens
tagaaggtatactactatttaatatggtaatgaaatagtccacaaatatgatttattaatatatatttggtgaattgaagcaaaagagttcacagtgtcastccctctttagtaatcatatttttgcagcactttgtgcttacatactgtgaatgtatgaaacgatcacttgcttcctagatgagccaaggtttttaggta

SEQ ID NO: 21609 - DNA, 201 bp, Homo sapiens
attagtgtttaaatgttcaaaattttcactatgaatccatgaaactaatgaaaattccaatcctttagattgaaagaggaaacgtggatggaacagatcgratgatcctggtacaccagctttcccacccctggggaattgcagtccatgattctttcctttattatactgatgaacagtatgaggtcattgaaagagttg

SEQ ID NO: 21610 - DNA, 201 bp, Homo sapiens
tagtccctttgcaagagtgagggtttgacttaaggcaatgagttcggcttgctgagaggtagtggagcggggcagagcggtagcctcaatgatagatgtgsaagatactatagcatagcctgcctttgctggtgagtggcgattaggcctggtggaactgctatcagtaaaccaagtgtgttcagggtgaggaacaggaaa

SEQ ID NO: 21611 - DNA, 201 bp, Homo sapiens
tttgtaatgctgggattttgtttttcagataaaggaaaagaaagaacatgtgctgaaaatatatgcgagcaaaattgtacccaattaaatgaaggaggatytatctgctcctgtacagctgggttcgaaaccaatgtttttgacagaacctcctgtctaggtagagtatattttttccaattcctgtttaggtgaacttta

SEQ ID NO: 21612 - DNA, 201 bp, Homo sapiens
gggagggctctaggtttggtgctatcaaacgtgcctacatccccaactttgaatccggccgcaataatcttgtgcaggaagttgacctgaaactgaaataygtaatgcagccagatggaatagcagtggactgggttggaaggtaaatttgccatacattccccccttacctgttctgttttcctggttagagttctctac

SEQ ID NO: 21613 - DNA, 201 bp, Homo sapiens
tcctgcgtgattcaggtgctttggctgttgggcaggagtcccctcaattccttactcttccaagtgtaacctgccaaacatgtccccttggctgtagttcycccaagagagggggactatggtctgatgataggtatctgagcagctgtctcaccagccaaacgaaatgctctcatcttcaaacctcttacccagtaatga

SEQ ID NO: 21614 - DNA, 201 bp, Homo sapiens
ttggatcctaaagttttcttatttggagcagagctttgtgatagacaggaaagttctggaaaatgagctgagcgatcagactacaggatcccttaagtcckgtgcagtatttcatttttctgtgaatcttaggctcctactccttttccaatttacttcactccaatgtttatgttcctaagagtttgtctgttttccaag

SEQ ID NO: 21615 - DNA, 201 bp, Homo sapiens
tgaccgaatctactggagtgacttcaaggaggacgttattgaaaccataaaatatgatgggactgataggagagtcattgcaaaggaaggttagaaattarttagaaagtaatatattaaattaataattaacatatttctaatgtctttgcctgttttctcaagaaggagccctgctcttaggaaatggcttatatagtt

SEQ ID NO: 21616 - DNA, 201 bp, Homo sapiens
aaactcgagtctgcctggatgaatggagaggaccgcaacatcctggttttcgaggaccttggttggccaactggcctttctatcgattatttgaacaatgrccgaatctactggagtgacttcaaggaggacgttattgaaaccataaaatatgatgggactgataggagagtcattgcaaaggaaggttagaaattagtt

SEQ ID NO: 21617 - DNA, 201 bp, Homo sapiens
ttcctaagagtttgtctgttttccaagcactagtcctttgctataaggatggggtagagagaaagaagcttaaagagtttgcagacaggttaagatgcttytgtggagacagaacacatcttggtgcacatctgagtgtccttagcacttcatctatggacttctttcataaatggtagaacacgtatccatcacacctta

SEQ ID NO: 21618 - DNA, 201 bp, Homo sapiens
caaggtgattctgagggctggaccaatttttgggaacgtgtgatctaggtaccctctcatttttcagttttgtaaacagacttagaggtgaactgacttamcactgcaaatttcttcagtggcagttaaatatactctgttaaatctctttcttttggatgggaatgttacaagctagctacaacaagaaggacaggactc

SEQ ID NO: 21619 - DNA, 201 bp, Homo sapiens
aatgctcaataataattattgatgaagcattgctttgggtgctgaactgaatatatgctagtcccttccttgctatttaacagtagttacttcagatcctkgacattgatgcttttcataatattgtgcagtaggtttggctttcagttcattgtttgttcaacaagtactaacttcactccgaatatggacctataatgg

SEQ ID NO: 21620 - DNA, 201 bp, Homo sapiens
taagttctcttatttaaagtcactgaagaaaaaaatgaacaaccaagtgagagctgagtttctttacttcccggagaacactgctgttgtagagatggagragacatttcctatgtgctggatgtgcttaaaggtctcttggtcccaaagtatctctcactacggccaaagatctctgctctgtcattactaaagtcagtt

SEQ ID NO: 21621 - DNA, 201 bp, Homo sapiens
ctcagcttggagccttgccctgaggagtagctcccaacacttctgtgaggttgctcagctaatctggtcctggcctccactctctccactctctcctccargctcatgtttcttatattctaaattctagaactttgatcagtttcatcagcataaccactcttgtaactgctgggctcccttttcagccatggcagtaaa

SEQ ID NO: 21622 - DNA, 201 bp, Homo sapiens
aatgactaaatcagtaaattgtactcttaagattaaaggctattttctgatttatttttttgatgacaaattagagtgtttccttctcatctcagtcactscctgccactcttgctcttaatcataagccagttttagtttgagaggagcacaccagggaaacttttaatatatggttttaaggaaaagtcaggcttaagg

SEQ ID NO: 21623 - DNA, 201 bp, Homo sapiens
tttgtgtgtcagttagtagagattttattgtatatattttctggtatagtttattactgaagccgtacttctttttagcattaaaattctaaaattttatrtttataatagtgacaaaggtttttactgtaattactaatgatatttaaaacacagattaggcaaaatcttaggaaatataccctgctttttttccttcca

SEQ ID NO: 21624 - DNA, 201 bp, Homo sapiens
attaatatgagtttttaaacttctctatggtaacaaaagccatagtaatagcagtgagtaccaatgacctgatatatttaaataaaaataagcacataatmtatatatgaatatatcctcattgtagtaaagtaataatattcagaaatatattttaaagaaataatacgatgtacaaaaaagtaaaatttacattttttc

SEQ ID NO: 21625 - DNA, 201 bp, Homo sapiens
gcagccctgcgcaaaggggcagcctcacttctgctcagagtggggctcgtctgtgggtgtgaggccactcctgtgtctttagcaaatgtcaggctcctttkcccccctcactgctacccagctgccaatcccattcccagccttttagttctttaggcattttccttttctcttagtagaaaagaagttccaatagaaata

SEQ ID NO: 21626 - DNA, 201 bp, Homo sapiens
tctcataaggaatgcacaacctagatccctctcatgtgcagtttacaacagggtttgtgctcctatgggaatctaatgcagccactcatctgacaggaggyggagctcaggcactaatgctcactcacccgcctctcacctgctgctgtgtagcctggttcctagcaggccacggaccagtaccagtttgtagcccaggga

SEQ ID NO: 21627 - DNA, 201 bp, Homo sapiens
ttctatttttaaaaaaatttagagatgggggtctcactatgttgcccaggctggattcaaactcctaggctcaagtaaccctcctgcctcagcctcctgartagctgggactaaggtgtgtgccactgtgcctagctctgtttttctttaaagttactgtgtaataaaaaaagaatttgcaaatgcataaaattgaatata

SEQ ID NO: 21628 - DNA, 201 bp, Homo sapiens
gagaagttttttttggctcaagtgatcctcctacctcagccttccaaatagctacgactacagctacttggaagtgagccactgtgcccagctaaatttawtttttttttcttttaagatataaggatctcactatgttgcccaggctagtcttgaattcttggcctcaagtgatcttcttgcctcaatctcccatagctg

SEQ ID NO: 21629 - DNA, 201 bp, Homo sapiens
tcctattttctgtgtcagttttcaaaattctttgcatttttcatcacagaaatcaggttaggtaattaagtagccggtcttgtggtagatggtgatttggrgaataattaaatgaggcctggtaagtgatcagggagtgtacttggcagctttttatattagctttggccttcactatgtactgaagatggagggattatt

SEQ ID NO: 21630 - DNA, 201 bp, Homo sapiens
tgtccaggtgtagaagaactggagggttgggagctcaggcagggcttaagggcaaagaacaagtttaataggaaaagttaaagcaaggaagaaatgagagkttttggtcgaagcagagcatttcagagtttgagaacttagaggcggagaagtttagagttgaagatgaaattcaaaggacgggtatattgatttggtggt

SEQ ID NO: 21631 - DNA, 201 bp, Homo sapiens
agaaacccagggttggagattagcttagacacaatgggaacccaaaagaataaataagaatattgttgaaatggttacatatgatgtccaggtgtagaagractggagggttgggagctcaggcagggcttaagggcaaagaacaagtttaataggaaaagttaaagcaaggaagaaatgagaggttttggtcgaagcaga

SEQ ID NO: 21632 - DNA, 201 bp, Homo sapiens
attttttttaaaaaatttcaacttttattttagttatagggggcacatgtgcaggtttgttacatgggtatattgtacccagatagtgagcatagtacccratagttagtttttcaacccatgccctcctcccttcctcccctctctagtagtccacagtgtctgttgttcccatgtgtatgtccatgtgtgctcaatgtt

SEQ ID NO: 21633 - DNA, 201 bp, Homo sapiens
catctgatattattatcatactctgatatccctccactgtttttttcatagaaattcttttttttttttaatttttttggagatggagtgttgctctgttkcccaggctggagtgcagtggcatgatctcagctcactgcaacctctgtctccaagattcaagtgattctcctgcctcagcctcctggcagctgggattat

SEQ ID NO: 21634 - DNA, 201 bp, Homo sapiens
ctcattttctattgagctaatttcctcatttccctgaagtgcaatatagattatctgaatctcatgcaaatcctctctcatccatccctaatcgtgctttrgaatttgttttgtacataagttctccttcatctcagtttcctttggttccccttatgaaagtcagttctaataagtgattttatgctataggttttgaca

SEQ ID NO: 21635 - DNA, 201 bp, Homo sapiens
tttctctttccaaggtgctgaatttctttctttctttctttctctttctttctttctttctttctttctttctttctttctttctttctttctttctttcyttctttctttctttccttctttctttcttctttctgaatttcttttttaataaatctggttttatataactttttattgaaagcttcttcaaattacttt

SEQ ID NO: 21636 - DNA, 201 bp, Homo sapiens
ttaaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaagggac

SEQ ID NO: 21637 - DNA, 201 bp, Homo sapiens
ttacatttacattggtagggggcagttctaagatactagctacactgaaattagaaacaacttttttctccaatattaataaatatttctgctgtcagcaytagggtgtttggtttccaaagcccttgcatttgatatagctttttaaaccaccattacgcacattggaagatactgttggctctcagttatcttaatttt

SEQ ID NO: 21638 - DNA, 201 bp, Homo sapiens
gtggtacagaaattggctggagggcccagagagggactatcccactgcagtgtggtggcagagatgatagtgtaaatgagggtgagtggccagctgacacrtggacgagaggtattgagaggatgcctaggctctgctgtcacctggcagagccacttccagttgctgggtattcaggttattcattctgtcaggacctaa

SEQ ID NO: 21639 - DNA, 201 bp, Homo sapiens
acagaaattggctggagggcccagagagggactatcccactgcagtgtggtggcagagatgatagtgtaaatgagggtgagtggccagctgacacgtggaygagaggtattgagaggatgcctaggctctgctgtcacctggcagagccacttccagttgctgggtattcaggttattcattctgtcaggacctaactgct

SEQ ID NO: 21640 - DNA, 201 bp, Homo sapiens
ggcactctgctgagtacagctgactaacacctgcatggctttcccttcctgcagccatcgaactgcctatcaacctgccccccccatgcaggtgcatgcayggaggaaattgctattttgatgagactgacctccccaaatgcaagtaagtctgaatgttgaggtcccagctataggccttgcctcttctggggaaatttg

SEQ ID NO: 21641 - DNA, 201 bp, Homo sapiens
aacttatattccttttatgcaattaaagcaactttatgatttagagtctgaaataaagataaaggtctgaaatatattttggggatagactggtttttgtrggtctgctttgttgtgatgtcttgctaaaacatatgataaacttggaattaaggaaaaatgagaattagcaaaataaagaaatttagtatttctttctgg

SEQ ID NO: 21642 - DNA, 201 bp, Homo sapiens
cccccaaactaaaaacaacacatcaataacagtaacaaacacaaagtttgaagactattttccagtaggagaatagggacagaggaaggtatgcttaacakgtcagggtgttcagttcttatctcttaagtctgtatgcaataaagagatatttaagaatttgggagacagtaatagtcaaaagaagaagtgctccatgta

SEQ ID NO: 21643 - DNA, 201 bp, Homo sapiens
atcaacctgccccccccatgcaggtgcatgcacggaggaaattgctattttgatgagactgacctccccaaatgcaagtaagtctgaatgttgaggtcccrgctataggccttgcctcttctggggaaatttgagaccttaaagtagccaggaaaacaaatacaggaacctcaccagttcactaattcttacattttaacc

SEQ ID NO: 21644 - DNA, 201 bp, Homo sapiens
caaaaggcatctctccaggaacaagtaagttttaagaatgtgagcaacttggaaattactcatggcccctacattgaatgctgtcacagcttttctacttmacccagtctttgaaggagtggttctagcccccagtttctgccaggattgcgggctcccatgtgttgatgtgctctctgctatcttcttctatagccgcag

SEQ ID NO: 21645 - DNA, 201 bp, Homo sapiens
atacactttcccatagcaaatagcatacctgactctctgtgctaatattgcacatttgttaaacaatgaatgaatggatggatggatggatggatgaatgratgaaacatatactactgattattttattccagagttctcaaaatatttgttgctgatattttgagtgctgactgtaattactttgattagataaacaac

SEQ ID NO: 21646 - DNA, 201 bp, Homo sapiens
agaaatccttgtggaaaaaacgattacacatattcatcaactatatgctgactgaatgactttgaaacttttttattcaaaatgttggagaactgacatcrtctttgttttatggaagtgttaggttatgctttatgaagaacagcaagacataattttttttcgtcaacctttccaaataatttcatgctactagtgaag

SEQ ID NO: 21647 - DNA, 201 bp, Homo sapiens
tggctttctatagctgaggcagaccccaaaggagctgattgcaggaagaaagtccttcctcatagctggtccttcctataaggggaagctgcatggcacawctctgggtgtaccactgcttcccatctcatgaagagtcaaagtccaagtccttactatgatctacaagaccctaaccatttggccttcacatcacctccc

SEQ ID NO: 21648 - DNA, 201 bp, Homo sapiens
ctaagacccttactaccaaactcacatctctctaaagtccacccagtgcaaagctgtcttaattccaaatggcaattaatatgctcttattttatctcttkgtctcttgattagtaaatggggttctcttcttttaaactgatagttttccaaaagcagggaacgtgtctttcccattagtgttaggtacaatgcagtagt

SEQ ID NO: 21649 - DNA, 201 bp, Homo sapiens
taaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaagggact

SEQ ID NO: 21650 - DNA, 201 bp, Homo sapiens
gagccaccacgcctggctggcaaaaataaattatttgagctttctattgctctattttgtttcctcctaattatcaatactaccttgttgctataaaagtrttttaggtaatttacaaaataatatataagaagataaataaaagttgcataaggaattcaacataaagggaagattatggtaagcagagaattttactat

SEQ ID NO: 21651 - DNA, 201 bp, Homo sapiens
aaatcaaaataaaatttgacctaaattgatgctgagaagagtctatatcaaggcttctgtacaccttctcaaattcccttatttcttcttctcatgtcacacacacacacacacacacacacacacacactcatacactcacagacatacataaatattgtctagaaaggaattttcagtttcagatttttcaagggacta

SEQ ID NO: 21652 - DNA, 201 bp, Homo sapiens
aatcaaaataaaatttgacctaaattgatgctgagaagagtctatatcaaggcttctgtacaccttctcaaattcccttatttcttcttctcatgtcacamacacacacacacacacacacacacacactcatacactcacagacatacataaatattgtctagaaaggaattttcagtttcagatttttcaagggactaa

SEQ ID NO: 21653 - DNA, 201 bp, Homo sapiens
ccagtggtgctgaacctttgtttgcctttcctctgagtgtaaggactgttcaagaaatacagcagctggcagtagccacagtgaagaaagggttcttttgyaggagccatggccttggaactgctcacctccccttgtctttctttccagggtgaaattcacagagtgaagacagatggcaccaacaggacagtatttgct

SEQ ID NO: 21654 - DNA, 201 bp, Homo sapiens
gaatacatgccaagaagcagcagtcacaatgcttgcccctagaggagtcttaagctagtagaaaatattcgacgaatataaaaatgatcaaaactcaagayaaaagtagtagctccctaagggaatttagtgaaagcatttgatgtggtgctggggccttcctttagaatcctttagaatatttgcctctagggtaagaat

SEQ ID NO: 21655 - DNA, 201 bp, Homo sapiens
gatgttttcttataagcaaacttttgtcatgtgagtaaaagggaaacaatgtggaaataaatttatccctaagttttttgattcaatgaggggtatatatktgagcttggcctggagcaaaaatcataacactctttagcttcagaataagaaacaaatttaagctattgtgtattatttactcattcagcaagtattttc

SEQ ID NO: 21656 - DNA, 201 bp, Homo sapiens
actgatgttttcttataagcaaacttttgtcatgtgagtaaaagggaaacaatgtggaaataaatttatccctaagttttttgattcaatgaggggtatawatgtgagcttggcctggagcaaaaatcataacactctttagcttcagaataagaaacaaatttaagctattgtgtattatttactcattcagcaagtatt

SEQ ID NO: 21657 - DNA, 201 bp, Homo sapiens
tacaatgtgtagacagttttgagaactttggaagatactgtttacttattcacttatacattcatccattaatgcagtcatatggtcatccatttagttakcaaacatttattgggcaactattttatgccaggctctgagtaccaggccctgggacacaataatgagcaaatcagacacagtcattgacctttgggagtt

SEQ ID NO: 21658 - DNA, 201 bp, Homo sapiens
cctatctaacaaacaagattaggaaacttgagggagataaattaagggaaatacttacctgatgcatgcagtatggcgcatattctcaatcaatgagaagygatttttattgcaattgcagttgttcagaagagaggcaatgtggagcagctgagagaagaagggcctggaagtgaatgagccagggtccatctcctatta

SEQ ID NO: 21659 - DNA, 201 bp, Homo sapiens
aacaatgctttggttgagaattattccaattaagcaaagggagatgacccattcaaaagggcaggatcagatcttacgtaagtgagtaaaaatttaaagtyccccataaaactgggacagagatagtttctactgagccagtgaacattaataacagataatcaataaataattaaatatcatctcaatataatttcttgg

SEQ ID NO: 21660 - DNA, 201 bp, Homo sapiens
acagtggcagtgttgagtacttgtgaaaccatatgctctgcaaagcctaaaatatttattatgtggccctttacagaaaaagtttgccaaccctggattawaggattggaaatgagcaaatgcatacatagcaagtagagttaggtaatgaaaaaatgtatcagtaacatatttcacattggcctgatttctctagaggtg

SEQ ID NO: 21661 - DNA, 201 bp, Homo sapiens
caaaggattgtgaattattgttttctggagtagattgaaactcattaacatctttagcaatggtagtagaatccattcatttctttctttgctcagtgttracagtttggacctgttgtctctgtgtgggtctccaaagagggaaaaccattcagaaacagattttcaggtattttcagtatttggtggagttagggagct

SEQ ID NO: 21662 - DNA, 201 bp, Homo sapiens
ctaactttatggcctgttttttggtattgactctcctgtttgtcctggtactccttctggaaagttatttttcctgtgtaggtttcctagaattcctagawtatatcatattgaagtactttgttaactatgccataagttgtgggaaactagagttggcctcacttttcccttcttcctaatgtggatgggaaactgact

SEQ ID NO: 21663 - DNA, 201 bp, Homo sapiens
tggcagtcactttagggacttgaaattcaccaggaatgggggtttggggagtcgtggtggtaccttcatgagactaactttatggcctgttttttggtatygactctcctgtttgtcctggtactccttctggaaagttatttttcctgtgtaggtttcctagaattcctagaatatatcatattgaagtactttgttaac

SEQ ID NO: 21664 - DNA, 201 bp, Homo sapiens
aatagagtaaataagcttataaagatgaaatgccaaggtaacttatgggagaaaaaaagggaagaaatatatttcaccttttaaacatagattactaccamtgtttttcttaacttgttgatttcacaaggagaaaataaaatttctggctcaaagatagcaacattttaagttttctaagacaattgattgaaagccact

SEQ ID NO: 21665 - DNA, 201 bp, Homo sapiens
ccagattagtatggtgtaatctctctctctgtttctctctctctctctctctctctttctgtctctgccatcagagtgaagactttgtcatggaaatgggraagcagcccataatatttgaaaacccaatgtactcagccagagacagtgctgtcaaagtggttcagccaatccaggtgagaaaccatacagtcttttctt

SEQ ID NO: 21666 - DNA, 201 bp, Homo sapiens
ttttgggtaacttatgacgtagcacctagcgtacctccaggtgtgaggaaggcacctttctttgtgtgtgaaccagattagtatggtgtaatctctctctstgtttctctctctctctctctctctctttctgtctctgccatcagagtgaagactttgtcatggaaatggggaagcagcccataatatttgaaaacccaa

SEQ ID NO: 21667 - DNA, 201 bp, Homo sapiens
acttgtgaaagggcccgcagctattaggcaacagtcagtattcaaattccagacctgtctgactggaatgcctgtgtgcctaaaaaagtctgtttgctgcrtctagagtatctgctttaatttcctctctgtaagataataaaagaaacacattttaaaactgatgttattattgataagaaatttcattgccctatagag

SEQ ID NO: 21668 - DNA, 201 bp, Homo sapiens
catatgtgatatatccaactgattgtcctttttttagaacccactgaaaatagtccttcatcttcaccaatctcctgaaaatattctttcaatgctaccartgactgccattatgctaagcctaatggttcttgttcaaatatcacttctcagagagctactccccacagttactctttaccttttacccagctctatttt

SEQ ID NO: 21669 - DNA, 201 bp, Homo sapiens
aaggacccatggccacttgtctcctgggcatagtctccctcatctcagtccccattcttttgaggactccatacgtaacaaataggttggaggcaggagartgatggaattccacacatagatgagtagagaagttgggaaataagccacaataaaagtgactaaattatttgagtgctttctataccaggcattggccta

SEQ ID NO: 21670 - DNA, 201 bp, Homo sapiens
ttctgattcagattttctttagtgaaaaaaagaaaaaagagggtaaaagaaagcataataactccataaagaggaaagcgtttttttttttgttgttgttktttttaatcagttctgatttcctttctggtatctctgctggtgttttcaaaacttggcaactttgtggctgtggaagactgttgatgagagggttgggcg

SEQ ID NO: 21671 - DNA, 201 bp, Homo sapiens
atcgttggtttgcagcacttctcttttgttacttaggaatgccaaagaaagggtaaaatccctgttacaatgaaggctttcttgctggtaatcagcagtayttggtctgcctgcaactggggctgctttgtcccagaagttttatttctattgactttctgctctttagaatttaaacatttttctttatatctttaactg

SEQ ID NO: 21672 - DNA, 201 bp, Homo sapiens
tgagtggctgtgaggatggatgaatccatgtagaatacttggtccagtttctgccacctagtaagtgctcatttaatctaagctgtgattattaacactaytaacaatattgtgttttctaaatatatagttggctttctatcacatagagaactttcttttcacaatttgctgaataaatgaagagaaaaagtagtagga

SEQ ID NO: 21673 - DNA, 201 bp, Homo sapiens
gcctagttgcctcctcctctttcaccacctcactatgaattaccttgagggtggtgtccacacttctttccagatgcttaacttctctttgacttggttcyctcatctgtagaataggaacgatactaatgcctacttgattgagtggctgtgaggatggatgaatccatgtagaatacttggtccagtttctgccaccta

SEQ ID NO: 21674 - DNA, 201 bp, Homo sapiens
cttctaatgggattagcatcaaggaaaaaccactcatgcagggtctaagataaacatcagaacaatgcagcaattataggtcattcaattaatatattgaygtgactttcagttgctcaaaaatagtacagtttttttctgttaagtgaaaagattattttgctttttcaagcaccatattagaatgattttggtgtgaat

SEQ ID NO: 21675 - DNA, 201 bp, Homo sapiens
tctttcttgtgcattgtagaatgtctaacagtatccctggcctctatccactagatgtctgtagcattgcccagtcgtgacaatccaaaatgtctctggasgttgtcaaatgtcctccaggagccaaatcatccagttgagaaccactgatttaggggactgaacaggtgcaaggattttcttggtggggaaacaagggaa

SEQ ID NO: 21676 - DNA, 201 bp, Homo sapiens
aaatcaaagtccaaataaaatctttatgttcaagttagttgatatgtctcataagcctttcaatttgtggggtttccttctatttctgttctttacccctwgcaatttacttgttaaaaaaaaaaaacccaggtcacttgtcctggagtttcccacagtctggcttgtgttcattgtgtcccctgatgtcctttaacacat

SEQ ID NO: 21677 - DNA, 201 bp, Homo sapiens
tggattgatctgtaaccttgagtcattctcctctctcgtgtctcttatgaattctaagttgaaagcctgatgctagggaagttgaaagtgtgagtagttcrgtgaaaacaaaacaaaagaaaacaacagaggtaacaacgtacttaagcccccctgtactggggcctctggaaggacactaagagcatgactctgttttga

SEQ ID NO: 21678 - DNA, 201 bp, Homo sapiens
cagtatgaggtcattgaaagagttgataaggccactggggccaacaaaatagtcttgagagataatgttccaaatctgaggggtcttcaagtttatcacaracgcagtaagtatttgtcactgaaatacattcatgggtgtataatgcatattcacacataactcacatttgtaagcacacacccacacacagtttcacgt

SEQ ID NO: 21679 - DNA, 201 bp, Homo sapiens
gggctccatcctgctgagtttgaggccttaggacattggattggagctgttcagggggcagttggctctcaggaggaaactcaggaggcactcaggaggamacacacacatcacacacacacacacacacacacaagaaacagtagtgttataaagttatacatatcttttccacatgaaagttattttggtttctatgtt

SEQ ID NO: 21680 - DNA, 201 bp, Homo sapiens
cctctctcgtgtctcttatgaattctaagttgaaagcctgatgctagggaagttgaaagtgtgagtagttcagtgaaaacaaaacaaaagaaaacaacagrggtaacaacgtacttaagcccccctgtactggggcctctggaaggacactaagagcatgactctgttttgattttaatgtggaggttttccacttactgg

SEQ ID NO: 21681 - DNA, 201 bp, Homo sapiens
tgcacaacaggaaccatggcaggaatatacactttcccatagcaaatagcatacctgactctctgtgctaatattgcacatttgttaaacaatgaatgaadggatggatggatggatggatgaatgaatgaaacatatactactgattattttattccagagttctcaaaatatttgttgctgatattttgagtgctgact

SEQ ID NO: 21682 - DNA, 201 bp, Homo sapiens
ttttgctctttaccctcatgttctgaaacctctctctctctctctgagtttagttgtttctttttgctcgaatatatactccacttttatagcgtccccartgcttagaatggtgtttggtttacagtgaatacctaccatttttctggtgaatgaatggattaataatctattaataacatggtatgtgtaataaaaatg

SEQ ID NO: 21683 - DNA, 201 bp, Homo sapiens
aattttttttcgtcaacctttccaaataatttcatgctactagtgaagattgctgagaagcatgaattctggggaactacagtcacaatgagcacagccartgcttgcctgtcttctcagctccccatttgagtgcaggcatgctgctgtgagttgagtttctgggaataagaatgtagcctggtaccatgaaacaggtgg

SEQ ID NO: 21684 - DNA, 201 bp, Homo sapiens
tctcttctcccactcgctgttgccacattggatttcattatggtccaaaagcacagcaggcgactcctgcctctcagcttctgcgctagctcttccctctrcctggaacatctctcttccagatctctgcatgagttgcttcgcgtgctatttaggattctacccaaatgtcactttctcagagaggccctcattgaccgc

SEQ ID NO: 21685 - DNA, 201 bp, Homo sapiens
actttaaaagtataagctatggttctcaagaaattgatgatctatctaggaatataggaaaaggaatagagtaaataagcttataaagatgaaatgccaargtaacttatgggagaaaaaaagggaagaaatatatttcaccttttaaacatagattactaccactgtttttcttaacttgttgatttcacaaggagaaaa

SEQ ID NO: 21686 - DNA, 201 bp, Homo sapiens
gccagcacgagttgtcctaaagtgcatggtatgggtgtctaggtgaaagacttggcatccgtactgttctttctggtgggagagggagataagtcacttartcttcacttaatcctctctcctcaaaactctccaattgtttctcacacccttcagcatgtggctgctgctatttccctgctctcttctcccactcgctgt

SEQ ID NO: 21687 - DNA, 201 bp, Homo sapiens
gggagaaggatattgaacaagaacacaaaggacataaacatagttggccagctactgctggggtgaaaactaataaattcatgagtattctgagaaaattrctagagaaagctgaatgacaagatttagtggaaactcaagatgggggaggtgggtcccaagcagcatttaaagtagggtacagatttgttgaactgtagg

SEQ ID NO: 21688 - DNA, 201 bp, Homo sapiens
gccataaaaaagaatgagttcatgtcctttgcagggatatggatgaagctggaaaccatcattttcagcaaactaacacaagaacagaaaaccaaacactkcatgttgtcactcataagtgagagttgaacaatgagaacacatggacacagggaggggaacatcacacaccggggcctgtcagtgggtgggggcaagggg

SEQ ID NO: 21689 - DNA, 201 bp, Homo sapiens
aaagtttggcttttgattggatttcaaagaatctctattggacagactctcattacaagagtatcagtgtcatgaggctagctgataaaacgagacgcacrgtagttcagtatttaaataacccacggtcggtggtagttcatccttttgccgggtaagtgtgttcatgttttcctaagagcttgaaactgtatgtctttt

SEQ ID NO: 21690 - DNA, 201 bp, Homo sapiens
acaaaatatacttagcttaaaatatgtccatattttaacttataggaagagaaattctcgcagctaacagggtggaaaatgttgaaagtttggcttttgaytggatttcaaagaatctctattggacagactctcattacaagagtatcagtgtcatgaggctagctgataaaacgagacgcacagtagttcagtatttaa

SEQ ID NO: 21691 - DNA, 201 bp, Homo sapiens
attttaagagcacattgatttattagcttggcaatacaatttttgaaatgtcatataattaaaaattaagtttctaattactgcatgcagtaatagtccayagaggggccagtttgatgtaactttgataactcatgattatacaacaaaaaagctggatttttctgcttcagttttatgttgtttattagagctcccttt

SEQ ID NO: 21692 - DNA, 201 bp, Homo sapiens
tctaagttaaaaaagcacaatacgcagttcaccgattccacagaaacaaaaagtagtgaggatgtaaagcagtcacttcaaatcccaacttcttagtcaartgcttctctaaagcctgagtgacaagctgtgttttgtagtccaaatggttgtgcctactggtaggtgttcaggtcagagaggagtgaaaaggcagctgtg

SEQ ID NO: 21693 - DNA, 201 bp, Homo sapiens
agctttaatttagtgatatttctcaatccatctcccagaatttcagtttcttggctcctgatagttacatttcctctgcctcttacaactttattttgtarttcttggtccttaattaatagagatattattcgttgcatgcaaacactataacattttgtaatgttgccaactaagcaaatggatagagctttttcttaa

SEQ ID NO: 21694 - DNA, 201 bp, Homo sapiens
gagaattggcagcagcattttcctactcacctggtattgttgattacaacagggctgtgggagaagagctgtctgcagggctgctttagtacaaggcactsgtgatgagcagaaagactgggatggattcggaaagaagatgactgtgttgcgaaaactctaacatggagcaagataaatggatgtctttaaaaagcattt

SEQ ID NO: 21695 - DNA, 201 bp, Homo sapiens
cccctcctcccacccctaacctgggccggtttgcatggtgtgggcactctgctgagtacagctgactaacacctgcatggctttcccttcctgcagccatygaactgcctatcaacctgccccccccatgcaggtgcatgcacggaggaaattgctattttgatgagactgacctccccaaatgcaagtaagtctgaatgt

SEQ ID NO: 21696 - DNA, 201 bp, Homo sapiens
atgtgactgcctgtggactgatcaattactgatgctttggtgtctttagttgaagtttcaaggtgggcctacattaaactcttgattttaactgggttcayggaggagaattctgaaaacttcaaatgagaatgtgaatattttaagagattattttaccactaggttcttgtaactattaatatatgtgctccagagtct

SEQ ID NO: 21697 - DNA, 201 bp, Homo sapiens
aatcatcttgttattttttatagtttgattatttaaatcaaagtccaaataaaatctttatgttcaagttagttgatatgtctcataagcctttcaatttrtggggtttccttctatttctgttctttacccctagcaatttacttgttaaaaaaaaaaaacccaggtcacttgtcctggagtttcccacagtctggcttg

SEQ ID NO: 21698 - DNA, 201 bp, Homo sapiens
gggaggccggaggggagagcgtccgggcaggggctagggccgggcggcggcgcgggagctgctcccggtggggcgctcaggttgcttcgcgaagccggagsgggagcgcccctcttcgctcgccaggaactgagcggcagcaaacttgagaaagcagccccgccagtttcggtgacagcgcaccccacggagaccctgtct

SEQ ID NO: 21699 - DNA, 201 bp, Homo sapiens
aacaaacctggatggtatagcctactgcacacctagggtaaacagtatataccctaggcatatactgttgctcctaggctacaaacctgaacaccatgttyccgtgctaaatactacaggcaattggaacacaatgttaagtatttatgtagctaaacatatgtaaacatagaaaaggtacagcaaaaatatggtattata

SEQ ID NO: 21700 - DNA, 201 bp, Homo sapiens
ccctggcatcctgtcacagtctcctctttgctgttaaacatcacttcttcttacctatttcctttatccctccccttccttccctgctttcactcctttayatctttatatttctgattgctgttaattatcttggtatctactgtaaggttcttggtgtagatctctatgcagaagttaaaccaacttgaggattgttac

SEQ ID NO: 21701 - DNA, 201 bp, Homo sapiens
ttttggctcaagtgatcctcctacctcagccttccaaatagctacgactacagctacttggaagtgagccactgtgcccagctaaatttattttttttttyttttaagatataaggatctcactatgttgcccaggctagtcttgaattcttggcctcaagtgatcttcttgcctcaatctcccatagctgggattaaagg

SEQ ID NO: 21702 - DNA, 201 bp, Homo sapiens
gtttcctacacatctattcacacttaagccatcgcctgggccccagctaatgatgaaatgcactcctacaatatttgtttttcttattttcacttctacawttctcctttctgtgcctgtgacaaattcttgctctccagatgttgcggtttctagcgtcgtatataaattatcttattctaacccagacacatttgttaa

SEQ ID NO: 21703 - DNA, 201 bp, Homo sapiens
ataattacacatttctaattgcaatttaaccctgtgcatttttccttccagctaccaatccgtgtaaagataacaatgggggctgtgagcaggtctgtgtyctcagccacagaacagataatgatggtttgggtttccgttgcaagtgcacattcggcttccaactggatacagatgagcgccactgcattggtaagaagt

SEQ ID NO: 21704 - DNA, 201 bp, Homo sapiens
gtactggggcctctggaaggacactaagagcatgactctgttttgattttaatgtggaggttttccacttactggtgctttcttctctttctcatgcagcygtgaatccatgtgccttttcccgctgcagccatctctgcctgctttcctcacaggggcctcatttttactcctgtgtttgtccttcaggatggagtctgt

SEQ ID NO: 21705 - DNA, 201 bp, Homo sapiens
tgtggatgtatccagtagtaaccagtagtaatgttttcaacacgttgctaatccattactctatttcacctataggtgaaaagggctagaagtggcttcaygtcttggataattacacatttctaattgcaatttaaccctgtgcatttttccttccagctaccaatccgtgtaaagataacaatgggggctgtgagcagg

SEQ ID NO: 21706 - DNA, 201 bp, Homo sapiens
cagatttgctctaaaactcatgttaagtgatggatctatttaggatgaagaaagactgcaaagtaatgaggttaacttaacaaaagcccaaccactagaamtgacacattcagatgaatctccttcaatgtcatcatcctgggaaagtataaacttgtctaaaaatagatattttatctgaaaacatttttggaaatatct

SEQ ID NO: 21707 - DNA, 201 bp, Homo sapiens
ttgtttcctcttgtatttccattttgtaaggataatatcacagtttgccattggattatatatccttgggacaatctctgcttggttaaatgaagtattgkgtattaatatggtgacttcctatcactgaaactggcttccataaggagaatatgaataaattttatgaaaaaattagctaacccaataagtcacataaaa

SEQ ID NO: 21708 - DNA, 201 bp, Homo sapiens
ctgagggcctcagaaaacagaaatatttaagacatgattcctgctgtccagaagcctacaacctattaaatagtaaggaagataaccaaagtacaaaaatraatacagtaaaaggaagaatgtaagcatagtttactctagactagtatttagaaacacagttaaatataacccaagaaagagtctattttaagtactcat

SEQ ID NO: 21709 - DNA, 201 bp, Homo sapiens
tacaatatgagaggttctttccggtgctcgtgtgatacaggctacatgttagaaagtgatgggaggacttgcaaagttacaggtaattgctgaactaaccygagccagtttatcagcacatcccagagcttaaaatcaaatggcacatgtaggtatttgacaatgttgattaggagttagatcgacttgaatcctggaaag

SEQ ID NO: 21710 - DNA, 201 bp, Homo sapiens
ggtatatacccaaaggaatataaatcattctactataaagacacatgcactcatatgttattgcagcactatttacaatagcaaagacttggaactaacamaaatgcccattaatgatagacatatacatcatggactactatgcagccataaaaaagaatgagttcatgtcctttgcagggatatggatgaagctggaaa

SEQ ID NO: 21711 - DNA, 201 bp, Homo sapiens
tgttttcacttttagtttttcttaggacttcccactttagtaggtttaaacttttgaggctctactccatataaagatattttactggtttcttttaagtktcagtagagaagtcatatcatggtgtagaaatggtatggagctgtgtttagtattgactctgatgaattcattctttgtgctattatgtgttgaatatct

SEQ ID NO: 21712 - DNA, 201 bp, Homo sapiens
cacacattttccctaactcagacaaactgggggaaagtatcctcaaaggaatgtggtattgaacatacagtaaaattgagtagacattgccatataatgtrtaattaacaaatcaagtggttgtataaatggacacttcaaatagtctcttagatgggctaaatatttcttagatatttttgttttcacttttagtttttc

SEQ ID NO: 21713 - DNA, 201 bp, Homo sapiens
gtggggataaatgtattggcgtcacaaatcgttgtgatggtgtttttgattgcagtgacaactcggatgaagcaggctgtcgtaagtaacacatacccagmatgtttcagacaaaggggtcatttcatttttgccagtattgatattgatattgccacacattttccctaactcagacaaactgggggaaagtatcctcaa

SEQ ID NO: 21714 - DNA, 201 bp, Homo sapiens
gtactgcttctcaattcaagtgtgccagtggggataaatgtattggcgtcacaaatcgttgtgatggtgtttttgattgcagtgacaactcggatgaagcrggctgtcgtaagtaacacatacccagaatgtttcagacaaaggggtcatttcatttttgccagtattgatattgatattgccacacattttccctaactc

SEQ ID NO: 21715 - DNA, 201 bp, Homo sapiens
ccccaatcatcgatgtattgacctatcgtttgtctgtgatggtgacaaggattgtgttgatggatctgatgaggttggttgtggtaagtgcattgccttcktttttattcacaatgtttatttagaaaaatctcagtgttaacacatggacacagggaggggaacatcacacaccggggcctgttggggggtggggagcta

SEQ ID NO: 21716 - DNA, 201 bp, Homo sapiens
attgccccaatcatcgatgtattgacctatcgtttgtctgtgatggtgacaaggattgtgttgatggatctgatgaggttggttgtggtaagtgcattgcyttcttttttattcacaatgtttatttagaaaaatctcagtgttaacacatggacacagggaggggaacatcacacaccggggcctgttggggggtgggga

SEQ ID NO: 21717 - DNA, 201 bp, Homo sapiens
agacttttaaatccagttttgggggtctgtctacacactgttgctactaggcatgtgggtcatgctggttttgttgcctgattgggctccattgcttggckttggtctagagtcatggacttcatagtattcatgaaatgtagtccaagtccaagcacatgatgctcactttctgaatgtggtctattttccaaggtgtaa

SEQ ID NO: 21718 - DNA, 201 bp, Homo sapiens
gagtagaggtgggctttaaagaaaataaataaaagcttgggctatttatatgggaaaaatatcttttagaatttcagattcttaacatgcactttgaaggyttttaggaagctaagcaagaaatttcattcataatgttatggatggtttctggccttgatttagactatcttcaacaatttttttccttgacattggctg

SEQ ID NO: 21719 - DNA, 201 bp, Homo sapiens
tgtattggttaactcctggctctccattttagaaagctctactggttggatgcccgcctggatggcctctttgtctctgacctcaatggtggacaccgccrcatgctggcccagcactgtgtggatgccaacaacaccttctgctttgataatcccagaggacttgcccttcaccctcaatatgggtattgtctccctgca

SEQ ID NO: 21720 - DNA, 201 bp, Homo sapiens
ctcccttgcacgtacctcgcccctagctgaagtccagttctttatagtatgtgcatagttccctatagggtaatgtttattaatttccccaccaacgtttktttttcttcaagataaattaattccatttgtcatttcttacttgtcatttcagagccatttctttcatggtttagtgatttcagtgtttttctttgaaag

SEQ ID NO: 21721 - DNA, 201 bp, Homo sapiens
ctcggcctcccaaagtattgggattacagatgtgagccactacacctggctgaatatggcatattttttttcatctttttactctgattagagctaactayaacttaatgtaaaaaaaattattttagatcctctccttttggtattttcaaaaattgggtaaaacatgttcttcaaattttgacccaaaatattattctt

SEQ ID NO: 21722 - DNA, 201 bp, Homo sapiens
ctcggcctcccaaagtgctggtattatgggtatgagccaccacgcccagcctgaaagtttcagtgtggtataggtggctttcttgcctccacttcttcackctgaccttgcttttatgtccatgctgttgcctgcaatgcaaatgacctctcttattgttgccacctctccacttatgttttttggaaagagtaaagttag

SEQ ID NO: 21723 - DNA, 201 bp, Homo sapiens
agagaagttttttttggctcaagtgatcctcctacctcagccttccaaatagctacgactacagctacttggaagtgagccactgtgcccagctaaatttwttttttttttcttttaagatataaggatctcactatgttgcccaggctagtcttgaattcttggcctcaagtgatcttcttgcctcaatctcccatagct

SEQ ID NO: 21724 - DNA, 201 bp, Homo sapiens
tcctgattatattaacttacttccctttctaacgcatgttctgtgttatgactcttacaaatatgttagagtacacatggaaatagaaggcatttgcatcyccaggcatgtgaactgtcttagggtggctttaggcattttcattttggccctgaaagtaaggcatgacgatatgttaccggatctgtgtactctaatatt

SEQ ID NO: 21725 - DNA, 201 bp, Homo sapiens
atgagcttttaattgcttcttcgtaagccctttgaaaacctaagcacaacatttagaattatttgggcttgacgtaaagaagaaagccaaggtaattgaaygagcactgatacctgacccaggttcttttcatattttgtttgagacaacccatgacttgccttctcgggaataaaagaaagttctttaattttatgtgaa

SEQ ID NO: 21726 - DNA, 201 bp, Homo sapiens
tctaacttttaactagtaggtgatccggatacatcaccttgctttttgtgcttcagttttgttttcatttgtaaaatagatgcccagtgtaattaccaagrcaaacataaagagtaaatggcacgtgtatgtgaaaggctcttgaatggtttagtgggatataggacgaattgtgtattttttgccgctcttttgcacaat

SEQ ID NO: 21727 - DNA, 201 bp, Homo sapiens
tcagtaacctggaaaaaacctttaaattctaatttctttggaatcagactggaaaagactgttttaataggtctaacaataattttattttatttattttwattttattattatttttagagtcagggtctcactctctcacccaggctggagtgcagtggtgcgatcacagctcactgcagcctcaaacaccggggctca

SEQ ID NO: 21728 - DNA, 201 bp, Homo sapiens
ctgggaattaattggattttactctgctcttatatatttcaaatttcaaggagaaattctttgtattgtatttttacctggtatacaaagatacttaaacrgcaatatttgaatgtagaatatggctttcttttttttttttttttttgagatggagtctcactctgtcacccaggctgaagtgcagtgatgcgatctcgg

SEQ ID NO: 21729 - DNA, 201 bp, Homo sapiens
attacattgaaactgtaacttatgatggaattcaaaggtaagaagtattttttatggcttatggctttataagttgcagggaaagtgcataaaatggctgsagagaaatatcaaaggaccagaattaaaatattgctttgttggtggacatgatagctttaatgacctttgtactgacatttgcatgaagtgacctgctct

SEQ ID NO: 21730 - DNA, 201 bp, Homo sapiens
agaggagaaagttcagaaggtgaatatgaattttttttttttgagacaggttcttgctctgttgcccaggctggagtgcagcagcacaatcacagcatgcygcagacttgaacttctgggctcaagcaatcctcccacctcagcttcctgagtagctgagactatgggcaagtgccatcatgcccagctaatcttttaatt

SEQ ID NO: 21731 - DNA, 201 bp, Homo sapiens; identical to SEQ ID NO: 3736

SEQ ID NO: 21732 - DNA, 201 bp, Homo sapiens; identical to SEQ ID NO: 3737

SEQ ID NO: 21733 - DNA, 201 bp, Homo sapiens
cagagcattactagggagtaacaagtcgtggaaaatggttagagaaacatattacagatatttatgggggagatgatcgtacttgcaagaagcatttcaarcctattgcattttctcaagtgatttatttataagttagctgtgactgaaaatactaatctacccatgtttcttttcagagcatttattttttactgactg

SEQ ID NO: 21734 - DNA, 201 bp, Homo sapiens
ccagagtgaatttgtacattccttaggggcatttttgcaagggaggttgttgtgttttaaaggtagttgataagagacctgcaccaccaaccccagacctrcaccaccaaccaccatcatgcattagtctatagaaggtatttgggtgtacgtactcctgtaccactcggtaccaccatttagccaagcgaagtttctgac

SEQ ID NO: 21735 - DNA, 201 bp, Homo sapiens
tacttcagtgactgctgccacagccaccatagggagagcttgaacaagaaagaaaatagtagcgatgaagcggatcttggcaactgcggcatccctggacrttgagggggtttggttcagtaacctggaaaaaacctttaaattctaatttctttggaatcagactggaaaagactgttttaataggtctaacaataattt

SEQ ID NO: 21736 - DNA, 201 bp, Homo sapiens
gaatgtctctgttgccttttatttgttcatttttatttacgcagtgttccttgctcatttttgaagtaattcaaaatgacactcacggtaagcttgcaagrctgcctttcctttactataacggagaaaaaattctggaaagaaggcagctctttcagtatagtcatataagaacaaaatttccccaaacttggcttgtgg

SEQ ID NO: 21737 - DNA, 201 bp, Homo sapiens
aaacagaggagaaagttcagaaggtgaatatgaattttttttttttgagacaggttcttgctctgttgcccaggctggagtgcagcagcacaatcacagcrtgctgcagacttgaacttctgggctcaagcaatcctcccacctcagcttcctgagtagctgagactatgggcaagtgccatcatgcccagctaatctttt

SEQ ID NO: 21738 - DNA, 201 bp, Homo sapiens
aagaagttacacacaatgggatgattctttataaatgtggagcagggccttaaatcataagggaacctatgccagcaatctcattcaggggttggatgatrttgaaagtacggatgtactgaagaattatgaatataccccagcaatttggaagtgagataggttcccaatctttaattttgattatgttatgctcaagaa

SEQ ID NO: 21739 - DNA, 201 bp, Homo sapiens
tgattgaaagcagcttacttttaggactagtttattatggcaccactgccttctaggtgctctgctgtagccagcacgagttgtcctaaagtgcatggtaygggtgtctaggtgaaagacttggcatccgtactgttctttctggtgggagagggagataagtcacttaatcttcacttaatcctctctcctcaaaactct

SEQ ID NO: 21740 - DNA, 201 bp, Homo sapiens
tcctctgggcttactgagttcattttgattaaacaataaaagcaaaaaggcaagggcagtgtatctggggtaaaggaataagtgaacagctatgccaacarctcttcagagattgttacctgtattatattttattgacctgtaaaaataataacaataacaacaatatcaatgacgatagtgatagcaagtaacattaca

SEQ ID NO: 21741 - DNA, 201 bp, Homo sapiens
atttttaacaattcaatgtgtttatttttgcataggtaacatatttatatgttcacaaattttaaattataagaagatatgtagtgaaatgccttcctccrtaactattcccctctgcatggttttcaccttctctttcctatgagtaattgccgtttctttattttagttctagagattttttaatgaataaacaagaac

SEQ ID NO: 21742 - DNA, 201 bp, Homo sapiens
cctaatatttggttcagtgaagtgttgaaagaatttgctaagtaatcattgaaagctaagattctagtgaaaaacaaaatgcatggtttaaaaattgaacrtactaactgaaagacagtggaagttagatgcttcttgctgtaaataattaaacccaacagtgcagacgagagaacatggcaccaagagggacttgggcta

SEQ ID NO: 21743 - DNA, 201 bp, Homo sapiens
cagtgttcttgcaaaatttagggatatttccaaatggacatgctaaatttggattaacaattttttgaatgcactaactctgggtaatttgttggaatcartgtaagagtatgaaaagtagagagtagtacagagtagtagagaaaagtcatggagaaaatctgcaaaaaatagatgagggctccaaagcattttgtcgct

SEQ ID NO: 21744 - DNA, 201 bp, Homo sapiens
agacgaagagggcccctgactgctgaaaaggacccatggccacttgtctcctgggcatagtctccctcatctcagtccccattcttttgaggactccatamgtaacaaataggttggaggcaggagaatgatggaattccacacatagatgagtagagaagttgggaaataagccacaataaaagtgactaaattatttga

SEQ ID NO: 21745 - DNA, 201 bp, Homo sapiens
ggcagggctttatcattacaaatcagggatggctcctactgcctagaaaaattggtcaacattaatttcatactttgattattaaggaccaatttgtcgaytaatggtgaccattattaatattttttaattgattgattgtttactttgcctaggctatcatgtcacccacctttaattgtggaataaatgctatgccta

SEQ ID NO: 21746 - DNA, 201 bp, Homo sapiens
ctgtgccactgtgaagaagggtatatcttggagcgtggacagtattgcaaagctaatgattcctgtgagtaaattatggacacctgtgtctctgaacagtraacagattctaatagcttctttccttccttctgatgacaacagaattatcagcatttttgttgttggcagggctttatcattacaaatcagggatggctc

SEQ ID NO: 21747 - DNA, 201 bp, Homo sapiens
ttctgtaaagttatccttcatgtaggtttaaaaaatgatgtaaatgttctttttccttacatgaagatggttgttataaattctcagaacctgtgcctaaytccagagggtgtttatttagacatgggcaacaccacattcttggccatcttatctaggatttttgtcagagagtgcttaataaatgctgataaccttgac

SEQ ID NO: 21748 - DNA, 201 bp, Homo sapiens
tatgttttttaaaaattctagttttaaaaaatttgaaaaatacgataatgtagtaaacttcaaatctaattaattataaaatgactttcacattcattttktcatttagttttctcactaatcttctgaggtcggtttcagattagtaaattgagactcggagaagttaagtcatttattaaagttcttacagttggtaag

SEQ ID NO: 21749 - DNA, 201 bp, Homo sapiens
acttgaaatgtggcaagtgactaggaaagcaaattattacttttattttattttaattaatctaaagatacatttagatagccacagggggttagtggctrccatgttggaaagcatagtattgaagggaaacatttacaccaaaatttatatatttgtagactaacattaataaatgaaatgcagtaccatagggctatg

SEQ ID NO: 21750 - DNA, 201 bp, Homo sapiens
agtgatgagatggaaagtgtctgtggtgagttggactcttggcgcttttggtaggagctaatggcatcttgatgtcaagtgtttggtatggaatcctgctrtgtgtgaatgtgtttgaaatgtgtgcctaggcatcctggtagagctgaaaaatgtttcctctgataatccagactgtttctgttaaatcacctctgtagt

SEQ ID NO: 21751 - DNA, 201 bp, Homo sapiens
tataaaaattagttaattgcaacatttccccatcagtttcatttttcatatgtgtgattttaaataattgactttgaagtgttttataaaatgacttttgrgtctctattttgtgttcttttcatgatgtgtttaacttggtattttagtttggcaaaaacaaacaaatccccccaccccactcctcaaaaatgggacttg

SEQ ID NO: 21752 - DNA, 201 bp, Homo sapiens
taagagaaacaatatgtaaaaatcccttagcatgaggcatggtgcaagctaagtctagcttagcttgggactaaggaaacgtatcattttaccaattttcrtagcacaaaggtcattatttcaaaaattttatgaaaataacttccaatcctcagcttccatctgaatagagtgaataaaacacagtggactttctcaggg

SEQ ID NO: 21753 - DNA, 201 bp, Homo sapiens
atgaattatagatctgttgataaattgagtaaattggatttgatatattagataatggagtgaggagatcaagtgtgaaaatcactacctataaaaattasttaattgcaacatttccccatcagtttcatttttcatatgtgtgattttaaataattgactttgaagtgttttataaaatgacttttgagtctctatttt

SEQ ID NO: 21754 - DNA, 201 bp, Homo sapiens
gattactcagatttgagtctttatggatcacttgaatcaatgcaaactgtttatacatcattattgctgatccatcaacaataaccatcatccatgataaycatccatgatggttatcgttgatgatgtggttgccaaagagactttataaatgtatgtgggtaaaaccagtcttgacatttgcctgtagagattaagtcc

SEQ ID NO: 21755 - DNA, 201 bp, Homo sapiens
gacattcatgggtcttgttcctgatgaatgaaggaaaaatgggcacagacgaagagggcccctgactgctgaaaaggacccatggccacttgtctcctggrcatagtctccctcatctcagtccccattcttttgaggactccatacgtaacaaataggttggaggcaggagaatgatggaattccacacatagatgagta

SEQ ID NO: 21756 - DNA, 201 bp, Homo sapiens
tgagaggtcacccagcaatgataaagtatcagtttgttttttctggagagatatttccaaacaatagtcgtttgggagttataaacaggcatcgaagttamtactgaaaaggtgaatttgacaaatgaattatagatctgttgataaattgagtaaattggatttgatatattagataatggagtgaggagatcaagtgtg

SEQ ID NO: 21757 - DNA, 201 bp, Homo sapiens
aacagccttgatcaaacaaaaggccctctttgaagaggggagtggtttctccactcagggaggcagcatggattgtggtggaaagaacatcacatgtcaaktcaggacattcatgggtcttgttcctgatgaatgaaggaaaaatgggcacagacgaagagggcccctgactgctgaaaaggacccatggccacttgtctc

SEQ ID NO: 21758 - DNA, 201 bp, Homo sapiens
ttacataaatgattatttgcaagattacttcttggctaaaactggattggttgaatgtggcagttttgagactattttctgaacaaagttttaaagctggytctatgtagattttttttttctccctgtgggtggctccaatgtatgaaatcatccccttagctttttttttttttaaatcttcaaataaataacaaaatg

SEQ ID NO: 21759 - DNA, 201 bp, Homo sapiens
atttgcctgtagagattaagtccagtgctgtccatgccatggatgattcatgccattggaaactgactgggctctgacaactgcccttaagacatagtccrttcaactttcagacaggtcaaggccactatacatcttgatgaataaagaagagcaggctataatggcaagagccaaaggagaaatagcaggaagcttccc

SEQ ID NO: 21760 - DNA, 201 bp, Homo sapiens
atgtaaatgtgtatcttcactctgtcatattgtaaccactagtcatatgtggctattgagcacttgaaatgtggcaagtgactaggaaagcaaattattamttttattttattttaattaatctaaagatacatttagatagccacagggggttagtggctaccatgttggaaagcatagtattgaagggaaacatttaca

SEQ ID NO: 21761 - DNA, 201 bp, Homo sapiens
ctgaagccttatagtctttaagaaagactcttctaatattttgttgtgttctcccctccatattctattgtttatgtcaattatattggaactatttttamacagtagaactgggacttctctggtaatgaacagagctctgtcatgtaagggacttcaatgaacacttactaaatgagtgaataataagttaaccaataa

SEQ ID NO: 21762 - DNA, 201 bp, Homo sapiens
aggaattgaaaaagtgaaaatccctcagctatctatttatatatttaaaacaatactaaaagtcatatagatatatccagacctttggctattgatgtttmtttttcatttggtacaagcaaaaagacatcaaaataaagaggcacagaaaatttaaatttcctttgatcttatccacctgttttccatcttgccagttct

SEQ ID NO: 21763 - DNA, 201 bp, Homo sapiens
tgagacaggaaaattgcttgaacccgggaagcagaggttgcagtgagctgagattgcctcactgcactccagcctaggtgacagagtgagactccatctcaaaaaaaaaaaaaatttttttcaagcaaaaatttataacttaacttggccaggcacattgtctcacatctgtaatcctagcactttgggaggctgaggttg

SEQ ID NO: 21764 - DNA, 201 bp, Homo sapiens
ttgcttgaacccgggaagcagaggttgcagtgagctgagattgcctcactgcactccagcctaggtgacagagtgagactccatctcaaaaaaaaaaaaawtttttttcaagcaaaaatttataacttaacttggccaggcacattgtctcacatctgtaatcctagcactttgggaggctgaggttggtggatcgcttga

SEQ ID NO: 21765 - DNA, 201 bp, Homo sapiens
taatttttaaattttttgtagagacacgatcttgttacgtttcccaggctggtctggaatcctgggctaaagtgatcctcctgccttggcctcccaaaatkttgggattataggcatgacccccccatgactggcctgaaaataattttagatgagaagtaatgttgggtaaatataagatggcgacctatgagcaatttg

SEQ ID NO: 21766 - DNA, 201 bp, Homo sapiens
ccaggctggagtgcagtggcattatcacgctcactgcagcctcccacttcagcctcccgaatagctgggactacaggcacgtgcctccatgcctggctaatttttttttttttttttttaattcttagtacacataaacccttgccatattgcccaggctagtctcaaacccttggactcaagcaatcctcccaccttacc

SEQ ID NO: 21767 - DNA, 201 bp, Homo sapiens
agtctcaccattctcatgactttagtgaccctctgtggcctgatgagacttaaatctgtgtttacaacccagatttttgcccacacttgagtcttgtatastcaactacctttggacctctgcaagttgccttgaactcaaggtgtcccaactgaaaataatcatcttccctcctgaactggattttccttctatatttgc

SEQ ID NO: 21768 - DNA, 201 bp, Homo sapiens
acttaaatctgtgtttacaacccagatttttgcccacacttgagtcttgtatactcaactacctttggacctctgcaagttgccttgaactcaaggtgtcmcaactgaaaataatcatcttccctcctgaactggattttccttctatatttgctagtctacatattttatctttattaatagaaatagcatttaacccac

SEQ ID NO: 21769 - DNA, 201 bp, Homo sapiens
gtgagaattcccctgtacatacagaatgggtcattctgctatttttaggacagatttgatacagtagcttttacaaaaagataagccaaagtttttagacwtcgtgttagtggactgtcattctgtatttaaacagaacacaaaagaaagctgtctgagaccatgacacagtgaaaacagccttgatcaaacaaaaggccc

SEQ ID NO: 21770 - DNA, 201 bp, Homo sapiens
catttaccctatccaccctatccactgacatgggtggttttcagctacacatacatggattgtggtgtatgcatttctctcacctgtctttaccaacatcwtcttctttcttttgtttcctattcacctgcaatgagtctggataaaacccctgttcttttattttgtggacactaatgatttgatgtcagcatctcacct

SEQ ID NO: 21771 - DNA, 201 bp, Homo sapiens
agccccagctcttcacctagttctatgactttgagacatccagttaaccatctttgagcttcagttttctcatctatacaaatggtgtaaaaatacctatytcacattgtgcttgtgtgattatactttgtaaactaaaaaaagttaccaaaatataaggcattcggtatccagttaacaaaatggtagtggttttctgaa

SEQ ID NO: 21772 - DNA, 201 bp, Homo sapiens
atggctccccagtgaatacctcggtggtaatcaagaataacattgaataatcctgacacgaaatcttgtgtctttctaccattcatctgcctctggtagtsttgacctggcagtggaagctctgaggcatgctgaagcagtttactgggctcattgtttctgattgacaggacatgctgtttgttgacagaatgacatcgt

SEQ ID NO: 21773 - DNA, 201 bp, Homo sapiens
gaatcagactgcctcagtgtaaatctgtgctccactacctactagctgtgagatttgttcaagccttgtcgtcctcatctatgaaatggggccattgatamcatctcacaaagctgttgtgaggatatgtaaggtaatgcatgggaagcacttaaaatattgctggcaagttctgggtgaacaaatgctgtcatttgcttt

SEQ ID NO: 21774 - DNA, 201 bp, Homo sapiens
ctcagtattacatcagcttttctctctttttcctttatcaactcccaaagaggagttggggctgagctgtcttacagttgaaacttgataggccatgaagkcctttcaggaaaagtgatttgttctttcagaatcgctaattcagtcttgtgatgccccacaagctgttctcagttttttgttccacgctagagcccagat

SEQ ID NO: 21775 - DNA, 201 bp, Homo sapiens
tgacattgccattacttttatttaccatggaaatttcaaacctaggatataataacagcacatctgaattatatcatttcagcatttggctgctacctctktgaccctcacatgagtctccgtttcctcagctgacaaatggagtacagaccagatagtgccttcgatcctcttaccgctaccactctgattgaaagcagc

SEQ ID NO: 21776 - DNA, 201 bp, Homo sapiens
ctgctttgaccaggacagttctgcaagatgagtaattgtcccaccccaaatggcgatagcgtcctctgaagaacctctgagaagtgtggctttgcttatamtgttctgtagtgctgatggactgcctgattgtagaggtgagaggtgcataatgaaaaaacaagtgggatgtaagagccttgggggagaaagacaggtgac

SEQ ID NO: 21777 - DNA, 201 bp, Homo sapiens
tctcttagtagaaaagaagttccaatagaaataccagaagccacattctcagtattacatcagcttttctctctttttcctttatcaactcccaaagaggmgttggggctgagctgtcttacagttgaaacttgataggccatgaagtcctttcaggaaaagtgatttgttctttcagaatcgctaattcagtcttgtgat

SEQ ID NO: 21778 - DNA, 201 bp, Homo sapiens
tactggtgttccacaggtgggggtcagggatgatgtacatactgctttgaccaggacagttctgcaagatgagtaattgtcccaccccaaatggcgatagygtcctctgaagaacctctgagaagtgtggctttgcttataatgttctgtagtgctgatggactgcctgattgtagaggtgagaggtgcataatgaaaaaa

SEQ ID NO: 21779 - DNA, 201 bp, Homo sapiens
cacaaagatagacccatgcatgacctgatttttttttcataaataagacttttaatgacttatacttgcacatagttataactttaaaaaggagctttttyttttcttttgtttccactcaaggcagcctcttgttctgtcacccaggctagagtgcagtggtgcagtcatagctcactgcagcctccatcttttgggctc

SEQ ID NO: 21780 - DNA, 201 bp, Homo sapiens
ttagcacaagaggaactaagagttttctaacatcgctaggagaatgtcacaggctaaagagagaaatagagggtagaaaggaaggaaaaaaggatgaagtsaatgaaggggttgtagagatggtcagaaaatacagaaatgcacctggagaagggaatcagagagcttccagtcccacacgtcctcctgcctgatggtcat

SEQ ID NO: 21781 - DNA, 201 bp, Homo sapiens
gtcttgtgtgaccacattcatttatgaggaaactgactggaactagggattttttttctccttttttggggctgtagaatattcaccccaccaacaacccmtcaactctgtggacagctgatggtcctgtaaggaaatgccatttaaaaccttgatttcatcaataatatactctaactaaatttgtgattgcctagaagt

SEQ ID NO: 21782 - DNA, 201 bp, Homo sapiens
taaataactacatcttttcttaggggatcatgaatttagtttgtcgataattgaggcccatatctgcttcttcctcttataaccctactgggggctgccthttccaggaaaagtggagtaattccattatgcctctccttagaatctcagtaaaagactagtggtagagttagaaatcactaacttattgtaaaatgtaga

SEQ ID NO: 21783 - DNA, 201 bp, Homo sapiens
tctggtcctggactctttttggcaacctaccttttaaaatattcctcatagtcagtggttaaactctgtatgctttgttgagggaggcattacattgttcttttttttttttttgaatgagtacacagtatatgcaggaaatgagttgtcagaaatcaaattagctaatgtggtggtgtggtgtagtgccagatacttggg

SEQ ID NO: 21784 - DNA, 201 bp, Homo sapiens
gtgggctatgactgtgccactgcactccagcctaggtaagacctgtctctaaagaaaaagaaaaagaaatcatattaaaagtcaggattagctgaatgaarccctcaggagaactccctccttcaatgataccttcttttttccaaattctctttttctactgacttttccctatcatcagatatgctcaagtttctccca

SEQ ID NO: 21785 - DNA, 201 bp, Homo sapiens
caccatgcctggcaatttttgtatttttagtagagataaaatttcaccgtgtttcccaggctggtcccaaactcctaacctcaagttattcgcctgcctcrgcctcccaaagtattgggattacagatgtgagccactacacctggctgaatatggcatattttttttcatctttttactctgattagagctaactataac

SEQ ID NO: 21786 - DNA, 201 bp, Homo sapiens
tttgtgtgtgtgtgtgtgtgtgtatgcgtgttttgcctgtttattgtaatgatacttacaacttgataattaaaactcagtatctaatttttaagcagtcwtatttatttatttatttatttatttatttatttatttatttatactattttactttaagttctagggtacatgtgcacaacgtgcaggtttgttacatat

SEQ ID NO: 21787 - DNA, 201 bp, Homo sapiens
ttatttatttatactattttactttaagttctagggtacatgtgcacaacgtgcaggtttgttacatatgtatacatgtgccatgttggtgtgctgcaccygttaactcgtcatttatgttaggtatatctcctaatgctatccctccccctccccccaccccacgacaggccctggcgtgtgatgttccccatcctgtgt

SEQ ID NO: 21788 - DNA, 201 bp, Homo sapiens
ttgcaattggtacactatttggtctgcaggaagaaattcaataaatatatttgatattaaactctgtattaatgtatatcattagttttaatgaatgcatwtgcagctataccagatatagctgtttgaatctggacaaactgttttacttctggggctagagtcctcaataatatttctcactgggggcgctattggcat

SEQ ID NO: 21789 - DNA, 201 bp, Homo sapiens
aagggttcttatggctttaggtctaacatttaaatctttaatccatcttgaattgatttttgtataaggtgtaaggaagggatccagtttcagctttctamatatggctagccagttttcccagtaccatttattaaatagggaatcctttccccatttcttgtttttgtcaggtttgtcaaagatcagatggttgtagat

SEQ ID NO: 21790 - DNA, 201 bp, Homo sapiens
gttctccacatctgcaactctgtagctaaacatggcaggagaaaaacacaactatactgactagcctcgcttgacattcatgaagccaatctcaagcttargacttgcttcctagtctgtctattgcctctcttgcttccttatatcttctcctctttcctcaaacctctgacatcaccttctcacatgtagagtgagctt

SEQ ID NO: 21791 - DNA, 201 bp, Homo sapiens
acacacacactcatacactcacagacatacataaatattgtctagaaaggaattttcagtttcagatttttcaagggactaaacattttttctttaagctrtattaaaaatggattttgaagattaattttccacagacacacggatgcttgaatgtcatatatttggtcctccaagcctgagtcaaccccaagctagtgc

SEQ ID NO: 21792 - DNA, 201 bp, Homo sapiens
gttttcccagtaccatttattaaatagggaatcctttccccatttcttgtttttgtcaggtttgtcaaagatcagatggttgtagatgtgtgatatcattwctgaggactctattctgttccattggtctatatctctgttttggtaccagtaccatgctgttttggttactgtagccttgtagtatagcttgaagtcagg

SEQ ID NO: 21793 - DNA, 201 bp, Homo sapiens
gatcctaccgcctcttcaccatccctcaaatccctcacctatttacttcctcagcttatattttatggccatcattaatttcacttccctgcatacatacrcgctcagcagcttggcccctttatctggctctgttgtgcttggcaaggccctgatcctggttaaatccagttctccacatctgcaactctgtagctaaac

SEQ ID NO: 21794 - DNA, 201 bp, Homo sapiens
gatttttcaagggactaaacattttttctttaagctgtattaaaaatggattttgaagattaattttccacagacacacggatgcttgaatgtcatatatytggtcctccaagcctgagtcaaccccaagctagtgccagatttattttatattttcaacattttttctcagtccatctctagtctagtgatcttcttcac

SEQ ID NO: 21795 - DNA, 201 bp, Homo sapiens
aagtcatgcaggatacattgtctgttcaacatgtaatttatgcagtcaaagctctctctacttcaggatgtgctcagaaaaatgcagtagaagcctaagawcataacagctagtgaatgatttgctttttcctttcaggtgtcctagcggctacaccggaaaatattgtgaaatggcgttttcaaaaggcatctctccagg

SEQ ID NO: 21796 - DNA, 201 bp, Homo sapiens
agatctctactgctttctcctgtgggcatttagtgctataaatttccttctacaccctacttcaaatgtgtcccagagattctggtgtgttgtgtctttgstctcattggtttcacagaacgtctttatttctgccttcatttcgttgcttacccagtagtcattcaggagcacgttgttcagtttccgtgtagttgagtg

SEQ ID NO: 21797 - DNA, 201 bp, Homo sapiens
tcaggctggagtgcatggctccctgcagcctcaacttcccaggctgaagagatcctctccgcttaaccccacaagaagctgggactacagacacataccascactcacagttaatttttatattttttgtagagatgaggtttctccatgttgttcaggctggcctcaaacccctgagctcaagtgatcctcccgcctcag

SEQ ID NO: 21798 - DNA, 201 bp, Homo sapiens
tctacaccctacttcaaatgtgtcccagagattctggtgtgttgtgtctttgctctcattggtttcacagaacgtctttatttctgccttcatttcgttgyttacccagtagtcattcaggagcacgttgttcagtttccgtgtagttgagtggttttgagtgagtttctggatcctgagttctaatttgattgccttgtg

SEQ ID NO: 21799 - DNA, 201 bp, Homo sapiens
gccttgtggtctgagagacagtttgttataatttctgttcttttacatttgctgaggagtgctttacttccaactatgtggtcaattttggaataagtgcratgtggtgctgagaggaatgtatattctgttgatttggggtggatagttatgtaagcagagattttactaagcttcctaaatagttttagattgagaaaa

SEQ ID NO: 21800 - DNA, 201 bp, Homo sapiens
ttataatttctgttcttttacatttgctgaggagtgctttacttccaactatgtggtcaattttggaataagtgcgatgtggtgctgagaggaatgtataytctgttgatttggggtggatagttatgtaagcagagattttactaagcttcctaaatagttttagattgagaaaataaatttattgcttttttatggatt

SEQ ID NO: 21801 - DNA, 201 bp, Homo sapiens
gcacctccacaggtcagcttccttctgttttgttgatctggaattctcatagtatttttggtaaacttcaagttcgtatgctgagcaacctaccttttttwaatttttttatttttatttatttatttattattatactttaaattttagggtacatgtgtacaatgtgcaggttagttacatatgtatacatgtgccatg

SEQ ID NO: 21802 - DNA, 201 bp, Homo sapiens
gatgttgtcatgtctgcagcatctttgtctgcattttctgttctgtgccaacgcattgcaaaccatcttgtttttaatttttttttttttttttttttgaracagggtctcactctgtcacccaggctggagtgcagtggtgcgatcttggctcactgcaactccacacacccccaccaggctcatgccatcctcccacct

SEQ ID NO: 21803 - DNA, 201 bp, Homo sapiens
acaacagggtttgtgctcctatgggaatctaatgcagccactcatctgacaggaggcggagctcaggcactaatgctcactcacccgcctctcacctgctsctgtgtagcctggttcctagcaggccacggaccagtaccagtttgtagcccagggactggggacccctccctcatggaacctgttcgtagtttgccatgc

SEQ ID NO: 21804 - DNA, 201 bp, Homo sapiens
cagctttgcgtggtgatttatttactagaatgtatgatttccctccacacctcttttgattggttggtacccatgccttagggtgttgttaaatattttcratatcaccctaattttcaatgagccatgcctgacttcctttctggaacctgggcttatttcagtgacagagaattaaagagaatgtgacatcatggaatg

SEQ ID NO: 21805 - DNA, 201 bp, Homo sapiens
ttaaaatttctgttaaaattggttaaaggccatagaattttttttttaagctaagcatgttatagagaggtatcctataagaagcaaggggcaggtaaagmctttagagatgtatagtccagtgtgttaattaaaggatactacctacttctaattcggtatgtattaatcttttctgatatatctgttaaagtactcttc

SEQ ID NO: 21806 - DNA, 201 bp, Homo sapiens
cacttgatgctgagaaatagaagagaatggatgggaaagaatgatggggagtttcagagatttgtgatgattcacaaatcacaaggtatgttgcaatgttygtccagggaaaagtcctcatttgttttttgttgttgttttgtgttatttatttatttatttatttatttgagatggagtctcgctctgtcgcccaggctg

SEQ ID NO: 21807 - DNA, 201 bp, Homo sapiens
ctgagttgctgggactacaggcgcgtgccaccatgcctggctaatttttgtatttttagtagagatggggtttcattttgttggccaggctagtcttgaasgagtaggagagcggtttttttgcctgattttacacaatcaccatggactggattccgctgaagtcatcatgaagctatttatgaaggagaaaggccgggg

SEQ ID NO: 21808 - DNA, 201 bp, Homo sapiens
tttattatcaacaaaacatggaactgaacattcatcagggatgtttcaaaaactggtaattcagccccagtaacttaactgtctcattttatctaaaggaraatttgtttgaaacaaatttgctagttgcaaattagctctgagaacaggcacagcttacgttaagtgaaaattttactttccctatttcaatacagcata

SEQ ID NO: 21809 - DNA, 201 bp, Homo sapiens
ttgtttgaaacaaatttgctagttgcaaattagctctgagaacaggcacagcttacgttaagtgaaaattttactttccctatttcaatacagcataagamcatacaagttacaattatctaagtacaatacattgtttctttctaatatatattttatttaatcagacatctatttacctctccttgaattgcagactca

SEQ ID NO: 21810 - DNA, 201 bp, Homo sapiens
tttgaaacaaatttgctagttgcaaattagctctgagaacaggcacagcttacgttaagtgaaaattttactttccctatttcaatacagcataagaacayacaagttacaattatctaagtacaatacattgtttctttctaatatatattttatttaatcagacatctatttacctctccttgaattgcagactcacag

SEQ ID NO: 21811 - DNA, 201 bp, Homo sapiens
caccatcatgagctgaccaacaatttctaaattcctactcagaaacacagcaaggggaatgcagtcaagcacaaagggcttaaatgaccagataaggctgsgctggatgaataaagaggaatatcctatgaatgtgactgtgtagttttagagtatcccgattcaactgttatatttgacttgtggccttgtagacagtgt

SEQ ID NO: 21812 - DNA, 201 bp, Homo sapiens
ttttaatgaagaaggacttaggaaagcaatacattatggattaaaacataaggcaaaggattaacccaagcaggcatctggaatgtactaaaagaaatgaygtgtactaaacgaatgggcgcggtggctcacgcctgtaatcccagcactttgggaagctgaggtgggcagatcacgaggtcaggagatcgagaccatcct

SEQ ID NO: 21813 - DNA, 201 bp, Homo sapiens
ctcacgcctgtaatcccagcactttgggaagctgaggtgggcagatcacgaggtcaggagatcgagaccatcctggctaacacactgaaaccccgtctctrctaaaaaatacaaaaaattagctgggcgtggtggtgggcgcctgtagttccagctacttaggaggctgaggcaggagaatggtgtgaacccaggaggtgg

SEQ ID NO: 21814 - DNA, 201 bp, Homo sapiens; identical to SEQ ID NO: 3796

SEQ ID NO: 21815 - DNA, 201 bp, Homo sapiens
ataagtgtggtagaagccattatttatgaattatcatgctaaattaattaactcattaattcattcagggcacacccagttattccccaaactgagtgatrtatttctgggaatagacttattaagcttgagaaaacccaaaggatcattataacagcaaacaggaatgtaggcatccacatagtggatgactttagtgac

SEQ ID NO: 21816 - DNA, 201 bp, Homo sapiens
gataatagtggggagaaggtcagcatgtaaacacgtgaacaaatgtctctgcatcataaaaaggtaaagaaaaaggtgctgtgcttttgatgtgcatatamataaacatctcaatgccttaaagagcagtattgctgccagcacgtcccacctccagccctaaggcagttttcccctatctcagtagatggaatatacaat

SEQ ID NO: 21817 - DNA, 201 bp, Homo sapiens
aaaatgaaataagtgtggtagaagccattatttatgaattatcatgctaaattaattaactcattaattcattcagggcacacccagttattccccaaacygagtgatgtatttctgggaatagacttattaagcttgagaaaacccaaaggatcattataacagcaaacaggaatgtaggcatccacatagtggatgact

SEQ ID NO: 21818 - DNA, 201 bp, Homo sapiens
tttagaatgtgttcaccatcatgagctgaccaacaatttctaaattcctactcagaaacacagcaaggggaatgcagtcaagcacaaagggcttaaatgamcagataaggctgggctggatgaataaagaggaatatcctatgaatgtgactgtgtagttttagagtatcccgattcaactgttatatttgacttgtggcc

SEQ ID NO: 21819 - DNA, 201 bp, Homo sapiens
cttcatctctaagactgtctccctcttttgctctgtaacctcactcgtcttcctttacttgaatgagggacgttcctccagctcaggaattctacctatgragttccctctatctatgatgccctccaacaccccacccaccatacctccatagactagttgatttgagacttccttcatctcctagtctgacttttctta

SEQ ID NO: 21820 - DNA, 201 bp, Homo sapiens
aaagagcatcctgaggatttaggaccaaagggaatgtggtttggatagaaggatgtacccactgtgttttcttctctgagtaaacaaatgtgcttaggagstgaatgtcatgtttaattgcctagcaagaaacctccctgcgggtcccggatctcatccagatgtttgcaactgaaagaatatgagctagataagctcaga

SEQ ID NO: 21821 - DNA, 201 bp, Homo sapiens
gccaccctgtttacaacaatagtagggctttgaacaatgagaaaatgcggggaaatgaaaaagacatataaagggaaagagtggatttatgcaattggatwgaaaagtggcatgtaaaatagctggtttatagatcaaactgcctttagatctgtaaaggagcttagagtacatacaggtggagagacatcaaatgtgtgt

SEQ ID NO: 21822 - DNA, 201 bp, Homo sapiens
ccaaaaggctttagaatgtgttcaccatcatgagctgaccaacaatttctaaattcctactcagaaacacagcaaggggaatgcagtcaagcacaaagggyttaaatgaccagataaggctgggctggatgaataaagaggaatatcctatgaatgtgactgtgtagttttagagtatcccgattcaactgttatatttga

SEQ ID NO: 21823 - DNA, 201 bp, Homo sapiens
tgtgtttgctgctctgggggtggaggatgtggggtgaaggttggggccagaaatgcaagaggcctctgaaagggaccctggaagtggagcaggtacacggyaaggggccccaggcggcccagcggcacccgggctcaccccagaaccattcgaatgacaaggggtgccctgcctgaaaacgccttgcggggctcagcttcc

SEQ ID NO: 21824 - DNA, 201 bp, Homo sapiens
tccagtgtgttaattaaaggatactacctacttctaattcggtatgtattaatcttttctgatatatctgttaaagtactcttcgcatatttttaaaaaaytggcattttaaagtatagtctttgatggtagaaatgtgagattgacaaaaatcatgtcctcttatgtatgaatttagtcttacacagttcttcatatgat

SEQ ID NO: 21825 - DNA, 201 bp, Homo sapiens
ctccagtcaggctccccgactttaaattcggcctctactgcttcacgtctgtggactgtcagccactttcttcttatatatgttctttccattgcctcatytctgaaattgtgtaactattaaatgagctacagagtattaatgtaaaattcttagagcagtgcctggcgctacagaaagtactcagtgaaagttagctct

SEQ ID NO: 21826 - DNA, 201 bp, Homo sapiens
agtgggttttctggttaaaaaaaaaaaaaaatctctgaatgcacggagtcgtctcaggccttctcaaatttgcaaagaacaggtccacaagacctacattycccaagataattgcagtagtgtgacctgataattaacattttttgctttcctgctggaacattcctggggcccagagactgggccaagcatttccagtcc

SEQ ID NO: 21827 - DNA, 201 bp, Homo sapiens
ctcaaagccattattttgggccttctaccaatgacgtgtttgtttcccttgaaggcttgccagaatctttatgtaggtgactctagatcatggttatttaytttcattttctcagatattaaagcatattttccttctgagttttgaatggtaagggtaaggctattcaccgcatactatcatccaaatagaagtggatgt

SEQ ID NO: 21828 - DNA, 201 bp, Homo sapiens
gcctttagatctgtaaaggagcttagagtacatacaggtggagagacatcaaatgtgtgtgagcagacccttatgtacttctccatcttcatctctaagamtgtctccctcttttgctctgtaacctcactcgtcttcctttacttgaatgagggacgttcctccagctcaggaattctacctatgaagttccctctatct

SEQ ID NO: 21829 - DNA, 201 bp, Homo sapiens
atggcacagagccacattccaaagtaagttatcttttttatttggatgaggaagtttgggaaaattatcatttgtgcccacagtttctcttgggagttaaratgaaccctataaaacctttgtatacgaggtcagatgcaggccactgcagtgtgggaggatgctgaccaactagcctgcaggcttggcttcatagaagag

SEQ ID NO: 21830 - DNA, 201 bp, Homo sapiens
caatactgaataattgccttataatttggaagaaaatttaaataaagtttattgttgagtttcaataagtggccccaaacaaggggttaatattttatgtrtaatatgactcacctttttattgtaactaataaaactgcatttttatgatgctgcttttgttctttggaagacctaattttataaatgccattaataaag

SEQ ID NO: 21831 - DNA, 201 bp, Homo sapiens
gtttcctgcctttgttgtatgcctgatacatgtattaactcatttaatccttattgaaagtctgtgatgtataggtgctacatttttcaaaagaagaaacwgaggtccagagaggttatatagctcactctggggtgagaacctaaagagtcaagactgtttttttaatcccgaaactttggtactgagcgaagtgctctt

SEQ ID NO: 21832 - DNA, 201 bp, Homo sapiens
caaagcacttagccaagtttaaggacactactcatgtcatatctgctaacacccgttgttcaaacaagtaacatggccaagcctaattatgaaggaacagkaagtatactggccctacagaaggagagggaatgaaatgaatatttgatgaacagtattatgctatcagcttcatattagatgtttatttctagtatttta

SEQ ID NO: 21833 - DNA, 201 bp, Homo sapiens
gcatggccacttcccagttccaggaacaggcagtcgttgttttttctggcttatcacattgagatacatggttactacaagtgacacttaaacgtgtcagrcagtttgggggctcccttcttgaactttttctaagagcaaacctttgtcttaatgccaccctgtttacaacaatagtagggctttgaacaatgagaaaat

SEQ ID NO: 21834 - DNA, 201 bp, Homo sapiens
aattggatagaaaagtggcatgtaaaatagctggtttatagatcaaactgcctttagatctgtaaaggagcttagagtacatacaggtggagagacatcaratgtgtgtgagcagacccttatgtacttctccatcttcatctctaagactgtctccctcttttgctctgtaacctcactcgtcttcctttacttgaatga

SEQ ID NO: 21835 - DNA, 201 bp, Homo sapiens
tacttgtatgcaaataatatatgatgcctcagtttcctccaaagtcttagttaacagagttagaaaaaatcagattatatttgaagttctgtgttcatacyggagtaattattattccaatggtacaatatacaacataactttattacattttttggtacagcataaagatgattttccctttctctgagtatttctgaa

SEQ ID NO: 21836 - DNA, 201 bp, Homo sapiens
agtgggaagaaaaagagcaaatatgaacaaattgtcattgttttagaatctgcttcttttcctttccggtatttctgtgcaaggagagaatgatctctgaycttgtgaaaggcaaataccatgtgtattcatggttgttattcatttggcaacgacttgaaactcatgacactccctgctgaagatcctccacctattctt

SEQ ID NO: 21837 - DNA, 201 bp, Homo sapiens
tctgtgtcccaccaaggacacttaaaggagttcatggtggtaagacttgtgaaggccgtctttatccgactcagagtctttccacataggcattatagagygacttttcctccatatatttattttaatcactcattattttagccaggcttctgacatctatgaccccagttactgaggactatgtacaaatgggacagt

SEQ ID NO: 21838 - DNA, 201 bp, Homo sapiens
ttcaggaaacgaaaccaggagccgcgggtgttggcgcaaaggttactcccagacccttttccggctgacttctgagaaggttgcgcagcagctgtgcccgrcagtctagaggcgcagaagaggaagccatcgcctggccccggctctctggaccttgtctcgctcgggagcggaaacagcggcagccagaggtgcgcgggc

SEQ ID NO: 21839 - DNA, 201 bp, Homo sapiens
cttcttttcctttccggtatttctgtgcaaggagagaatgatctctgaccttgtgaaaggcaaataccatgtgtattcatggttgttattcatttggcaasgacttgaaactcatgacactccctgctgaagatcctccacctattcttaacagctgggctccccagctcctggatcaccaaccagtaccagtctgtggcc

SEQ ID NO: 21840 - DNA, 201 bp, Homo sapiens
aacttatcttttaagattaaaaataatgtaaccaagtgggaagaaaaagagcaaatatgaacaaattgtcattgttttagaatctgcttcttttcctttcyggtatttctgtgcaaggagagaatgatctctgaccttgtgaaaggcaaataccatgtgtattcatggttgttattcatttggcaacgacttgaaactcat

SEQ ID NO: 21841 - DNA, 201 bp, Homo sapiens
ttaaatctcttgatgaacagtgtgtggttggcaaaatttccaagcactggactggaattttgagagaggcatttacagacgctgataactttggaatccarttccctttagaccttgatgttaaaatgaaagctgtaatgattggtgcctgtttcctcattgtaagtctgttcttattaatcttgattatagatgctttct

SEQ ID NO: 21842 - DNA, 201 bp, Homo sapiens
tttcatatggttcaacttcattggtgtagttccagagtaagcataacatatataaatactgaagtatattcattattttaaatatttaaaataatacttayagcaatgatgatagatatctttaaaatcatccataattctaccatcttcacatcccattaatttcatttatctctttcttcgtagtctgtatgtaatttt

SEQ ID NO: 21843 - DNA, 201 bp, Homo sapiens
gattatataaaatatatatgggaagttaatgacttgaattaaggtcatgttggattttagttatgtataggaaaagaatggagagttttcagcaaacagayggtaattgaatctctaagaaggttatcttaatggtgagtaagagagagcctagtagaccttttatccaatataggtgataagagagtctgtctccttcaa

SEQ ID NO: 21844 - DNA, 201 bp, Homo sapiens
attatataaaatatatatgggaagttaatgacttgaattaaggtcatgttggattttagttatgtataggaaaagaatggagagttttcagcaaacagatrgtaattgaatctctaagaaggttatcttaatggtgagtaagagagagcctagtagaccttttatccaatataggtgataagagagtctgtctccttcaag

SEQ ID NO: 21845 - DNA, 201 bp, Homo sapiens
ggatgactttagtgacctggcacacagtgccttatctacttggcacatgtacaggtacaaggaacacttaacattttgcaccagagcttattacataccaytttcaatgcttgagatattatataaatgctaaaattctaaaacctatagtaaagcaaagacccagattttatactgcagtagttttgccagtaagtctca

SEQ ID NO: 21846 - DNA, 201 bp, Homo sapiens
accacagtagtatttcattacacataatccctaaaactcagcagcttgcaataagtgtttatactcatgcttatgggtgtgtaggtcaactgtgtttcagyggatgtatttaagcactgacttaggcgcatgttaacctcaatctgctccaggtagatttgttctatggctgtagcagcagcagctacctgagtcatgctt

SEQ ID NO: 21847 - DNA, 201 bp, Homo sapiens
cttgagaaaacccaaaggatcattataacagcaaacaggaatgtaggcatccacatagtggatgactttagtgacctggcacacagtgccttatctacttrgcacatgtacaggtacaaggaacacttaacattttgcaccagagcttattacataccactttcaatgcttgagatattatataaatgctaaaattctaaa

SEQ ID NO: 21848 - DNA, 201 bp, Homo sapiens
tgtagcagcagcagctacctgagtcatgcttttctagtggcttgtcactgaagatcataagccaggccaaagcacttagccaagtttaaggacactactcrtgtcatatctgctaacacccgttgttcaaacaagtaacatggccaagcctaattatgaaggaacaggaagtatactggccctacagaaggagagggaatg

SEQ ID NO: 21849 - DNA, 201 bp, Homo sapiens
ccctttctctgagtatttctgaaatttaaaatgaaataagtgtggtagaagccattatttatgaattatcatgctaaattaattaactcattaattcattsagggcacacccagttattccccaaactgagtgatgtatttctgggaatagacttattaagcttgagaaaacccaaaggatcattataacagcaaacagga

SEQ ID NO: 21850 - DNA, 201 bp, Homo sapiens
gtacttttgctataagtttcctaaaagtatttaatacttttttttttcaatttagattaaatctcttgatgaacagtgtgtggttggcaaaatttccaagyactggactggaattttgagagaggcatttacagacgctgataactttggaatccagttccctttagaccttgatgttaaaatgaaagctgtaatgattgg

SEQ ID NO: 21851 - DNA, 201 bp, Homo sapiens
tatatgttctttccattgcctcatctctgaaattgtgtaactattaaatgagctacagagtattaatgtaaaattcttagagcagtgcctggcgctacagraagtactcagtgaaagttagctcttattattttaaatatttgacaaagttcctgcttctccaagctgattctctggttcccaggtggtttcattcatgca

SEQ ID NO: 21852 - DNA, 201 bp, Homo sapiens
tacttgaatgagggacgttcctccagctcaggaattctacctatgaagttccctctatctatgatgccctccaacaccccacccaccatacctccatagaytagttgatttgagacttccttcatctcctagtctgacttttcttaaaccccctaccaccatctaagttagtgccccataaccctttcttatagcaacatt

SEQ ID NO: 21853 - DNA, 201 bp, Homo sapiens
ttctttattctctctttcatctttgttgaggtaacaaaaaaatatttatctgtcactacagtgtcacccttattagatatatgaaataatctccaggactrgactccttgcttttcccatgtgaagttttatgattttctttttacttacaaaactcaaagctttttaaatgtaaatttatatagaattatactggtttat

SEQ ID NO: 21854 - DNA, 201 bp, Homo sapiens
ttattttaaatatttgacaaagttcctgcttctccaagctgattctctggttcccaggtggtttcattcatgcactgttattcctggaagtcttggcatgsccacttcccagttccaggaacaggcagtcgttgttttttctggcttatcacattgagatacatggttactacaagtgacacttaaacgtgtcagacagtt

SEQ ID NO: 21855 - DNA, 201 bp, Homo sapiens
tccttcatctcctagtctgacttttcttaaaccccctaccaccatctaagttagtgccccataaccctttcttatagcaacattaattttatttatagcasttagagtatttttaataatatatttaattcttaattgtctgtctcccctagtgtctaggtattgtgctctagtgcctggtatagtgccttgcatgctcta

SEQ ID NO: 21856 - DNA, 201 bp, Homo sapiens
gatgtatagatctgcaatccagaaactatgaatttttttcagttgagtagtctgtttgccaaaaaataaaaaaaaataaaaaataaaaacttgcctaagtktcttctcttacattttatttaggatttgcccttagacattatttagtgcttttctgaccctgtagggacggtgagaataattgaaacactagtttcttaa

SEQ ID NO: 21857 - DNA, 201 bp, Homo sapiens
tggccacttcccagttccaggaacaggcagtcgttgttttttctggcttatcacattgagatacatggttactacaagtgacacttaaacgtgtcagacartttgggggctcccttcttgaactttttctaagagcaaacctttgtcttaatgccaccctgtttacaacaatagtagggctttgaacaatgagaaaatgcg

SEQ ID NO: 21858 - DNA, 201 bp, Homo sapiens
atatttaattcttaattgtctgtctcccctagtgtctaggtattgtgctctagtgcctggtatagtgccttgcatgctctatgccttcaattaattccttwaaaaccacacaagctttatatttagtgaatatttatataggaagaatttctatgtgtatatatgtgtatctgtgtatatacacactgtattgcactgccc

SEQ ID NO: 21859 - DNA, 201 bp, Homo sapiens
ttcctttgtctctttggtttactttttagttttgtagaacacttgatcactaccatctcacttggtcctagttgatgtatcatctacatttttattcaagktttaatataaaatgctataaaaggctatcctaaactggttttaagcatatttgttttgtttgttcagcataaaatacacaagaggatttttatggaatgg

SEQ ID NO: 21860 - DNA, 201 bp, Homo sapiens
aagaatttctatgtgtatatatgtgtatctgtgtatatacacactgtattgcactgccctgaatagtgctaaattaaaaaaccaaaacactttttaatcasaacttaatagttgcactcttcaattttccatatgttcttttaagaagtgattagaaaaaaatgatgtctccatatgttgtctgctgctgtaaaagaatac

SEQ ID NO: 21861 - DNA, 201 bp, Homo sapiens
ttgatacaaagtatgtgagtgtcagcattttgcagccatctgtttccctcatgaagatagattagcccagcaaaggtgcagagttcacttaggattcccayggtctagatattctgtgagttgaagccttggttgccgaacacgtttgtctaatacccacctcccacttctgaacaactactgttgagttgaataaggatg

SEQ ID NO: 21862 - DNA, 201 bp, Homo sapiens
agttcccttagtatttattgatcattatcgggcgtttcccggagagggggatgtggcaggacaataggataatagtggggagaaggtcagcatgtaaacaygtgaacaaatgtctctgcatcataaaaaggtaaagaaaaaggtgctgtgcttttgatgtgcatatacataaacatctcaatgccttaaagagcagtattg

SEQ ID NO: 21863 - DNA, 201 bp, Homo sapiens
ttaagaagtgattagaaaaaaatgatgtctccatatgttgtctgctgctgtaaaagaatacctgagacttggtaatttataaaggacagaaatttatttcytacagttctggaggctaggaagtccaacataatcatgtgttgcttaaatacaggaatacattctgagaaatgcatcatgaggcaattttgtggttgtgag

SEQ ID NO: 21864 - DNA, 201 bp, Homo sapiens
gcctactctggcaataacaaacccactcccaagataacgacattaatctattcatgaaggtagagtgcttataaactaatcatattttattaggctccacytcccaacactgttgcattggaaattaagtttccaacacatgaacttagctcacacattctaaccatagcacctggcctagttaaagctaagtggcacaag

SEQ ID NO: 21865 - DNA, 201 bp, Homo sapiens
gttactgtcccaggacgttgctctgaaatgttctttctgtgactctggcctcctgaactcctgtgcatccttcagatctcagcataaaggtgacccctcarggcagctgttcctgctccttccctttttctcttcccatctcaatagcgacctttggcatctctagtcataaaaccgtggtctcttacttgaaagcattta

SEQ ID NO: 21866 - DNA, 201 bp, Homo sapiens
catctcacttggtcctagttgatgtatcatctacatttttattcaaggtttaatataaaatgctataaaaggctatcctaaactggttttaagcatatttrttttgtttgttcagcataaaatacacaagaggatttttatggaatggctccttgttacaaggtactttgcatttataatcagccacagtcacctcagttt

SEQ ID NO: 21867 - DNA, 201 bp, Homo sapiens
ctcatgacactccctgctgaagatcctccacctattcttaacagctgggctccccagctcctggatcaccaaccagtaccagtctgtggcctgttaggaaytgggcttgtacagcaggagctgagcagctggagagtgagcaaagtttcatctgtattgacagctgctccccatcgctcacatacattaccacctgagctc

SEQ ID NO: 21868 - DNA, 201 bp, Homo sapiens
aagagtgtacattcactcaagtgtgtagacctaactaccaaattacaggaaataattggatataccagtgattctgaaattgccttcacattagaaccacytagggactttaaaaactccaaggactagtccatacctcagttcaactaaatcagaaacttcgaagttcatatagtgttccaggtgattccagtatgcagc

SEQ ID NO: 21869 - DNA, 201 bp, Homo sapiens
gaatggtaagggtaaggctattcaccgcatactatcatccaaatagaagtggatgtgcaaccacagatatttcattgaaaaatctcagaaagagaaaagcrtattaaacatcacagatacagatgtctacgctgaaatgtcaacttatagatagatggcataaccctaaaaaggttgacaattccatttttggtgcagtta

SEQ ID NO: 21870 - DNA, 201 bp, Homo sapiens
gtttaatataaaatgctataaaaggctatcctaaactggttttaagcatatttgttttgtttgttcagcataaaatacacaagaggatttttatggaatgrctccttgttacaaggtactttgcatttataatcagccacagtcacctcagtttcatcccgtatcttacaagtatgatgtgctgtatactcaaagcctcac

SEQ ID NO: 21871 - DNA, 201 bp, Homo sapiens
tgaaaacttttagtctactttggttacatgtgtttattattgctcaccttatagattaacagcagaaaagtataaattttaatatttctacctttctggcttgaggtctacagcattaatttctgaccagttaatgcaaactgagattcctattgtcctaagaaaatctgggaagttagtaacacaaacacatcttttgat

SEQ ID NO: 21872 - DNA, 201 bp, Homo sapiens
acatgaatattaatatttaggaggttgaaccatttgtgcatatattaagtttactcaagccttattagcaaataacaaagtttaatatgctagtgtattgwaattaaacatggcttttgtgggtcaaaaacagtcatatttggggaatttcatatggttcaacttcattggtgtagttccagagtaagcataacatatata

SEQ ID NO: 21873 - DNA, 201 bp, Homo sapiens
aggtttgaaacccatcttcacaacacttatctatgtgactttaacaaattctttcacttctctttgctttagtttttttacatgaaaattgggtgtaatamcagtaaataaataaatcattagtaagtaaataaaatagcttaccagcaactattaatatactcatgatacactttttatatttctttgctacatacctag

SEQ ID NO: 21874 - DNA, 201 bp, Homo sapiens
gaggatttttatggaatggctccttgttacaaggtactttgcatttataatcagccacagtcacctcagtttcatcccgtatcttacaagtatgatgtgcygtatactcaaagcctcaccacctgcttgccccacccatttgcttaaatgtatcaattttttctaagcttaacttttaccaaaactggagttcaacagatg

SEQ ID NO: 21875 - DNA, 201 bp, Homo sapiens
cacctcaacctcccgagtagttgggactacaagcgcatgccaccatgcttggctaatttttttttagtagagacagtgtctgtccatgttgcccaggctgrtctcaaacttctggactcaagtgatcctcctgcctcagcttcccaaaatactggcattataggcataagccaccatccctggccaaaaaataattctgaa

SEQ ID NO: 21876 - DNA, 201 bp, Homo sapiens
tctgttgtttatgctccagaatacaatgtctagttcagtattttgactatagagaagatgtacaaaaatagcactatcactaggttcttcattaaaaatamgaaagccttttggaaagctaagaaatgctagatttattgggaaatatgttctgtaacatatatttaaaccacaacaatattctctttgtgtattttatat

SEQ ID NO: 21877 - DNA, 201 bp, Homo sapiens
catatacataccacttattttttttcctgctatagatagatcagatactgattcatcagcaaattgaacttctggaaggtatgtattcattgttttaatcmtgtttctataaagagtagaagtttatgcagataaaggcacattgacctccacaaatataacactctcacttatataggacagttaaaccagttatttaca

SEQ ID NO: 21878 - DNA, 201 bp, Homo sapiens
aattttttctaagcttaacttttaccaaaactggagttcaacagatgaatatttttccttcttagatgttaactaaacatttttaaaggtacaaaatttaygtacaaacataacccaaatgacatggaagttacttgatttgtgacttacctctgtaatgttcccctggcctacttgaaattcctacctttcctctagtct

SEQ ID NO: 21879 - DNA, 201 bp, Homo sapiens
ttgacttattaaccacttaggattgcacagtaagataatttaaagggtagccagcactggagtgggcctgggaaggggatgggcagtttgtgttagtgtgygtgggtccaagataaaaatgttgggtagcagagttttgcctaatgcattgtcgctaaaagggatgaagggcatcgggatctacaggagatggaaaaagta

SEQ ID NO: 21880 - DNA, 201 bp, Homo sapiens
gctgcaatttatgtttctgtataaataccgagtacaaagtttcacttgggtggtcaaggtgctatggctgtgacaactcctgagagtgggttttctggttaaaaaaaaaaaaaaatctctgaatgcacggagtcgtctcaggccttctcaaatttgcaaagaacaggtccacaagacctacatttcccaagataattgcag

SEQ ID NO: 21881 - DNA, 201 bp, Homo sapiens
aaaaaaataaaaaataaaaacttgcctaagtttcttctcttacattttatttaggatttgcccttagacattatttagtgcttttctgaccctgtagggamggtgagaataattgaaacactagtttcttaaaatttctgttaaaattggttaaaggccatagaattttttttttaagctaagcatgttatagagaggtat

SEQ ID NO: 21882 - DNA, 201 bp, Homo sapiens
gtgtgtccagtctatacacatacaaatattcttgtgatattcaaccagttttcatttcataaatcatttctttcttgcactctctttagtaacttaatttmccacaatgtgcttaagtggcataatcataggaatttttggtcattattatattatgcaagaaatacatagaaatagatattttaaaaatcagagtctcat

SEQ ID NO: 21883 - DNA, 201 bp, Homo sapiens
ctaacacccgttgttcaaacaagtaacatggccaagcctaattatgaaggaacaggaagtatactggccctacagaaggagagggaatgaaatgaatattygatgaacagtattatgctatcagcttcatattagatgtttatttctagtattttacaaactatccacttgtactcaaataaaatgagtcaagtattttta

SEQ ID NO: 21884 - DNA, 201 bp, Homo sapiens
tctcctgacctcgtgatctgcccactttggcctcccaaagtgctgggattacaggcatgagccacctcaattgtctaatttttaaaggtactccagtataratcaattttatttgacctaaatttttccacattaataatgaacacaataaatattttattaattaaaaatattaacttcagttttacactaaaaagtaat

SEQ ID NO: 21885 - DNA, 201 bp, Homo sapiens
tgcagtcaagcacaaagggcttaaatgaccagataaggctgggctggatgaataaagaggaatatcctatgaatgtgactgtgtagttttagagtatccckattcaactgttatatttgacttgtggccttgtagacagtgtgttaatgtcagatcttctttttcagaactgttttaatcatggacaaacaaagtaagtaa

SEQ ID NO: 21886 - DNA, 201 bp, Homo sapiens
gtatcacatttattaaaatcacttttatttctatgggtttagtttcaccatttattaggaggaaaggaagcaaatttgtgagggagctctgggttgtcagraaaggcttttcagagtagtaaagcaatcaaatgagaataactgattcagtatttgtttcctttgtctctttggtttactttttagttttgtagaacactt

SEQ ID NO: 21887 - DNA, 201 bp, Homo sapiens
tcttttactaatccccctcagtgcagaccctttacgggtgtcggactggtggacggtcaggtctttcccttcccaggaggccatatttcagactatcacawggggagaaaccttggacaatacctggctttcctaggcagaggtccctgtggccttccacagtgttttgtgtccctgggtacttgagattagggagtggtg

SEQ ID NO: 21888 - DNA, 201 bp, Homo sapiens
gaagtttggctggcatatattttatttttagtaaataaatgaaaacactggaaaaacattgtgtaatccttgtatttgatactaaaaaatttatgtttcawctggcagtctttcttgatggataccttaaagcatccattccatgtaataaattaacttttcttctatttatctagaatgatgatatcaaggtactctcat

SEQ ID NO: 21889 - DNA, 201 bp, Homo sapiens
ttatgaattccctatctttgcagcacatcctttatttctggcttgcatgggacttgaaagcctaaaacaactaaatgctaagaaaaattatttttaaaatkatgacaaaaatattttctatttcagatgtatagatctgcaatccagaaactatgaatttttttcagttgagtagtctgtttgccaaaaaataaaaaaaaa

SEQ ID NO: 21890 - DNA, 201 bp, Homo sapiens
tatattttatttttagtaaataaatgaaaacactggaaaaacattgtgtaatccttgtatttgatactaaaaaatttatgtttcatctggcagtctttctygatggataccttaaagcatccattccatgtaataaattaacttttcttctatttatctagaatgatgatatcaaggtactctcatggaaagaattgagaa

SEQ ID NO: 21891 - DNA, 201 bp, Homo sapiens
tattcttaacagctgggctccccagctcctggatcaccaaccagtaccagtctgtggcctgttaggaactgggcttgtacagcaggagctgagcagctggrgagtgagcaaagtttcatctgtattgacagctgctccccatcgctcacatacattaccacctgagctcaacctcctgtcagatcagcagtggcattagat

SEQ ID NO: 21892 - DNA, 201 bp, Homo sapiens
actggagttcaacagatgaatatttttccttcttagatgttaactaaacatttttaaaggtacaaaatttatgtacaaacataacccaaatgacatggaakttacttgatttgtgacttacctctgtaatgttcccctggcctacttgaaattcctacctttcctctagtctagtatcttattctcagttattcggaggaa

SEQ ID NO: 21893 - DNA, 201 bp, Homo sapiens
tggagcttgcagtgagcagagatgatgccaccgcactccagcctgggcgacagagcaagactctgtctcaaaaaaaaaaaaaatggaaagaaagaaatgaygtgctttcaccttcaacagtggcactataatattttgggctggacaattcttcatttttagggagctgttctggctcttttaagatgtgtagcagcagcc

SEQ ID NO: 21894 - DNA, 201 bp, Homo sapiens
ggggcatttcatcaagttacttattggtatttgcctttactccaaactgctaatcttttctaggtgcttagcatttcatgtttggcaactcacagtgggtrgtaataagccttttcatcatatttaatctttcagtctgtgtaaactgtgcttctcctaaagcagaagtctaataggagttttgttcattaacttcctgat

SEQ ID NO: 21895 - DNA, 201 bp, Homo sapiens
agagtttcactgtaatatgaattttgaagccagaactggaaatcccctgtgctgtgtcttcctcttcgtggtagtagaggttacagttatcaaatagtccrgagaagcaatgggaacttatgatttctgatagaaaaattttaacagagatgtacttgtatgcaaataatatatgatgcctcagtttcctccaaagtctta

SEQ ID NO: 21896 - DNA, 201 bp, Homo sapiens
acaaaatttatgtacaaacataacccaaatgacatggaagttacttgatttgtgacttacctctgtaatgttcccctggcctacttgaaattcctaccttycctctagtctagtatcttattctcagttattcggaggaagttagggacctagaattcttgttttcagagcagtagaattttgctaacataattcaaaaca

SEQ ID NO: 21897 - DNA, 201 bp, Homo sapiens
ttctttctttttttttttttttttttttgagatggagtctcacgcttgttgcccaggctggagtgcagtagcgcgatctcggctcactgcaacatctgcckcctgggttcaggcgattctcctgcctgagcctcccaagtagctgggactacaggcacctgccaccacacccagctcattttttgtatttttagtagagac

SEQ ID NO: 21898 - DNA, 201 bp, Homo sapiens
caagtgtgtagacctaactaccaaattacaggaaataattggatataccagtgattctgaaattgccttcacattagaaccacctagggactttaaaaacyccaaggactagtccatacctcagttcaactaaatcagaaacttcgaagttcatatagtgttccaggtgattccagtatgcagccaaagatgagaattatg

SEQ ID NO: 21899 - DNA, 201 bp, Homo sapiens
caaacataacccaaatgacatggaagttacttgatttgtgacttacctctgtaatgttcccctggcctacttgaaattcctacctttcctctagtctagtrtcttattctcagttattcggaggaagttagggacctagaattcttgttttcagagcagtagaattttgctaacataattcaaaacatttatccctatctt

SEQ ID NO: 21900 - DNA, 201 bp, Homo sapiens
gacctagaattcttgttttcagagcagtagaattttgctaacataattcaaaacatttatccctatcttggggcttgaagagaatgtgaaatgctttatcytctgttttgagggaatgagggaaggagcttgttcttaggcaattaacaagtaaatttaaataaataatccaaatctggtgtgggtaaacaaattttagtt

SEQ ID NO: 21901 - DNA, 201 bp, Homo sapiens
attggcattttaaagtatagtctttgatggtagaaatgtgagattgacaaaaatcatgtcctcttatgtatgaatttagtcttacacagttcttcatatgwtggaatctaaaacaaatgtagtcttgaaaacttttagtctactttggttacatgtgtttattattgctcaccttatagattaacagcagaaaagtataaa

SEQ ID NO: 21902 - DNA, 201 bp, Homo sapiens
taccttcctcttatctcaactgcaaagacgcgttccttcctcttttactaatccccctcagtgcagaccctttacgggtgtcggactggtggacggtcagrtctttcccttcccaggaggccatatttcagactatcacatggggagaaaccttggacaatacctggctttcctaggcagaggtccctgtggccttccaca

SEQ ID NO: 21903 - DNA, 201 bp, Homo sapiens
ccattttaaacagaacgttaaccttgccatctaagtctgattgccaaagcatatggatccttcttaaatctgaaatatcatctgccaatgctcaaggccaygttcagaatgtctgacatctttgaattcctacaagaagcccaattatgcaaagatagttttgagaaaattagtataatatgtactacccagttatgcttc

SEQ ID NO: 21904 - DNA, 201 bp, Homo sapiens
attggaatgttcttaagactttaagttgattataaaattttgtgcttaaagttggcaataatcaaaacaaaacaaacaaacaaaaaaaaccctttattttraaacacagtcttgctctgtcacccaggctggaatgcagtgatgacatcatacttcattagaccgtcaatattccaggctcaagcaatcctcccacctcaa

SEQ ID NO: 21905 - DNA, 201 bp, Homo sapiens
caaaacaaaacaaacaaacaaaaaaaaccctttattttaaaacacagtcttgctctgtcacccaggctggaatgcagtgatgacatcatacttcattagascgtcaatattccaggctcaagcaatcctcccacctcaacctcccgagtagttgggactacaagcgcatgccaccatgcttggctaatttttttttagtag

SEQ ID NO: 21906 - DNA, 201 bp, Homo sapiens
tgatggtagaaatgtgagattgacaaaaatcatgtcctcttatgtatgaatttagtcttacacagttcttcatatgatggaatctaaaacaaatgtagtcytgaaaacttttagtctactttggttacatgtgtttattattgctcaccttatagattaacagcagaaaagtataaattttaatatttctacctttctggc

SEQ ID NO: 21907 - DNA, 201 bp, Homo sapiens
ttttttcagttgagtagtctgtttgccaaaaaataaaaaaaaataaaaaataaaaacttgcctaagtttcttctcttacattttatttaggatttgccctyagacattatttagtgcttttctgaccctgtagggacggtgagaataattgaaacactagtttcttaaaatttctgttaaaattggttaaaggccatagaa

SEQ ID NO: 21908 - DNA, 201 bp, Homo sapiens
caaatattcttgtgatattcaaccagttttcatttcataaatcatttctttcttgcactctctttagtaacttaatttcccacaatgtgcttaagtggcayaatcataggaatttttggtcattattatattatgcaagaaatacatagaaatagatattttaaaaatcagagtctcataaaatacataaaggatgttatc

SEQ ID NO: 21909 - DNA, 201 bp, Homo sapiens
accaaccagtaccagtctgtggcctgttaggaactgggcttgtacagcaggagctgagcagctggagagtgagcaaagtttcatctgtattgacagctgcyccccatcgctcacatacattaccacctgagctcaacctcctgtcagatcagcagtggcattagattctcataggagcaagaaccctattgtgaactgcat

SEQ ID NO: 21910 - DNA, 201 bp, Homo sapiens
acgtgtttgtttcccttgaaggcttgccagaatctttatgtaggtgactctagatcatggttatttattttcattttctcagatattaaagcatattttcyttctgagttttgaatggtaagggtaaggctattcaccgcatactatcatccaaatagaagtggatgtgcaaccacagatatttcattgaaaaatctcaga

SEQ ID NO: 21911 - DNA, 201 bp, Homo sapiens
catgaatattaatatttaggaggttgaaccatttgtgcatatattaagtttactcaagccttattagcaaataacaaagtttaatatgctagtgtattgtwattaaacatggcttttgtgggtcaaaaacagtcatatttggggaatttcatatggttcaacttcattggtgtagttccagagtaagcataacatatataa

SEQ ID NO: 21912 - DNA, 201 bp, Homo sapiens
ggcttcaagttctgcctactttaaaaaaaaaattcgtataggtaaatgtgctggtaaaccaggttctgccttctgtactaatagttatgtggtagtttaarcaagttgcagtacctcaaagcctcagagttcctatctataaataagggtgatattttcaatgtaggttgctttgtagagtaaatgagagtatatgtaaaa

SEQ ID NO: 21913 - DNA, 201 bp, Homo sapiens
atatttaaaataatacttacagcaatgatgatagatatctttaaaatcatccataattctaccatcttcacatcccattaatttcatttatctctttcttsgtagtctgtatgtaattttaaagctatctttgttttattatcaacaaaacatggaactgaacattcatcagggatgtttcaaaaactggtaattcagccc

SEQ ID NO: 21914 - DNA, 201 bp, Homo sapiens
cctttagatctgtaaaggagcttagagtacatacaggtggagagacatcaaatgtgtgtgagcagacccttatgtacttctccatcttcatctctaagacwgtctccctcttttgctctgtaacctcactcgtcttcctttacttgaatgagggacgttcctccagctcaggaattctacctatgaagttccctctatcta

SEQ ID NO: 21915 - DNA, 201 bp, Homo sapiens
tatcttaaatacaatctatgataatggccaatagcaaacatttaattagcactgtttcctgcctttgttgtatgcctgatacatgtattaactcatttaawccttattgaaagtctgtgatgtataggtgctacatttttcaaaagaagaaactgaggtccagagaggttatatagctcactctggggtgagaacctaaag

SEQ ID NO: 21916 - DNA, 201 bp, Homo sapiens
taaaaatttcaggacctcaagagatgggtcaaaagagtttcactgtaatatgaattttgaagccagaactggaaatcccctgtgctgtgtcttcctcttcrtggtagtagaggttacagttatcaaatagtccagagaagcaatgggaacttatgatttctgatagaaaaattttaacagagatgtacttgtatgcaaata

SEQ ID NO: 21917 - DNA, 201 bp, Homo sapiens
ttctacctatgaagttccctctatctatgatgccctccaacaccccacccaccatacctccatagactagttgatttgagacttccttcatctcctagtcygacttttcttaaaccccctaccaccatctaagttagtgccccataaccctttcttatagcaacattaattttatttatagcacttagagtatttttaata

SEQ ID NO: 21918 - DNA, 201 bp, Homo sapiens
cccacagtttctcttgggagttaagatgaaccctataaaacctttgtatacgaggtcagatgcaggccactgcagtgtgggaggatgctgaccaactagcstgcaggcttggcttcatagaagagcactcctgctcctgctgaatggcctgacatttccttgggtccagggctccttaggtgcaaaaataaacctaggaag

SEQ ID NO: 21919 - DNA, 201 bp, Homo sapiens
ttggatgaggaagtttgggaaaattatcatttgtgcccacagtttctcttgggagttaagatgaaccctataaaacctttgtatacgaggtcagatgcagrccactgcagtgtgggaggatgctgaccaactagcctgcaggcttggcttcatagaagagcactcctgctcctgctgaatggcctgacatttccttgggtc

SEQ ID NO: 21920 - DNA, 201 bp, Homo sapiens; identical to SEQ ID NO: 3807

SEQ ID NO: 21921 - DNA, 201 bp, Homo sapiens
ctccctatttcctttggggtgagctagaaaaaaacaccaccacctaccactttgtcacaacaaagcaaatttagacctgttatccttggtaggaactgaaragttaaaaaaatgaagaaacttttgaagagagatttagcaaagaattctccaataagattgtttttcagttgcttttctgtctgctgttgaaatttcctg

SEQ ID NO: 21922 - DNA, 201 bp, Homo sapiens
taaaatgatgggatgagacaatccaagtatgaggtctcttacaaatctgagaggaatttggcataaaaagtaaaataaatctttctgtaagttgcatgggrctcagaggtaaagagtctgtagaactcacatttttgaatgattaatagctgacttagaaacacaaattatttttgcttacttattttattagataggttg

SEQ ID NO: 21923 - DNA, 201 bp, Homo sapiens
gttagagagaaaggtcagcatgagtgtattgtatttgtggccttctaatctaatccagagctttcactttacagataagaaatgtgatgcccacaaaaaawcaatgtgtcggtcaaaaccaaaacaaaacgatgtgccttactgtgtcagttattagtccccagattcagcatagaagaatataaagacattttttaaatt

SEQ ID NO: 21924 - DNA, 201 bp, Homo sapiens
ctgcaaggatttccccaaaacatctggcttccagagtttatatgaaatccacaaatgaaatcagtcaaagaaatctaccagataattactagccgagttartaaaacctatctaattcactatatattttaaaagatcttatggtcattatttctttgttgtttttatcccataagataaatcaacacttaataagaacca

SEQ ID NO: 21925 - DNA, 201 bp, Homo sapiens; identical to SEQ ID NO: 3810

SEQ ID NO: 21926 - DNA, 201 bp, Homo sapiens; identical to SEQ ID NO: 3811

SEQ ID NO: 21927 - DNA, 201 bp, Homo sapiens; identical to SEQ ID NO: 3812

SEQ ID NO: 21928 - DNA, 201 bp, Homo sapiens; identical to SEQ ID NO: 3814

SEQ ID NO: 21929 - DNA, 201 bp, Homo sapiens; identical to SEQ ID NO: 3813

SEQ ID NO: 21930 - DNA, 201 bp, Homo sapiens; identical to SEQ ID NO: 3815

SEQ ID NO: 21931 - DNA, 201 bp, Homo sapiens; identical to SEQ ID NO: 3817

SEQ ID NO: 21932 - DNA, 201 bp, Homo sapiens; identical to SEQ ID NO: 3818

SEQ ID NO: 21933 - DNA, 201 bp, Homo sapiens; identical to SEQ ID NO: 3820

SEQ ID NO: 21934 - DNA, 201 bp, Homo sapiens; identical to SEQ ID NO: 3823

SEQ ID NO: 21935 - DNA, 201 bp, Homo sapiens; identical to SEQ ID NO: 3824

SEQ ID NO: 21936 - DNA, 201 bp, Homo sapiens; identical to SEQ ID NO: 3828

SEQ ID NO: 21937 - DNA, 201 bp, Homo sapiens; identical to SEQ ID NO: 3829

SEQ ID NO: 21938 - DNA, 201 bp, Homo sapiens; identical to SEQ ID NO: 3830

SEQ ID NO: 21939 - DNA, 201 bp, Homo sapiens
ttctgtttagaaatatggcattgtttgaattacttttaaatttttctacaaccaatacttactattgcatcattccaaaaagatcatttttatttcaaaamatcccaagtaatataggaaaataagaaaggctatataatgtttatttggcttgttactgattgaatttccccctgtgtaaaaatacttagaagatgcagt

SEQ ID NO: 21940 - DNA, 201 bp, Homo sapiens; identical to SEQ ID NO: 3832

SEQ ID NO: 21941 - DNA, 201 bp, Homo sapiens
aaaaccatgattaaataatatagatgactatattatataatttaaggtacactggaaacaaagtattgttccattaattaatttcttttttactttttaayttctaaaattataatgattttaaaattatgcttaaatcttgactcattattgactccataattgaaaacattgtcctgaactctgaaggggtaatacttt

SEQ ID NO: 21942 - DNA, 201 bp, Homo sapiens
ttgactaccaattggctggtgccctgggcctttagtctttcatttttactaaattgtatcttggattacttgacatgttgagaataattctttttttttttactgataaagtttttgcatataatgccttaagcttggaattgcttctctccttttctctagctaaggcttcttatttaggtttcagcttacaggccatgt

SEQ ID NO: 21943 - DNA, 201 bp, Homo sapiens
attaagtatcttgactaaagtcaaatggtgagtaattgagttagtaagtgttaagtaaccggaaatactgagatttgcatgcagggtttttttttttttgkttttttttttttttgctttttttccaccacatattgaccctttatggaaagaacactaacataatgactaagaaacttggagctagttatggatttgcca

SEQ ID NO: 21944 - DNA, 201 bp, Homo sapiens
aatctcgttccccagtcatagcctgcaaggatttccccaaaacatctggcttccagagtttatatgaaatccacaaatgaaatcagtcaaagaaatctacyagataattactagccgagttaataaaacctatctaattcactatatattttaaaagatcttatggtcattatttctttgttgtttttatcccataagata

SEQ ID NO: 21945 - DNA, 201 bp, Homo sapiens
ataaggcaaagtacctcttgttttcagtaagatcaagctccgaggtactgggcaatgttctaacttagatattgaaatagagaagatttttagaaatgcamactcagttttatgcaaagatgaagataattcaatgaaacaatctggtcacaaacatattggtatgttctaagttacttgaatgcttgagcagtttagtac

SEQ ID NO: 21946 - DNA, 201 bp, Homo sapiens; identical to SEQ ID NO: 3808

SEQ ID NO: 21947 - DNA, 201 bp, Homo sapiens; identical to SEQ ID NO: 3809

SEQ ID NO: 21948 - DNA, 201 bp, Homo sapiens
tcccatatacttgggaggctgaggctggagtatcacttgagttcaggagttggagtctgcagtgaatgattgtgcccctccactccagcctgggtgacaargtgagactccatctcttaaaaaacacacacacacaaagagagaagaggaacaggactgagttctcagagattccaacattaagagaccaagaaaaagata

SEQ ID NO: 21949 - DNA, 201 bp, Homo sapiens
catagcctgcaaggatttccccaaaacatctggcttccagagtttatatgaaatccacaaatgaaatcagtcaaagaaatctaccagataattactagccragttaataaaacctatctaattcactatatattttaaaagatcttatggtcattatttctttgttgtttttatcccataagataaatcaacacttaataa

SEQ ID NO: 21950 - DNA, 201 bp, Homo sapiens
ggctgcagtttgatgctgtgagctcacacctgccaccctattgggtaagatattcctctcctgagggctgtcacttctgaatgatttgatttcaaagttcrgaagtctcatgtcctcctgtattcattacttctccaaactcttccaaacatatactgagaatattggtttacatttaagatcaccttttcttaacaacag

SEQ ID NO: 21951 - DNA, 201 bp, Homo sapiens
aggatgtcgtgtcacatgtctgtgcctgtaatctcagctacttgagaggctgaggcacaggaacctgggaggtggaagttgcagtgagctaagattgcgcrctggactctagcctggatgtcagagcaaaacgttgtgtccaaaaaaatttaaaaaagcctgcagcttcaaccatcttcagctcttggtattaacagactt

SEQ ID NO: 21952 - DNA, 201 bp, Homo sapiens; identical to SEQ ID NO: 3816

SEQ ID NO: 21953 - DNA, 201 bp, Homo sapiens
gagctagttatggatttgccactagttggttggtatgacttctgccatattgtttaactgggctttagttttcttttctctataaaatgatgggatgagamaatccaagtatgaggtctcttacaaatctgagaggaatttggcataaaaagtaaaataaatctttctgtaagttgcatgggactcagaggtaaagagtct

SEQ ID NO: 21954 - DNA, 201 bp, Homo sapiens
acatgaaaggcaattctgggaactattgttatatttgagatctactgtatttatgagagaggggagagacaacgtaacagggcttctaaacagctgagatrtttaaagttcctttgtgaacttgatttctagttccttagaaattcatctggtagaatgccccagggggccttctaaaggttggtaagaactccttagaat

SEQ ID NO: 21955 - DNA, 201 bp, Homo sapiens
gtcaaatggttatatattttcttcttaatcatcttgatatggtttggctgtgtccccatccaaatcttaccttgaattgtaataatccccacgtgttaagrgtggggccaggtggagataattgaatcatgggggtgggttcccccatactgttctcgtggtagtgaataaatctcgtgagatctgatggttttataaatg

SEQ ID NO: 21956 - DNA, 201 bp, Homo sapiens; identical to SEQ ID NO: 3819

SEQ ID NO: 21957 - DNA, 201 bp, Homo sapiens; identical to SEQ ID NO: 3821

SEQ ID NO: 21958 - DNA, 201 bp, Homo sapiens; identical to SEQ ID NO: 3822

SEQ ID NO: 21959 - DNA, 201 bp, Homo sapiens
agaaaaaaacaccaccacctaccactttgtcacaacaaagcaaatttagacctgttatccttggtaggaactgaagagttaaaaaaatgaagaaacttttraagagagatttagcaaagaattctccaataagattgtttttcagttgcttttctgtctgctgttgaaatttcctggatcaataaggcaaagtacctcttg

SEQ ID NO: 21960 - DNA, 201 bp, Homo sapiens
atgaaaaaatgaagaactagaccaaaagggataaaaaggcattcatttaggattgaacagacatgcatattaatttcagtaaagtttacacttagtagctrtgtggctgtgggcatattacttcagagctcaaagcctcagtttattcacctgtcaaataagggtcatgatgtctagtgtcacattgattaaaataagttt

SEQ ID NO: 21961 - DNA, 201 bp, Homo sapiens; identical to SEQ ID NO: 3825

SEQ ID NO: 21962 - DNA, 201 bp, Homo sapiens
gttaataaaacctatctaattcactatatattttaaaagatcttatggtcattatttctttgttgtttttatcccataagataaatcaacacttaataagraccagaagtactgcttccagagatgaaaggaatacattttcaacagatccagtcaattttccaaataaagcagaggggttagagaagaagcaaatccatg

SEQ ID NO: 21963 - DNA, 201 bp, Homo sapiens
ggtatttagagaattaagccatggtacaaacctaacctattgactataaatctgtatgaataacctccagctgattttcatttctaaaaattactgtggaygtgttaacacaattacaaatcacatagagttgctaagataaatttcagtttcacaaactatatttgaaaaacaaaatatagtctatcaacctcacctttt

SEQ ID NO: 21964 - DNA, 201 bp, Homo sapiens
atattttgccattaatccaatatgtttccatcactttgccaaaacctatttaaaacagtgaattaaattttcactaggtttgaatgatcatgttttataasaaatgtctttattttagtgtgttaaaaccttattaaacaaacaactgtttaaaaagcataacatttttattttgtgtcacttctacattttttaaatgca

SEQ ID NO: 21965 - DNA, 201 bp, Homo sapiens
aacatgatcaattttgtaataagcagaagttgttaacatagaaataattaatgtttcctacctaaaacaacatctaggcttcctttaagttaaaaaaaaaagtaaatttaaattcattgaagtatggagaggtaatcctcatgagtgaaaattaattgttttatagacttagtagcagaagagcaatccatatacaattta

SEQ ID NO: 21966 - DNA, 201 bp, Homo sapiens; identical to SEQ ID NO: 3831

SEQ ID NO: 21967 - DNA, 201 bp, Homo sapiens
cagttaaatctgaaacatactggtgggagtagcatggatgctatcatatgcaaggcctttagggggaggctagcagggttgcaggctagcatagttgacaygccattggacctatttatagagctgagttctttttgcaatgtcaactgtaacattatacctattttaagcctcagtatctcaaatgtcagcctctactag

SEQ ID NO: 21968 - DNA, 201 bp, Homo sapiens; identical to SEQ ID NO: 3833

SEQ ID NO: 21969 - DNA, 201 bp, Homo sapiens; identical to SEQ ID NO: 3834

SEQ ID NO: 21970 - DNA, 201 bp, Homo sapiens; identical to SEQ ID NO: 3835

SEQ ID NO: 21971 - DNA, 201 bp, Homo sapiens; identical to SEQ ID NO: 3836

SEQ ID NO: 21972 - DNA, 201 bp, Homo sapiens
agcatggatgctatcatatgcaaggcctttagggggaggctagcagggttgcaggctagcatagttgacacgccattggacctatttatagagctgagttmtttttgcaatgtcaactgtaacattatacctattttaagcctcagtatctcaaatgtcagcctctactagtcgtacagttctctcttatttgatatcaga

SEQ ID NO: 21973 - DNA, 201 bp, Homo sapiens
agggtctccctatgttgccgagggtgatcttgaactcctgggctcaaatgatccaccctcctcagcctcccaaagtgttgggattacagacgtgagccacygctctcagccccttacacttttttgaagttcagttctcccatctgtaaaaacgaggtaataatattgcctcaaatgacttaatggatgtgaaagggttta

SEQ ID NO: 21974 - DNA, 201 bp, Homo sapiens
gtggggagctcagagctgagatcctacaggagtccagggctggagagaaaacctctgcgaggaaagggaaggagcaagccgtggtaggtcgggtttctgtrccttggggtctgtctcctcttctttctcttaaaagtctttccagcaagctgagccagtgaaggaatgctttaaccaagggaccaactttgtaattcaggc

SEQ ID NO: 21975 - DNA, 201 bp, Homo sapiens
ataagaagataaaaaggaaaccttaaactctcttatcatttaggaatcctgatggggatgccaagccctggtgccacgtgctgaagaaccgcaggctgacrtgggagtactgtgatgtgccctcctgctgtaagggctgggccccggctgcctccctgcacctggtctcccttcttcaccatctcctcgccactttctagg

SEQ ID NO: 21976 - DNA, 201 bp, Homo sapiens
gggaggacggggcagagaggggagcctcctgagggctgaatgaaaggggactcccatgtgaggcatccatgccctgctctctgtcagataccagggccacrtgctacgaggaccagggcatcagctacaggggcacgtggagcacagcggagagtggcgccgagtgcaccaactggaacagcagcgcgttggcccagaagc

SEQ ID NO: 21977 - DNA, 201 bp, Homo sapiens
cttgggccagttacccgagggggtctctgagcagaggtatctggccggcaggttcacatgggcttctgggttggccgcctttactcttagtacacctggcwtgtgctgatccttcctccacctctggtttcttcgcaggaaatccatgcccgattcagaagaggagccagatcttaccaaggtcgggtgaagctgaggggt

SEQ ID NO: 21978 - DNA, 201 bp, Homo sapiens
cttaagggctgatggctttgatcgaatttcaggcatgttggccccaaggccctgtgtatattccctgggcccactcaaggggatgctggagccggaaagtycccggaggccacctactgcagccctgcactttacaaagaagagaaagattctccctaaaattacagaacagggccaaagatgcctaccggagcaaacccc

SEQ ID NO: 21979 - DNA, 201 bp, Homo sapiens
ctaaaaaatgaaactttagtttggaaatggccagagagtaggttattaatcacctcctgtgaacacagatcagccagaatgttccccaaggaacacaagtycaactgggacgatgagacacagaccaccagctaactcacacccaagggcattagtgtgagtcctcagtggtccgtgtccctaagctcctcagagctgagc

SEQ ID NO: 21980 - DNA, 201 bp, Homo sapiens
gggagggaggcagggcggggtgcagggtgcatcacccacccaccacctgccttcttccacccaccacctgcctacggtgtgacagtgccattgcagcatgrttctacagagatgcctgtgtcggcaccattctcccatcagctgcggccactgggcgggttctgattctgaggggagcagaaacaggtgttcccccccaag

SEQ ID NO: 21981 - DNA, 201 bp, Homo sapiens
aggcagatagagggggatgtaatacacaggcactgagacagcaccccactgactttcccctgtccctcctccagctggcctcctcctttccaggggctgtrcccaatccagaatcagttactcactggtgcccatcgaccatcatttccccatgtggccaccaaagaaatgaacaccacctttctggttggcatgatcatc

SEQ ID NO: 21982 - DNA, 201 bp, Homo sapiens
caaactaaccacacctctcccacaggaccctacagcggggagagccaggtgactgcgtggagtagacagccagctgcaactccattgcccaatatggtggycacttaccttgtgcaactgtttaaatttaaaataattaaagttaaaaattgtttctcagtcccactggccacattcaaagcactcggtggccctgtgtgg

SEQ ID NO: 21983 - DNA, 201 bp, Homo sapiens
actctgcaggaagcatgtggggttctccagattttcactgttattatctttattttcttaacctcacagggagggagagaggaagggagggagggaagacsaaaacacgccgaggtcccaggtaactaatgacaactcaagctcaaagaagtgtggtaacaaggatgtgtttggtggccaattgggaataatatggtggtc

SEQ ID NO: 21984 - DNA, 201 bp, Homo sapiens
ggtgcacgcctgtggctccagctacttggaacactgaggcaggagaatcgcttgagcctgggaggcagaggttgcagtgagctgaaattgtgtcactgtaytccaccctgggcaacagagcaagactctgtcaagaaaaaaaaagaaagaaagaaagaaaaaaaaaaaaacactgaggaccagtgcgaaggaacccccagc

SEQ ID NO: 21985 - DNA, 201 bp, Homo sapiens
gccagggagtagcacagctgcttcctcccggggagaaagggacacccaaagagcgcactccagggagaccttgggcactgcgggctcaaaggctggagatkgcacttctgttccctcctgatgggacaggtgcagggaggctgagaggatgccacgctggcgagcctccctctgagctgtgttttctcattggaattgctg

SEQ ID NO: 21986 - DNA, 201 bp, Homo sapiens
aaaagggagataacacagaacaaaattagaagtctatttataaaaatgagcctcttccatcccttccgccaatgtcatctctcacccgggtctcgccagarcactcatggacctccctttggtgaggcccaaagtccatcccagccacgccctgcggtcccgagtctgagtccattgttctggctttcactctgctctgca

SEQ ID NO: 21987 - DNA, 201 bp, Homo sapiens
ttttcgaaaagttaagaattacttatgtgatggtagtttttgaaagtggtttttattctgagatcatggcctctgtactatgcagggcctggagaagtggratgagagctaccaggctcaaagctcctgtcccgaacaaagggttgctttcgtgggagcacgccaccctttccaaggctagttcctctcccagcatctcac

SEQ ID NO: 21988 - DNA, 201 bp, Homo sapiens
tattttttggtgaattacaatgagaaaaagtccaggtgcaatggctcacatctgtaactccagcactttaggaggcggatccaggaggatggctttagccyaggagttcaagaccagcatgggcaacatagtgagacacctctgcctcccccaccccaccccgcctctacaaaaaaatttaaaaattagctgggtgtggtg

SEQ ID NO: 21989 - DNA, 201 bp, Homo sapiens
tctacagagatgcctgtgtcggcaccattctcccatcagctgcggccactgggcgggttctgattctgaggggagcagaaacaggtgttcccccccaaggrgccaggctgtcagggatcacaacctagcgggggctggggggggcggccactggcccaaggtcctggttatacagatcaaaaggcagagcccaggagagag

SEQ ID NO: 21990 - DNA, 201 bp, Homo sapiens
aatcagctcaaggcgcaggaaggtccagggaagccaaggaagagaagagacaagtctccaactctctcaggagcaaagacaaaaatatgctcctgctctcytatctcttattcagaccgttcagttgcaaaagggttgaacatgatgcagcgggtggtatgtgtggaccagccctaggtcgtgcttctcctccatctggtc

SEQ ID NO: 21991 - DNA, 201 bp, Homo sapiens
atgtagcgaggcaaggagggtgatcagcacctcccacgggggagttcgtttcgaagtaacaatcaaagatccagagccggacccaggcagggaggcaaggyctggaagcccctgtgcctccaggcccctaggacgctcgggggagggggagggggagggtgggacctgaagttgttgtgaccgaagggaaatgagtcaggg

SEQ ID NO: 21992 - DNA, 201 bp, Homo sapiens
aggaaatttgaggaaagctgagaaagagaagatctggagtaagtctctgtgatgagaagattccaccccgcactcctgttctgggtggccttggctcctgrctccctttcttctgaaactgcctggagccagggagtagcacagctgcttcctcccggggagaaagggacacccaaagagcgcactccagggagaccttgg

SEQ ID NO: 21993 - DNA, 201 bp, Homo sapiens
ttacaggggaaaaaactgacattaatgtcttttattcctaaagcactctgcaggaagcatgtggggttctccagattttcactgttattatctttattttyttaacctcacagggagggagagaggaagggagggagggaagacgaaaacacgccgaggtcccaggtaactaatgacaactcaagctcaaagaagtgtggt

SEQ ID NO: 21994 - DNA, 201 bp, Homo sapiens
caggaagcatgtggggttctccagattttcactgttattatctttattttcttaacctcacagggagggagagaggaagggagggagggaagacgaaaacmcgccgaggtcccaggtaactaatgacaactcaagctcaaagaagtgtggtaacaaggatgtgtttggtggccaattgggaataatatggtggtctcctgt

SEQ ID NO: 21995 - DNA, 201 bp, Homo sapiens
ccgggaaggggtcttgcaaataccattgtcaggtggagtcccctcaaaggtgacttcctagcagtacttgctgtggcaagaacgctcattctgggatctaractcaatccatgacggtcagcatgagctgctgggtgcgtgcttcctgtgcaggcagagtcggactccagcactggcagggacactgtgagtattgagata

SEQ ID NO: 21996 - DNA, 201 bp, Homo sapiens
ctttgagttcttgaaataaagaagtaacttggtgggcatctggaaaaaacacccaaactgtatcccaggctggggtgcaggagcctatcgagagggctggktggtgtggacagcgtgatgaagaaggtcaagttccttgtactcactcgtttgctgtttcattcacaattcctgtgaggtgggagctctcaccatccttgg

SEQ ID NO: 21997 - DNA, 201 bp, Homo sapiens
tagcagtacttgctgtggcaagaacgctcattctgggatctagactcaatccatgacggtcagcatgagctgctgggtgcgtgcttcctgtgcaggcagartcggactccagcactggcagggacactgtgagtattgagatatgaatagctccatcctgcccacccatttattccacctaaaatgttctcaaagatgcaa

SEQ ID NO: 21998 - DNA, 201 bp, Homo sapiens
ctcctcttctttctcttaaaagtctttccagcaagctgagccagtgaaggaatgctttaaccaagggaccaactttgtaattcaggcaactagaggatccrctagaatccactccagaggggagatgtctgtttgcatttgcatgtgattgggataggctggagtgttttggaggggagaggcagtcggggaaagggagac

SEQ ID NO: 21999 - DNA, 201 bp, Homo sapiens
tgtgatgcggacagagctatcgccctgctggggtgagattcacttgcattgaatcagctcaaggcgcaggaaggtccagggaagccaaggaagagaagagmcaagtctccaactctctcaggagcaaagacaaaaatatgctcctgctctcttatctcttattcagaccgttcagttgcaaaagggttgaacatgatgcag

SEQ ID NO: 22000 - DNA, 201 bp, Homo sapiens
tgcattgaatcagctcaaggcgcaggaaggtccagggaagccaaggaagagaagagacaagtctccaactctctcaggagcaaagacaaaaatatgctccygctctcttatctcttattcagaccgttcagttgcaaaagggttgaacatgatgcagcgggtggtatgtgtggaccagccctaggtcgtgcttctcctcca

SEQ ID NO: 22001 - DNA, 201 bp, Homo sapiens
atgaaagctgcccttgtctccaaaatgctccttctctgcccgactccccaagaccagcttggtttatttcacaatgactcgcgtcggattctcccagtgtytgcggctccccctgcttcatcacaggcctgggacagtccaggcagccagggaatagctgggaatagcagttcccctttgttggtttttgagttcactgag

SEQ ID NO: 22002 - DNA, 201 bp, Homo sapiens
ttcacttgcattgaatcagctcaaggcgcaggaaggtccagggaagccaaggaagagaagagacaagtctccaactctctcaggagcaaagacaaaaataygctcctgctctcttatctcttattcagaccgttcagttgcaaaagggttgaacatgatgcagcgggtggtatgtgtggaccagccctaggtcgtgcttct

SEQ ID NO: 22003 - DNA, 201 bp, Homo sapiens
ttggtttttgagttcactgaggctttgatttcccccagggcctgacgttgctgagcagagccagcggccagtagatttcaaaggattccaaaaaacagtcwggcactcctttgtgaacccaaaagtatctgagacaggtctgtcaatttagaaagtttattttgccaatgttaagaacacacatgtgacacggcctctgga

SEQ ID NO: 22004 - DNA, 201 bp, Homo sapiens
gccatttgtaagagtttcccagtttatactgcatgtgacactccccatgtcgtatgttctcacaacagaacagaaaccgcaggatgtcagcaccggaggcraccttggagcatccagcccacttggttttgcattgctggcaggagattttatgcctcaaaatatagatgctttttggaaggacagcacattaattatttt

SEQ ID NO: 22005 - DNA, 201 bp, Homo sapiens
ccaaggtatggcttggtttcatacatttcagggagacatgagacattaatcaatgtatgtaagatgtgcaccggttcggtctggaaaggcaggacaactcsaagtaggggcttccaggtcataggtagataagagaaggcttcattcttctgagtctttgtcagcctttcactgaatacacaatttacatatgagaggggg

SEQ ID NO: 22006 - DNA, 201 bp, Homo sapiens
catttcagggagacatgagacattaatcaatgtatgtaagatgtgcaccggttcggtctggaaaggcaggacaactcgaagtaggggcttccaggtcatargtagataagagaaggcttcattcttctgagtctttgtcagcctttcactgaatacacaatttacatatgagaggggggcagaggaagagtcacttatgcc

SEQ ID NO: 22007 - DNA, 201 bp, Homo sapiens
atgagaggggggcagaggaagagtcacttatgccttagttggctcagtgaatctacttttttttttgagacggagtttcactctttttgcccaggctagartgcaatggcatgatcccggctactgcaacctccacctcccaggttcaagtgattctcctgcctcagccttctgagtaactgggattacaggcgcctgcca

SEQ ID NO: 22008 - DNA, 201 bp, Homo sapiens
ctgctccaaccctaagtcaagccacatggtcttccgatagtggctcagttttctacttacataaaaagacagcacattctcttagcaatatgtgtttgtatgtgtgtgtgtgtgtgtgtgtgtgtgtgtgtgtgtgtatatatatatatatatatatataatttagagacaaggtctgactccatcacccaggctggagtg

SEQ ID NO: 22009 - DNA, 201 bp, Homo sapiens
aaagagtgttagatttggggtaagagaactgtgtctcctgggcttgagtcctgatgccaactctcacaagatgtgtcaccgtacagcacgacgcttatactttttttttttttttttttgagacaggatcttgctctgtctcaagctggagtgcagtggtatgatcacagctcactgcagcctcaaactcccaggctcagg

SEQ ID NO: 22010 - DNA, 201 bp, Homo sapiens
cttgagtcctgatgccaactctcacaagatgtgtcaccgtacagcacgacgcttatactttttttttttttttttttgagacaggatcttgctctgtctcragctggagtgcagtggtatgatcacagctcactgcagcctcaaactcccaggctcaggccatcctcccacctcagcctcccaagtagctgggactacagg

SEQ ID NO: 22011 - DNA, 201 bp, Homo sapiens
gatgtgagccaccacaccttgcaaatttttgtattttttgtacagccgagggtctccctatgttgccgagggtgatcttgaactcctgggctcaaatgatycaccctcctcagcctcccaaagtgttgggattacagacgtgagccactgctctcagccccttacacttttttgaagttcagttctcccatctgtaaaaac

SEQ ID NO: 22012 - DNA, 201 bp, Homo sapiens
gggacacccaaagagcgcactccagggagaccttgggcactgcgggctcaaaggctggagatggcacttctgttccctcctgatgggacaggtgcagggargctgagaggatgccacgctggcgagcctccctctgagctgtgttttctcattggaattgctgtacccggagcctcctgcaggtttccctcgccctctccc

SEQ ID NO: 22013 - DNA, 201 bp, Homo sapiens
tgggcacaacccaggggagaatgcccctgggacaacaggttcttcaccaaagaaaaaagttatcaccagagtggagtgatttcctcttagtgatacccctrgggattctagatgagggcctcacagaataaagcaactggaggaagatcaaagtcacctaaacctaagaattctaaactgcaggaaatttccccaggatct

SEQ ID NO: 22014 - DNA, 201 bp, Homo sapiens
gcacatagagcacattcttaatattttaactcacatcatccttggagctgctttgaaaatacaggggacccttgaacaacacttgtctgacctgcagggtycacttatgtatggatttttttcaaccaaaggcaggatgaaaacagtatttgtaggatgcagaactggtatacgcgtgttccacgctgcaggacttgagtg

SEQ ID NO: 22015 - DNA, 201 bp, Homo sapiens
ctgaggggagcagaaacaggtgttcccccccaaggagccaggctgtcagggatcacaacctagcgggggctggggggggcggccactggcccaaggtcctrgttatacagatcaaaaggcagagcccaggagagagcaagtggcttgcccagggtcacacagccgccagcagcacggccagggcagtcacagccgaggcca

SEQ ID NO: 22016 - DNA, 201 bp, Homo sapiens
atcatggcctctgtactatgcagggcctggagaagtgggatgagagctaccaggctcaaagctcctgtcccgaacaaagggttgctttcgtgggagcacgycaccctttccaaggctagttcctctcccagcatctcacttcagctctcgtcctgctctagaaacgtgcctttgctggtccaaggaatcctggccgtttct

SEQ ID NO: 22017 - DNA, 201 bp, Homo sapiens
gaaaacattagaaggaatgaaggatggcagatccccagttttggagtcaaacatacttgggaactaatccaggtgccattgcaaccttgggcaaaaacgtytccgcctcctgaaacttatcgctgtgggaactaaagagaatgtatggacaacattcggcatgctgatcccaccaagtgaaagttgtggttttacagccat

SEQ ID NO: 22018 - DNA, 201 bp, Homo sapiens
tggtagtttttgaaagtggtttttattctgagatcatggcctctgtactatgcagggcctggagaagtgggatgagagctaccaggctcaaagctcctgtyccgaacaaagggttgctttcgtgggagcacgccaccctttccaaggctagttcctctcccagcatctcacttcagctctcgtcctgctctagaaacgtgc

SEQ ID NO: 22019 - DNA, 201 bp, Homo sapiens
tgcctgtaatcccagcactttgggaggctgaggcaggaggattgcttgagcccaggagttcaagaccagcctgggcaacatggcaagaccccatctctacwaaaattaaaaaataagaagataaaaaggaaaccttaaactctcttatcatttaggaatcctgatggggatgccaagccctggtgccacgtgctgaagaac

SEQ ID NO: 22020 - DNA, 201 bp, Homo sapiens
gaaaatcaccttttcgaaaagttaagaattacttatgtgatggtagtttttgaaagtggtttttattctgagatcatggcctctgtactatgcagggcctrgagaagtgggatgagagctaccaggctcaaagctcctgtcccgaacaaagggttgctttcgtgggagcacgccaccctttccaaggctagttcctctccc

SEQ ID NO: 22021 - DNA, 201 bp, Homo sapiens
agtcccagctacttgggaggttgacgcaggaggactgcttgagcctgggaggcagaggttgcagtgagccaagacagcaccattggactccagcctgggtracagagaccctcgaaaaaaaaaaagaaaaagaaaagaaaagaaaaaattaggctgggcacggtggctcatgcctgtaaccccagcactttgggagaccga

SEQ ID NO: 22022 - DNA, 201 bp, Homo sapiens
ccaggcctgttcggccttaggcggaggtgaaggtacaagcagaaaagggagcaagaccaagtgaccttgggcaaatgcccgcttgcctcagtttcctcatstgtaaagaggtgggaataacagtacacacttcatggtttgctgtgaggattaaattagctaatttttgtagactgtacaacagcgcctggcacatagagc

SEQ ID NO: 22023 - DNA, 201 bp, Homo sapiens
gataggtgatagatagatgatagattgatagatgattgatagataaatagatgatagatacatagatgatagatggtagatagatgatagatggatagatdatagatgataggtggtagatgatagacagatgattagaaagatagatgatagatacatagatgatagacacatagatgatagacagattgacagatgata

SEQ ID NO: 22024 - DNA, 201 bp, Homo sapiens
aaagatagatgatagatacatagatgatagacacatagatgatagacagattgacagatgatagatgattgatagatgattaaatagatgatacatagatdataatgataaatagatgatagatgatagatgataggtgatagatagattgatagatgatagaagattgatagatgatagatacataggtgatagtagatg

SEQ ID NO: 22025 - DNA, 201 bp, Homo sapiens
catggaaccaaacagctcgatggagacaccctgcactgcttatggtgatgctgcaggaatggcggcagcgatgcccgctacactccatggcctgctgcacrtgtgacaggacagttatttcatctatgcttacacctgcaggtcccttaccctagaaacactctatatcttcttaggtacttcccttgaaacaggatgagt

SEQ ID NO: 22026 - DNA, 201 bp, Homo sapiens
atagatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagatag

SEQ ID NO: 22027 - DNA, 201 bp, Homo sapiens
caacacaactctgcagcaaaaactagtcccaaagtcagaagataaaactagcaaaaactttgcacaatatttagagaaaagctctagggtgtggagagtaygggtcttcctttttctccatgcaccaagcagagcacagtatcattccttaagctataaacaaaaacccttttgtataaatatttaaatagtaacagacac

SEQ ID NO: 22028 - DNA, 201 bp, Homo sapiens
tagatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagataga

SEQ ID NO: 22029 - DNA, 201 bp, Homo sapiens
gctacaggggcacgtggagcacagcggagagtggcgccgagtgcaccaactggaacagcagcgcgttggcccagaagccctacagcgggcggaggccagaygccatcaggctgggcctggggaaccacaactactgcaggtgagggcacatccccaaggagggattccccctgtgagaagctgctacagctggggaaagat

SEQ ID NO: 22030 - DNA, 201 bp, Homo sapiens
agatgattgatagatgattaaatagatgatacatagatgataatgataaatagatgatagatgatagatgataggtgatagatagattgatagatgatagaagattgatagatgatagatacataggtgatagtagatgtaagatgatagatgatagatagatagatgatagacagattgatagatgatagagagatagag

SEQ ID NO: 22031 - DNA, 201 bp, Homo sapiens
gggccccggctgcctccctgcacctggtctcccttcttcaccatctcctcgccactttctaggccttcatggctgtctggtgcagactgtgtgcctaccaracttccaggctgggtggggagggggcttccatgactgaagccacggtgggtgggcgggtgtccatgacccatgcatgggggtggtggggaggggcaagaa

SEQ ID NO: 22032 - DNA, 201 bp, Homo sapiens
ggaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatg

SEQ ID NO: 22033 - DNA, 201 bp, Homo sapiens
agcgggcggaggccagatgccatcaggctgggcctggggaaccacaactactgcaggtgagggcacatccccaaggagggattccccctgtgagaagctgytacagctggggaaagattctgtcagatccgtcagggttctcccaagaaacataaccaatacaggatggatagatggatagatgatagacagataatagat

SEQ ID NO: 22034 - DNA, 201 bp, Homo sapiens
acgctgtggggatagggaggaagaacctcgcatgaccttgctaacacagcaacatcccaaccgttggttcggcctagaagctggtatttgggccatctgtytcccattgtcttaattttctgctcattagaaattgaacccctaaaccagtccacacaagtacgttatctaagtaatgttgcattctgcttctcttagact

SEQ ID NO: 22035 - DNA, 201 bp, Homo sapiens
gaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatga

SEQ ID NO: 22036 - DNA, 201 bp, Homo sapiens
caattaagaaacgtttgcctcagcctggtgtggtggttcacgcctgtaatcccagcactttgggaggctgaggtgggaggctcacctgaggtcaggagttsgagaccagcctgaccaacatggagaaaccccatctctactaaaaatacaaaattagcctggcatggtggcacatgcctgtaatcccagctactcaggagg

SEQ ID NO: 22037 - DNA, 201 bp, Homo sapiens
gctggaagtgcaggcagaagctgaggctgctctcttaaggcagaatttcttattcaggaaacctcatatttgctcttaaggcctttaagtgattggacgargcccaactacattatctaggacaatttccttttctaaagtcaactggctgtagatattaaccacatctataaaacactttcacaactcctagatgaatgt

SEQ ID NO: 22038 - DNA, 201 bp, Homo sapiens
tcatgacgttggggtcctgagatttattttcctttcacactagatagatagacatttatgttaaggaactggctgacaggatcgtgggggctggcaagtcygaaacatcttggtaagccaggctggaagtgcaggcagaagctgaggctgctctcttaaggcagaatttcttattcaggaaacctcatatttgctcttaag

SEQ ID NO: 22039 - DNA, 201 bp, Homo sapiens
cactgcttccaggagaggtaggggctcggaaacccagttggtttttccaccctctaacgcctagaaaccaagccctttaggggaaatcccacagcaaaaawagcattctaaggctgtttctccaccaggtttccgccccaccacctgacggtgatcttgggcagaacataccgggtggtccctggcgaggaggagcagaaa

SEQ ID NO: 22040 - DNA, 201 bp, Homo sapiens
atcaatgttagctattattggaaaatttggctttctctttcaaaaacgtttataaataactttccctaaaaccatatgatggttctcccctttcagtgtcycctttctattcggagcggctgaaggaggctcatgtcagactgtacccatccagccgctgcacatcacaacatttacttaacagaacagtcaccgacaaca

SEQ ID NO: 22041 - DNA, 201 bp, Homo sapiens
aactggtgttgctgtgtttcagttctgtccagttctccctggtgaccttttcctcccttgattagttccatggcactgaaggctaaggaaaaaagggagcrggtgggtccaggaggggactgacctaggagacaggctgatatttttttttacttttagacaagtaagaaatgaaaaaatgtgcaagactattccctcagc

SEQ ID NO: 22042 - DNA, 201 bp, Homo sapiens
attctgaggggagcagaaacaggtgttcccccccaaggagccaggctgtcagggatcacaacctagcgggggctggggggggcggccactggcccaaggtyctggttatacagatcaaaaggcagagcccaggagagagcaagtggcttgcccagggtcacacagccgccagcagcacggccagggcagtcacagccgagg

SEQ ID NO: 22043 - DNA, 201 bp, Homo sapiens
gggttctgattctgaggggagcagaaacaggtgttcccccccaaggagccaggctgtcagggatcacaacctagcgggggctggggggggcggccactggyccaaggtcctggttatacagatcaaaaggcagagcccaggagagagcaagtggcttgcccagggtcacacagccgccagcagcacggccagggcagtcac

SEQ ID NO: 22044 - DNA, 201 bp, Homo sapiens
ctcctgccgtgcacccaggtgtgggggaaggactttcctgcttcttttccagttaccttacaattcagcaagacggaaatgattagcccatgacaaaaacyaggaaacaggctcagagagagtgagttgcccacacagaatgtgtgctgtaaatgcagttagatttccaggttgagaatccagtgaccacgccccttcttt

SEQ ID NO: 22045 - DNA, 201 bp, Homo sapiens
ttccagggagaagcgggaagcctcagtgcttttgttgaggaaggatgttcatgacagtaggtgcaggtcgctcctgccgtgcacccaggtgtgggggaagractttcctgcttcttttccagttaccttacaattcagcaagacggaaatgattagcccatgacaaaaaccaggaaacaggctcagagagagtgagttgcc

SEQ ID NO: 22046 - DNA, 201 bp, Homo sapiens
cagtacttgctgtggcaagaacgctcattctgggatctagactcaatccatgacggtcagcatgagctgctgggtgcgtgcttcctgtgcaggcagagtcrgactccagcactggcagggacactgtgagtattgagatatgaatagctccatcctgcccacccatttattccacctaaaatgttctcaaagatgcaagcc

SEQ ID NO: 22047 - DNA, 201 bp, Homo sapiens
ctcctctagcttgctcacgtttctgccttcttcttgctggcaagagtacagactataattctccagttcactaacatctggagcgactgcactgtttgcartttcattgattgactacatgtgtacagttcctttattgcaagtcacttttctgtataatcttttttgagacgaagtcctgctctgtcgcccaggctgcag

SEQ ID NO: 22048 - DNA, 201 bp, Homo sapiens
atgggataaaatttaaaaggggaatttaagaggaattttgggcagttttgagaaacaggaaatttgaggaaagctgagaaagagaagatctggagtaagtytctgtgatgagaagattccaccccgcactcctgttctgggtggccttggctcctgactccctttcttctgaaactgcctggagccagggagtagcacagc

SEQ ID NO: 22049 - DNA, 201 bp, Homo sapiens
aaatctgcaaaaatcaactttgtgtgctagggtggcctgacagggctaggccttggggtcttggggaccagcattccacctctcctctcatacagtgattytggattccagcccagcaaaagtcagccaaccttggggccttcctttctttcatcctttcttttttttccttttctatccttctgtgcctcccttcctacc

SEQ ID NO: 22050 - DNA, 201 bp, Homo sapiens
agcacagatatgctggctgtgtcctacacacaggtgcctacacacacatccttcagatccgggctgcactctatcagccaacccacggactctgttttttytaatttgcacagattctttgtcaacctgccatgccctgagactgctgaacttcatccaacagagagggtaccttttgcaaatctgcaaaaatcaactttg

SEQ ID NO: 22051 - DNA, 201 bp, Homo sapiens
tgaacccgggaggcagaggttgcagtgagccgagatcgcgccattgcgcttcagcctgggcaacaagagcgaaactcgatctcaaaaaaaaaaaaaaaaaraaaagaaagaaatgtttgcctctgttggcactagagaattggagtctgctttgtagaaggagaaggaagaaaggcaacttactgggaagcaggatctaga

SEQ ID NO: 22052 - DNA, 201 bp, Homo sapiens
gaggtggagggtgcagtgagctgagattgcgccactgcactccagcctgggtgggtgacagagtgagactctgtctcaaaacaaaaaaacaaaaaaaaacmaaaaaagaagagtgaagttcttgtggcaatatttctagtcataaaaacatcagcaaacttctaaataaagacccaaaacacttctaacattcaatattga

SEQ ID NO: 22053 - DNA, 201 bp, Homo sapiens
taacattcaatattgaaataaatgtgagctatacaacatttaagaaaggttaataaaaacaaacatggtatttatttacccaatttttggagaataagtgratgatggcggccataatagtggtgggttaattcagggaataaatgtttgcaaagcaaaaatggtaaggaacacctcttactaccatgaagttcaaaaaca

SEQ ID NO: 22054 - DNA, 201 bp, Homo sapiens
taaaaacaaacatggtatttatttacccaatttttggagaataagtgaatgatggcggccataatagtggtgggttaattcagggaataaatgtttgcaargcaaaaatggtaaggaacacctcttactaccatgaagttcaaaaacaatcacaaatagggcaggctccctgactgcctccacacctcacagtttatcatg

SEQ ID NO: 22055 - DNA, 201 bp, Homo sapiens
cttggttttgcattgctggcaggagattttatgcctcaaaatatagatgctttttggaaggacagcacattaattatttttcagtcatttttaccttatgygaacaagctgattagttcctttcctaggagctggtttttatggagggaagatggggccggtagaggcagatagagggggatgtaatacacaggcactgag

SEQ ID NO: 22056 - DNA, 201 bp, Homo sapiens
aacaaacatggtatttatttacccaatttttggagaataagtgaatgatggcggccataatagtggtgggttaattcagggaataaatgtttgcaaagcaraaatggtaaggaacacctcttactaccatgaagttcaaaaacaatcacaaatagggcaggctccctgactgcctccacacctcacagtttatcatgcatt

SEQ ID NO: 22057 - DNA, 201 bp, Homo sapiens
actgcactgtttgcaatttcattgattgactacatgtgtacagttcctttattgcaagtcacttttctgtataatcttttttgagacgaagtcctgctctrtcgcccaggctgcagtagcgcaatcttggctcactgcaacttccgcctcccgggttcaagcgattctcctgcctcagcctcctgagtagctgggattata

SEQ ID NO: 22058 - DNA, 201 bp, Homo sapiens
acaaacatggtatttatttacccaatttttggagaataagtgaatgatggcggccataatagtggtgggttaattcagggaataaatgtttgcaaagcaaraatggtaaggaacacctcttactaccatgaagttcaaaaacaatcacaaatagggcaggctccctgactgcctccacacctcacagtttatcatgcattc

SEQ ID NO: 22059 - DNA, 201 bp, Homo sapiens
ctgccttcttcttgctggcaagagtacagactataattctccagttcactaacatctggagcgactgcactgtttgcaatttcattgattgactacatgtstacagttcctttattgcaagtcacttttctgtataatcttttttgagacgaagtcctgctctgtcgcccaggctgcagtagcgcaatcttggctcactgc

SEQ ID NO: 22060 - DNA, 201 bp, Homo sapiens
agatcatggcctctgtactatgcagggcctggagaagtgggatgagagctaccaggctcaaagctcctgtcccgaacaaagggttgctttcgtgggagcasgccaccctttccaaggctagttcctctcccagcatctcacttcagctctcgtcctgctctagaaacgtgcctttgctggtccaaggaatcctggccgttt

SEQ ID NO: 22061 - DNA, 201 bp, Homo sapiens
acagctcactgcagcctcaaactcccaggctcaggccatcctcccacctcagcctcccaagtagctgggactacaggcatgtaccaccatgcccaaataawtttttgtatttttttgttgagatggggttttgccatgttacccagggaggtctcaaactccaaggatcaagccacccaccctccttggcctcccaaagtg

SEQ ID NO: 22062 - DNA, 201 bp, Homo sapiens
ggctcatgacgttggggtcctgagatttattttcctttcacactagatagatagacatttatgttaaggaactggctgacaggatcgtgggggctggcaaktccgaaacatcttggtaagccaggctggaagtgcaggcagaagctgaggctgctctcttaaggcagaatttcttattcaggaaacctcatatttgctctt

SEQ ID NO: 22063 - DNA, 201 bp, Homo sapiens
tgaaaacagtatttgtaggatgcagaactggtatacgcgtgttccacgctgcaggacttgagtgtgtgtggattgtggtagacagggctcctggaaccatrgcctgagcacacagaaggaggctgtcattaggggcttccttttttatacttgacaggttgcagcgagccaaggtgtttcaacgggggcacctgccagcag

SEQ ID NO: 22064 - DNA, 201 bp, Homo sapiens
aactttgcagctatcttattgaggaataaatgagaggcaggtttgcctgacgtagttcccggcttgacatttcccttggctcatgacgttggggtcctgaratttattttcctttcacactagatagatagacatttatgttaaggaactggctgacaggatcgtgggggctggcaagtccgaaacatcttggtaagccag

SEQ ID NO: 22065 - DNA, 201 bp, Homo sapiens
aagagaaacccgttgtattttatcttgttgtagcaagagccggtgtctaacacctgggctactgagagaaagcgaagggtttttttctgggaagctccaayttccttatttctctcacatgatgcctctgactttcatagtgtggcttggtcagatgggccttatcaatagagatggcctgatgtctcagctgtgtcatct

SEQ ID NO: 22066 - DNA, 201 bp, Homo sapiens
gctctcgttcgaatacccatcctgccacctgccccagtgagaagggttggagcagcccctgttctctgcccccgccacctccatgactcatgcattctgtrggggaggcgcccactgcagaaacagccaggctggctgggaaaagccctgcagcaattccccgtccagtttctctgtgcccactttgtctccgtgttatct

SEQ ID NO: 22067 - DNA, 201 bp, Homo sapiens
ctgtgtccatctgggccacggaggttggaatgctgtcagggagcagagaggcacagggacgaggggctggcattgctgtggagcacacagcacacactccyttctgtacagcaaactctgtatttgggggcccagtgtgtagctgggccctaggcacttattttgacctgagtaagcggaattaacatgccactccctgcc

SEQ ID NO: 22068 - DNA, 201 bp, Homo sapiens
ggtgagagcacgtgaaacgagctgaaatcccacctctccagtctcccccgcccccggaaggaaaggcagggtgcgatggcagggccaggggtgggggccarggacagggaaggcgcttctgccatgggtcaggaagcacagtgccacacagcaagcagagcctaggtgtgaccctgaatccaggctggcacccttgccacc

SEQ ID NO: 22069 - DNA, 201 bp, Homo sapiens
tgtccatctgggccacggaggttggaatgctgtcagggagcagagaggcacagggacgaggggctggcattgctgtggagcacacagcacacactcccttytgtacagcaaactctgtatttgggggcccagtgtgtagctgggccctaggcacttattttgacctgagtaagcggaattaacatgccactccctgcctgt

SEQ ID NO: 22070 - DNA, 201 bp, Homo sapiens
actcatggaagtggttcttcctgctgaacctgaagatgtccccagactctctctcaacatagcaatctagggagccacttccggtggagatgaaacccccytgccatctctaagtaaaaggactcaaagagggggaaaaaggctcaggccgggcgtgttggctcacacctgtactcccagcactttgggaggctgaggcgg

SEQ ID NO: 22071 - DNA, 201 bp, Homo sapiens
cacagtgccacacagcaagcagagcctaggtgtgaccctgaatccaggctggcacccttgccacccagcctgtggcttccgagccagcctgcatcaggccygggggaggacggggcagagaggggagcctcctgagggctgaatgaaaggggactcccatgtgaggcatccatgccctgctctctgtcagataccagggcc

SEQ ID NO: 22072 - DNA, 201 bp, Homo sapiens
aaggcagggtgcgatggcagggccaggggtgggggccagggacagggaaggcgcttctgccatgggtcaggaagcacagtgccacacagcaagcagagccyaggtgtgaccctgaatccaggctggcacccttgccacccagcctgtggcttccgagccagcctgcatcaggcctgggggaggacggggcagagaggggag

SEQ ID NO: 22073 - DNA, 201 bp, Homo sapiens
ccctgctgcgtggtatggcgctgctctgctgtaccctgagtgtctagttattcatcaggccccttcctaactatgagctctttcaggataagagctgtgtytttgcatcaccagagcctgtgccagggcacggctggtgctccatacacgttgatggtgaatatatagcatgggtagatcattgtctgtgaatgcttaaca

SEQ ID NO: 22074 - DNA, 201 bp, Homo sapiens
gggcgactgtcacctttgcctgctgtcgggagctgtgctgatgggtagggggctctgtgcttgctgtggcccagagccaagccgtggggatgtgctctgtytggagcagaccccttcactgtctgcctaactccttcgtgtgttcccggaacagcttctgtgttatgcattccagaaagcctgcctgaccaccccaacctc

SEQ ID NO: 22075 - DNA, 201 bp, Homo sapiens; identical to SEQ ID NO: 3869

SEQ ID NO: 22076 - DNA, 201 bp, Homo sapiens
ttagctattattggaaaatttggctttctctttcaaaaacgtttataaataactttccctaaaaccatatgatggttctcccctttcagtgtctcctttcyattcggagcggctgaaggaggctcatgtcagactgtacccatccagccgctgcacatcacaacatttacttaacagaacagtcaccgacaacatgctgtg

SEQ ID NO: 22077 - DNA, 201 bp, Homo sapiens
gggaagtgctgtgaaataggtgagtaggtgagagcacgtgaaacgagctgaaatcccacctctccagtctcccccgcccccggaaggaaaggcagggtgcsatggcagggccaggggtgggggccagggacagggaaggcgcttctgccatgggtcaggaagcacagtgccacacagcaagcagagcctaggtgtgaccct

SEQ ID NO: 22078 - DNA, 201 bp, Homo sapiens
aggaggctgtcattaggggcttccttttttatacttgacaggttgcagcgagccaaggtgtttcaacgggggcacctgccagcaggccctgtacttctcaratttcgtgtgccagtgccccgaaggatttgctgggaagtgctgtgaaataggtgagtaggtgagagcacgtgaaacgagctgaaatcccacctctccagt

SEQ ID NO: 22079 - DNA, 201 bp, Homo sapiens; identical to SEQ ID NO: 3872

SEQ ID NO: 22080 - DNA, 201 bp, Homo sapiens; identical to SEQ ID NO: 3874

SEQ ID NO: 22081 - DNA, 201 bp, Homo sapiens
aaactccatctcagaaaaaaaaaaaaagttacaattgggtgtcacatagacagtgaggagtagtggaaagagtgttagatttggggtaagagaactgtgtytcctgggcttgagtcctgatgccaactctcacaagatgtgtcaccgtacagcacgacgcttatactttttttttttttttttttgagacaggatcttgct

SEQ ID NO: 22082 - DNA, 201 bp, Homo sapiens; identical to SEQ ID NO: 3875

SEQ ID NO: 22083 - DNA, 201 bp, Homo sapiens
gtgggagggtcgctggagcccgggagttcaagaccaatctgggcaaacatagcaagtcccctgtctctacaaaaaataaaaaaattagccagacctggtakgtagtcccaactacttgggaggttgaggcagaaggatcacttgagcccaggagttggaggctgcagtaatctacgattatgccactgcatttcaacctca

SEQ ID NO: 22084 - DNA, 201 bp, Homo sapiens
gcgccctgtgctcagaagcaaccgggtggaatattgctggtgcaacagtggcagggcacagtgccactcagtgcctgtcaaaagtatgtactgaggctggraggtggtgcatgcctgtgatcccagcactttaggaggccaaggtgggagggtcgctggagcccgggagttcaagaccaatctgggcaaacatagcaagtc

SEQ ID NO: 22085 - DNA, 201 bp, Homo sapiens
gagatgggcggtggtgacggccggccgcacagcaatatgacgtgcttaatgccactgaactgtgcactgaacatcgttaaggtggtaaattttgtgttatrtatattttgcaacaataaaaaatatgtagtttctagaatcctcttctagatgcatgtctggcgtttctgccgcggggctggcactggaggaagccagaca

SEQ ID NO: 22086 - DNA, 201 bp, Homo sapiens
cagtcatggctgcgccctgtgctcagaagcaaccgggtggaatattgctggtgcaacagtggcagggcacagtgccactcagtgcctgtcaaaagtatgtrctgaggctgggaggtggtgcatgcctgtgatcccagcactttaggaggccaaggtgggagggtcgctggagcccgggagttcaagaccaatctgggcaaa

SEQ ID NO: 22087 - DNA, 201 bp, Homo sapiens
ggtgcctactctctagctgagatggaagcgctacacacactctctgaaaatgcctagcaataaagggcctcacggaagtccaaactaaccacacctctccmacaggaccctacagcggggagagccaggtgactgcgtggagtagacagccagctgcaactccattgcccaatatggtggccacttaccttgtgcaactgt

SEQ ID NO: 22088 - DNA, 201 bp, Homo sapiens
atgcctagcaataaagggcctcacggaagtccaaactaaccacacctctcccacaggaccctacagcggggagagccaggtgactgcgtggagtagacagycagctgcaactccattgcccaatatggtggccacttaccttgtgcaactgtttaaatttaaaataattaaagttaaaaattgtttctcagtcccactggc

SEQ ID NO: 22089 - DNA, 201 bp, Homo sapiens
cagggtgcatcacccacccaccacctgccttcttccacccaccacctgcctacggtgtgacagtgccattgcagcatgattctacagagatgcctgtgtcrgcaccattctcccatcagctgcggccactgggcgggttctgattctgaggggagcagaaacaggtgttcccccccaaggagccaggctgtcagggatcac

SEQ ID NO: 22090 - DNA, 201 bp, Homo sapiens
aaaaattagccagacctggtatgtagtcccaactacttgggaggttgaggcagaaggatcacttgagcccaggagttggaggctgcagtaatctacgattrtgccactgcatttcaacctcagtgacagggcaagccctcacctctaaaacaaaacaaaacaacacaaacaaaaacaaaaacacagaaaagcccagtacaa

SEQ ID NO: 22091 - DNA, 201 bp, Homo sapiens
aggcctgttcggccttaggcggaggtgaaggtacaagcagaaaagggagcaagaccaagtgaccttgggcaaatgcccgcttgcctcagtttcctcatctrtaaagaggtgggaataacagtacacacttcatggtttgctgtgaggattaaattagctaatttttgtagactgtacaacagcgcctggcacatagagcac

SEQ ID NO: 22092 - DNA, 201 bp, Homo sapiens
gaacaacacttgtctgacctgcagggtccacttatgtatggatttttttcaaccaaaggcaggatgaaaacagtatttgtaggatgcagaactggtatacrcgtgttccacgctgcaggacttgagtgtgtgtggattgtggtagacagggctcctggaaccatggcctgagcacacagaaggaggctgtcattaggggct

SEQ ID NO: 22093 - DNA, 201 bp, Homo sapiens
aaaggggaatggggagttattctttaatggctacagagtttcagttaggggtgatggagaagttctggagatgggcggtggtgacggccggccgcacagcratatgacgtgcttaatgccactgaactgtgcactgaacatcgttaaggtggtaaattttgtgttatatatattttgcaacaataaaaaatatgtagtttc

SEQ ID NO: 22094 - DNA, 201 bp, Homo sapiens
atcagcacctcccacgggggagttcgtttcgaagtaacaatcaaagatccagagccggacccaggcagggaggcaaggtctggaagcccctgtgcctccargcccctaggacgctcgggggagggggagggggagggtgggacctgaagttgttgtgaccgaagggaaatgagtcagggaaagaaatgccatgctttaatt

SEQ ID NO: 22095 - DNA, 201 bp, Homo sapiens
cttcaaaaggagcctccaggcctgttcggccttaggcggaggtgaaggtacaagcagaaaagggagcaagaccaagtgaccttgggcaaatgcccgcttgyctcagtttcctcatctgtaaagaggtgggaataacagtacacacttcatggtttgctgtgaggattaaattagctaatttttgtagactgtacaacagcg

SEQ ID NO: 22096 - DNA, 201 bp, Homo sapiens
cggagcggctgaaggaggctcatgtcagactgtacccatccagccgctgcacatcacaacatttacttaacagaacagtcaccgacaacatgctgtgtgcwggagacactcggagcggcgggccccaggcaaacttgcacgacgcctgccaggtaaccaggagtggcgcgcccatgctgggcacaacccaggggagaatgc

SEQ ID NO: 22097 - DNA, 201 bp, Homo sapiens
tacagatcacacaacacacccacatgcactcacctatgtttacacacacgggcctcctcctccagcccctgcccctcctgcgtgttcctcccctcccgggracgcggccctcacgccagctcactcctcctttctccctcccagcgctgctgcagctgaaatcggattcgtcccgctgtgcccaggagagcagcgtggtcc

SEQ ID NO: 22098 - DNA, 201 bp, Homo sapiens
gtcccctcaaaggtgacttcctagcagtacttgctgtggcaagaacgctcattctgggatctagactcaatccatgacggtcagcatgagctgctgggtgygtgcttcctgtgcaggcagagtcggactccagcactggcagggacactgtgagtattgagatatgaatagctccatcctgcccacccatttattccacct

SEQ ID NO: 22099 - DNA, 201 bp, Homo sapiens
aaggctgtttctccaccaggtttccgccccaccacctgacggtgatcttgggcagaacataccgggtggtccctggcgaggaggagcagaaatttgaagtmgaaaaatacattgtccataaggaattcgatgatgacacttacgacaatgacattggtaagagctcgtcattcccggctccagttcatacagatcacacaa

SEQ ID NO: 22100 - DNA, 201 bp, Homo sapiens
agcagcttcaagttgttccagggagaagcgggaagcctcagtgcttttgttgaggaaggatgttcatgacagtaggtgcaggtcgctcctgccgtgcaccyaggtgtgggggaaggactttcctgcttcttttccagttaccttacaattcagcaagacggaaatgattagcccatgacaaaaaccaggaaacaggctcag

SEQ ID NO: 22101 - DNA, 201 bp, Homo sapiens
tagtggctcagttttctacttacataaaaagacagcacattctcttagcaatatgtgtttgtatgtgtgtgtgtgtgtgtgtgtgtgtgtgtgtgtgtgtrtatatatatatatatatatataatttagagacaaggtctgactccatcacccaggctggagtgcagcagtgtgatcgtaggtcactgaaccttcaaactc

SEQ ID NO: 22102 - DNA, 201 bp, Homo sapiens
caaaaaaagcattctaaggctgtttctccaccaggtttccgccccaccacctgacggtgatcttgggcagaacataccgggtggtccctggcgaggaggarcagaaatttgaagtcgaaaaatacattgtccataaggaattcgatgatgacacttacgacaatgacattggtaagagctcgtcattcccggctccagttc

SEQ ID NO: 22103 - DNA, 201 bp, Homo sapiens
gatagccctcctgcacctgaggggagaaagggggaggccaggagtgagtcattttggttgcagagggaagaaagacaggacttaggtctgtgcctgggctyggcctctgactggctatttgtctgacctggagctgatctcctcacactctgaccctcaatttcctcctctatggaggagaggatggggctgaatcagtgg

SEQ ID NO: 22104 - DNA, 201 bp, Homo sapiens
cctgctccaaccctaagtcaagccacatggtcttccgatagtggctcagttttctacttacataaaaagacagcacattctcttagcaatatgtgtttgtrtgtgtgtgtgtgtgtgtgtgtgtgtgtgtgtgtgtgtatatatatatatatatatatataatttagagacaaggtctgactccatcacccaggctggagt

SEQ ID NO: 22105 - DNA, 201 bp, Homo sapiens
aggacaggccgatagccctcctgcacctgaggggagaaagggggaggccaggagtgagtcattttggttgcagagggaagaaagacaggacttaggtctgygcctgggcttggcctctgactggctatttgtctgacctggagctgatctcctcacactctgaccctcaatttcctcctctatggaggagaggatggggct

SEQ ID NO: 22106 - DNA, 201 bp, Homo sapiens
cgcactgtgtgccttcccccggcggacctgcagctgccggactggacggagtgtgagctctccggctacggcaagcatgaggcctgtaagtggaaggaagyctcggccccatcctgtctgcgggacagcaggggaggctgcggtccaccagaggaaaatggggtcaggagaccgaagttccagccccgggtcaggcactga

SEQ ID NO: 22107 - DNA, 201 bp, Homo sapiens
catacagatcacacaacacacccacatgcactcacctatgtttacacacacgggcctcctcctccagcccctgcccctcctgcgtgttcctcccctcccgrggacgcggccctcacgccagctcactcctcctttctccctcccagcgctgctgcagctgaaatcggattcgtcccgctgtgcccaggagagcagcgtggt

SEQ ID NO: 22108 - DNA, 201 bp, Homo sapiens
ccagggcatcagctacaggggcacgtggagcacagcggagagtggcgccgagtgcaccaactggaacagcagcgcgttggcccagaagccctacagcgggyggaggccagatgccatcaggctgggcctggggaaccacaactactgcaggtgagggcacatccccaaggagggattccccctgtgagaagctgctacagc

SEQ ID NO: 22109 - DNA, 201 bp, Homo sapiens; identical to SEQ ID NO: 3933

SEQ ID NO: 22110 - DNA, 201 bp, Homo sapiens; identical to SEQ ID NO: 3934

SEQ ID NO: 22111 - DNA, 201 bp, Homo sapiens
ccgggagcgagacttccccagcttcgcccagctgaccatgaaggacagcaaccagttccacgccacctgcctcgacaccttcccgcccatctcttacctcmatgccatctcctggcgcatcatccacctggtgcaccgcttcaacgcccaccacggggacaccaaggtgacgcgggccgggagggcagaggctgcgctcgc

SEQ ID NO: 22112 - DNA, 201 bp, Homo sapiens
ccatggggaataaaccagcattgctgcctccggcctccgccgtttttctgtttcgtaaaccagcatcccggggttcctgctctgagtgaccctggcacctstcagggagtccaggtgtgccccatgagggcctgggggaggggcaggctgggcagagccacagaggggctcccctcaaaccccacattggctcaggtggga

SEQ ID NO: 22113 - DNA, 201 bp, Homo sapiens; identical to SEQ ID NO: 3935

SEQ ID NO: 22114 - DNA, 201 bp, Homo sapiens
cgtacacctttgacgcgggccccaatgccgtgatcttcaccctggacgacactgtggctgagtttgtggctgctgtgtggcacggctttcccccaggctcraatggagacacgtgagtgtggaccccgcccctcctcctttttgggagatggtgccaggaactctggtcggaagagacggaggcacctgaaggctgtggcg

SEQ ID NO: 22115 - DNA, 201 bp, Homo sapiens
tacatcattgtcactcaggtgaggcctggggctcacccagtaccccggggtttcctttcctgccaggggggcccgcccagcccccagggcccttaaaggcwaagcgcggctccctgtccctaccgtgtctcaggcaggaagccagaacgcctttgtccattcatttgctctcaaagtggacattacaggccactggtgatg

SEQ ID NO: 22116 - DNA, 201 bp, Homo sapiens
gctggaggacggggccctgcagcctgtcctgtgcccaggaaagtgaccgcctgcttcgagtcagcggccaagaagtcggtgggtcagttcagacagctctycccagagctgccccgtgagactcaccctgcctgccccgcactccctacaggaagtagacggactgagggcacccagctgggagccaggagacctgggctc

SEQ ID NO: 22117 - DNA, 201 bp, Homo sapiens
cgaccctgtcactgtgctgtggggatgggtagggggcagctctgggtggcctggtggcccacagtaggtagagaaggggggtggcccaggcccccgggacrggagccccacagtgcctgacccacttctccccgcagtcctcatcaccgggggcatcgtggccacagctgggcgcttcacccagtggtactttggtgccta

SEQ ID NO: 22118 - DNA, 201 bp, Homo sapiens
gaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccc

SEQ ID NO: 22119 - DNA, 201 bp, Homo sapiens
agatgcagaaaccacactcggcctgttagctttcagtgcatcaaacaaagactcatggtgacaagggggtccatttgggggtcccagagcccactggggcytgcaggtcgggctgtccttggccactcctgggacccagagcccgggcatgtccagcaccccctccgccagcccgtgcgccacaggctctgctcttcacca

SEQ ID NO: 22120 - DNA, 201 bp, Homo sapiens
cttccatggggcttcctgctctgccgcaggtaccttttgttgcccttgtcgcaggccgcaagctctgcaggccgtgaacagagagtgtccgagagtggaastagcggaggtgggggacagacggctgggccggtgaatgctggcctcaaaggctgatggcccagaagccctgtcatctggaaatccccatttgccgtgggg

SEQ ID NO: 22121 - DNA, 201 bp, Homo sapiens
ttactgaagcgagttagagccagtcaaggcggccgggtgttgaccccgccccggcagttgggtgtcttttcttgggtggggtccggcagctgcatcttggygccacagagcccccatgtacgccctcctcggtgcacagcttggccctgaaccgcctcttcccctgcgctgctctgtgggggtgccacagagcccccatgt

SEQ ID NO: 22122 - DNA, 201 bp, Homo sapiens
gactgctgtgggttccaggtggcgtacacctttgacgcgggccccaatgccgtgatcttcaccctggacgacactgtggctgagtttgtggctgctgtgtkgcacggctttcccccaggctcgaatggagacacgtgagtgtggaccccgcccctcctcctttttgggagatggtgccaggaactctggtcggaagagacg

SEQ ID NO: 22123 - DNA, 201 bp, Homo sapiens; identical to SEQ ID NO: 3941

SEQ ID NO: 22124 - DNA, 201 bp, Homo sapiens; identical to SEQ ID NO: 3942

SEQ ID NO: 22125 - DNA, 201 bp, Homo sapiens
tctggagggtgcgtggcagctggagtgggagcagagacctcagggtgggagggctggaggacggggccctgcagcctgtcctgtgcccaggaaagtgacckcctgcttcgagtcagcggccaagaagtcggtgggtcagttcagacagctctccccagagctgccccgtgagactcaccctgcctgccccgcactccctac

SEQ ID NO: 22126 - DNA, 201 bp, Homo sapiens; identical to SEQ ID NO: 3943

SEQ ID NO: 22127 - DNA, 201 bp, Homo sapiens
agggcagaggcaccactgcagcagctccaggaaggacctgcaccgggggaggagtgcctgggaagggcctgggggctgagggtgaggaggaggggcccgcygccaccactcccctggggctctgagcgccctccctgttgtctggagggtgcgtggcagctggagtgggagcagagacctcagggtgggagggctggagga

SEQ ID NO: 22128 - DNA, 201 bp, Homo sapiens; identical to SEQ ID NO: 3944

SEQ ID NO: 22129 - DNA, 201 bp, Homo sapiens
cagtgtggcgggcgtgtttgtgtgcctgctggagtacccccgggggaagaggaagaagggctccaccatggagcgctggtgagtctcctcctgctctgggktctctccgggggttgcggggcccaggcagggctcacagggttgggtggagcttggtttctcacttggaggctccggaaccaaccctttggtgcttgtggg

SEQ ID NO: 22130 - DNA, 201 bp, Homo sapiens
tgagacccccagtaattcccttgcagaccctgcggagcgcggcgcccctcccccattcccttctctcggtcccccgactccgcgaaggaggaagttgcagygcaggggaagaggcggttcagccccggtggtttccggggtcaccgccccgaagcccccgagtgggggctccggcctgggcatcgggagaagctcccctgc

SEQ ID NO: 22131 - DNA, 201 bp, Homo sapiens; identical to SEQ ID NO: 3947

SEQ ID NO: 22132 - DNA, 201 bp, Homo sapiens; identical to SEQ ID NO: 3946

SEQ ID NO: 22133 - DNA, 201 bp, Homo sapiens
ctgtggcccctcaggctgagctgggctgttccttaaccacatggcttcagtgtggcgggcgtgtttgtgtgcctgctggagtacccccgggggaagaggamgaagggctccaccatggagcgctggtgagtctcctcctgctctggggtctctccgggggttgcggggcccaggcagggctcacagggttgggtggagctt

SEQ ID NO: 22134 - DNA, 201 bp, Homo sapiens
cgaatggagacacgtgagtgtggaccccgcccctcctcctttttgggagatggtgccaggaactctggtcggaagagacggaggcacctgaaggctgtggygctgagacagggagtcccagggcaggcagcagtcccccgagtgtgggagccacgggcagggtgtccccatagagccatcccacagcccacgtccacaggg

SEQ ID NO: 22135 - DNA, 201 bp, Homo sapiens; identical to SEQ ID NO: 3948

SEQ ID NO: 22136 - DNA, 201 bp, Homo sapiens; identical to SEQ ID NO: 3938

SEQ ID NO: 22137 - DNA, 201 bp, Homo sapiens; identical to SEQ ID NO: 3950

SEQ ID NO: 22138 - DNA, 201 bp, Homo sapiens
gtaggtagagaaggggggtggcccaggcccccgggacaggagccccacagtgcctgacccacttctccccgcagtcctcatcaccgggggcatcgtggccrcagctgggcgcttcacccagtggtactttggtgcctactccatgtatccttccacctgaggctggggtgggcggggaacgcccagggcagagctggggag

SEQ ID NO: 22139 - DNA, 201 bp, Homo sapiens; identical to SEQ ID NO: 3952

SEQ ID NO: 22140 - DNA, 201 bp, Homo sapiens
ttaaccacatggcttcagtgtggcgggcgtgtttgtgtgcctgctggagtacccccgggggaagaggaagaagggctccaccatggagcgctggtgagtcycctcctgctctggggtctctccgggggttgcggggcccaggcagggctcacagggttgggtggagcttggtttctcacttggaggctccggaaccaaccc

SEQ ID NO: 22141 - DNA, 201 bp, Homo sapiens
ggccttttaaaagccggacatgaaaacaagctgaattctttaaaggctgggaaaatactgctgtagagttacccctagttgggaaacttttgtagaagaawtggttttatttataaaatggtatcattttctttctcatttacctaaggtttttccttccaggatatctgcaatcaagttgctatatgtctggtgcttcca

SEQ ID NO: 22142 - DNA, 201 bp, Homo sapiens; identical to SEQ ID NO: 3968

SEQ ID NO: 22143 - DNA, 201 bp, Homo sapiens
tctctagggtttcaggatacactcatttatccagtatggactgggctcttatatgacagacactgttcttgggatacactaggaacaagtagataaatatmcctgcctttgtagagtgtgagtagtgaatgaatatgagaatgaaaatgttgagataccgtgggttctttccactccaaggcttcccgttttagtcttcct

SEQ ID NO: 22144 - DNA, 201 bp, Homo sapiens
tttgtggtccctttcaggttcatggtgagctaatgacagcattaagctggccaggcttttgccagaagactagggttgggccccatcaggaccactaactrctgtgtgaacctgagtgggttatttgcttttcagccctcagttttctcaccaacaaaatgagaccacactagactgtcgttagcattctttcatcctcat

SEQ ID NO: 22145 - DNA, 201 bp, Homo sapiens
tgtctttcttggcttgtcttcttatttcacgtattccattcacatcgggctaacacccacattgtacattcactgtttctaggtcacaccctatgcttttyatcttcctcacatttgcttgaattgcttcctctccctgaaatactcttcccatgccccaagcaccaccttttaaaatctctctcatcttgccatgctatg

SEQ ID NO: 22146 - DNA, 201 bp, Homo sapiens
gtatgctatagcgtaaaagactaatatcattctttcctgaaagtggattttggtgaggagagaggcaatagatactgagtgaccaaaaaagcagaaagagraactgaaaagtcagagaagaattagtttagaatttaaaagggaaggaaggagcatagaattcaaatttctttacttcacagcttgacctggaacttaccc

SEQ ID NO: 22147 - DNA, 201 bp, Homo sapiens
ttgtacattcactgtttctaggtcacaccctatgctttttatcttcctcacatttgcttgaattgcttcctctccctgaaatactcttcccatgccccaarcaccaccttttaaaatctctctcatcttgccatgctatgtatgtcaaaggccaccttctgtcttgccttgtcctggaaatgagaacttcctctgcagaat

SEQ ID NO: 22148 - DNA, 201 bp, Homo sapiens
acaggcattagccaccgcacctggtgtttaaattttttaaatagcatgtttgcatttgaatgttatgttggaacaggggcagggttttctaactgaagacrtctgagatattctataagctaattcaataaattatctctctttttttatagatttcttccatgtcttcagtggaccaagatattacgcatttgatcttat

SEQ ID NO: 22149 - DNA, 201 bp, Homo sapiens
ctgagcctctattgctgccctaaaagaaaaaaagtttaagaagaaatgcactacagtgcttcccagttattgtctttggatggtggggatttttttcttcytttttaggctttccaaatttccaattttaaattttttttggggggggggatggagtctcactctgttgcccaggctggagtgcagtgacgcgatcttggc

SEQ ID NO: 22150 - DNA, 201 bp, Homo sapiens
gagaaaaatacaaaaattgttcaggtaaatgaactatcagttaggtgatgtttgatttgctgattattaggaaatagtgtgggttgttttctcttgttaaytaaaacagcctgaaagaaattatttgggtgattagtttgagattgaacatctccttttagtgatttggagggttccaagctggtaaggactaggcctttt

SEQ ID NO: 22151 - DNA, 201 bp, Homo sapiens
actcctggcctcaagcaatcctcccacctcagcctcccagagttctgggattacaggcattagccaccgcacctggtgtttaaattttttaaatagcatgwttgcatttgaatgttatgttggaacaggggcagggttttctaactgaagacatctgagatattctataagctaattcaataaattatctctcttttttta

SEQ ID NO: 22152 - DNA, 201 bp, Homo sapiens
ggccgtgtgaagacagaggcagagattggagtgacgcatctccaagccaaggaattccaaggactgtaagccaccagtagaagctttgaagaggcaaggarggattccctccaatagccttcaagtgtgaccctgctgacacctgcagaattcggacttctatcctccaaaaccgtgagggaataaatttcctttgtttta

SEQ ID NO: 22153 - DNA, 201 bp, Homo sapiens
aggtaacataatatttcaaactcacaaaaagtgatcatttgaaatttttgctacctcatgatactaagtcaatttgggatttttttaaaaaaagaaagaaraagacatgctgaatctgattactgaccttacttcttaggtcagagatcagaaaatacagactacggccaaatcctgcctgacccctgtctgtataaataa

SEQ ID NO: 22154 - DNA, 201 bp, Homo sapiens
tcaggatacactcatttatccagtatggactgggctcttatatgacagacactgttcttgggatacactaggaacaagtagataaatatccctgcctttgwagagtgtgagtagtgaatgaatatgagaatgaaaatgttgagataccgtgggttctttccactccaaggcttcccgttttagtcttccttctccaacaat

SEQ ID NO: 22155 - DNA, 201 bp, Homo sapiens
cgttagcattctttcatcctcatcccagatacaattctctaagactcctcaagctgtaatttggtttctgcataaaagtcacacaaactaaggcatccaaytgtggggccttgaatgtcttgctcagaagtttttattttttataggctctggggaaccattaaggctctcacagcccccctgaacttaactttatcatct

SEQ ID NO: 22156 - DNA, 201 bp, Homo sapiens
ctgagcgaaatttttatttgtccattggctattttgtgagtgtgcaatcacaggctgagggtacatgctgttgcttttatcaatatgttcacagcatttastgggagcaataatgaaagatgctacaaagtaagatttttcaatgtccaaggcaggacaatgccaaatgtaatcaaataagatcactcccataaccttccc

SEQ ID NO: 22157 - DNA, 201 bp, Homo sapiens
actacagtgcttcccagttattgtctttggatggtggggatttttttcttcttttttaggctttccaaatttccaattttaaattttttttggggggggggatggagtctcactctgttgcccaggctggagtgcagtgacgcgatcttggctcactgcaacctctgcctcccaagttcaagcaattctcctgcctcagcc

SEQ ID NO: 22158 - DNA, 201 bp, Homo sapiens
aagcgtcttcagggagaacatgatcttctcttcaaactctacccctcctggctttctttctgtccctctgggtagggcccttccctggcgagcaccctgasgttcacagcatcatgtgtcactcacagctctcttgcagtcctctttaaagccatgtcttaaacaattgctgcatcaggaatatgaagcaacataggttaa

SEQ ID NO: 22159 - DNA, 201 bp, Homo sapiens
tcaggtaaatgaactatcagttaggtgatgtttgatttgctgattattaggaaatagtgtgggttgttttctcttgttaattaaaacagcctgaaagaaaktatttgggtgattagtttgagattgaacatctccttttagtgatttggagggttccaagctggtaaggactaggccttttaaaagccggacatgaaaaca

SEQ ID NO: 22160 - DNA, 201 bp, Homo sapiens
accccaatctgtcacttactagttgagggaccaagtaccagctattcaaaatctatgggcatcagtcactttactataaaaatattgttaataaaacttcrgaaaaatgttatgaggattgcataacattagattgcctagtatgttgtaggtactctacaattatggctttttttaaaagtaggcatatacaaaaatgca

SEQ ID NO: 22161 - DNA, 201 bp, Homo sapiens
aagatcatgttctccctgaagacgcttccatttctgctcttactccatgtgcagatttccaaggcctttcctgtatcttctaaagagaaaaatacaaaaaytgttcaggtaaatgaactatcagttaggtgatgtttgatttgctgattattaggaaatagtgtgggttgttttctcttgttaattaaaacagcctgaaag

SEQ ID NO: 22162 - DNA, 201 bp, Homo sapiens
aaagaaacaaaaactttaaaaggatgaaatatacaattactttaatactttatggtatagtctggtagcacttaccttcacatgaagacccttcacctttytgagaagtctctgatgtacccaagagtcacaccggacttactctcataagaaagaccttttttttttttttttttttttttccaggactttcaagcaacc

SEQ ID NO: 22163 - DNA, 201 bp, Homo sapiens
caagcaaccctatccaacctactggaccaagcacacccaaaccctgtgaccccagtttgacatttgatgctatcaccacactccgtggagaaatacttttytttaaagacaggtataaaattgaaatatttcttcctttgattcctcttactgacataccttaaaactggattcaaattaagtcacacgttagtcaccttt

SEQ ID NO: 22164 - DNA, 201 bp, Homo sapiens
ctaaagagaaaaatacaaaaattgttcaggtaaatgaactatcagttaggtgatgtttgatttgctgattattaggaaatagtgtgggttgttttctcttrttaattaaaacagcctgaaagaaattatttgggtgattagtttgagattgaacatctccttttagtgatttggagggttccaagctggtaaggactaggc

SEQ ID NO: 22165 - DNA, 201 bp, Homo sapiens
atggagccaggttatcccaaaagcatatcaggtgcctttccaggaatagagagtaaagttgatgcagttttccagcaagaacgtaagtaggaaaaaaaaaacctaataaatgtgttgtttgtttgtttattatagaggagacagggtcttactatgctgaccaggttagtgtcaaactcctggcctcaagcaatcctccca

SEQ ID NO: 22166 - DNA, 201 bp, Homo sapiens
tttttaaatagcatgtttgcatttgaatgttatgttggaacaggggcagggttttctaactgaagacatctgagatattctataagctaattcaataaatyatctctctttttttatagatttcttccatgtcttcagtggaccaagatattacgcatttgatcttattgctcagagagttaccagagttgcaagaggcaa

SEQ ID NO: 22167 - DNA, 201 bp, Homo sapiens
cccctatgtgcttgtctttgtccaggactacctggaaaagttctaccaattaccaagcaaccagtatcagtctacaaggaagaatggcactaatgtgatcrttgaaaagcttaaagaaatgcagcgattttttgggttgaatgtgacggggaagccaaatgaggaaactctggacatgatgaaaaagcctcgctgtggagt

SEQ ID NO: 22168 - DNA, 201 bp, Homo sapiens
gtgagaactgaatgaaaaaatatgtgtgaggagactttgtaaattatatacaataaaaaaaatttttttcgttatattctgtattggtgttaaatcggatracattttgtttttaccagatatgataaccaaagacaattcatggagccaggttatcccaaaagcatatcaggtgcctttccaggaatagagagtaaagtt

SEQ ID NO: 22169 - DNA, 201 bp, Homo sapiens; identical to SEQ ID NO: 3976

SEQ ID NO: 22170 - DNA, 201 bp, Homo sapiens
ctctctttttttatagatttcttccatgtcttcagtggaccaagatattacgcatttgatcttattgctcagagagttaccagagttgcaagaggcaatamatggcttaactgtagatatggctgaagcaaaatcaaatgtggctgtatccactttcagaatgttgaagggaagttcagcatgcattttcgttacattgtg

SEQ ID NO: 22171 - DNA, 201 bp, Homo sapiens; identical to SEQ ID NO: 3979

SEQ ID NO: 22172 - DNA, 201 bp, Homo sapiens; identical to SEQ ID NO: 3966

SEQ ID NO: 22173 - DNA, 201 bp, Homo sapiens
ttttttttccaggactttcaagcaaccctatccaacctactggaccaagcacacccaaaccctgtgaccccagtttgacatttgatgctatcaccacactycgtggagaaatacttttctttaaagacaggtataaaattgaaatatttcttcctttgattcctcttactgacataccttaaaactggattcaaattaagt

SEQ ID NO: 22174 - DNA, 201 bp, Homo sapiens
cttcttaacttgccctgaaactcatgttataatgaacaataccttcatttttaaaactttgttggcttgtttgttttttctagcaagatatctactcaacrggcgaacaactcctgttcgcactgaagtgtaaatgactgatttgatttttgggggagagagcctgagagaactcagtcccagggaccagaagcaggtgag

SEQ ID NO: 22175 - DNA, 201 bp, Homo sapiens
gggaaacttttgtagaagaaatggttttatttataaaatggtatcattttctttctcatttacctaaggtttttccttccaggatatctgcaatcaagttrctatatgtctggtgcttccatacaggcattttctttgccgccaaaaattccagatatagaaaataatgtgaggatggtagattacaatgaactagaaatc

SEQ ID NO: 22176 - DNA, 201 bp, Homo sapiens
gaagaaatgcactacagtgcttcccagttattgtctttggatggtggggatttttttcttcttttttaggctttccaaatttccaattttaaatttttttkggggggggggatggagtctcactctgttgcccaggctggagtgcagtgacgcgatcttggctcactgcaacctctgcctcccaagttcaagcaattctcc

SEQ ID NO: 22177 - DNA, 201 bp, Homo sapiens
cttcagatattctgttatagcaacagaaaatggactaagacactgacaaggtgccaggtgttcacaggcagcatgaggtctagttaggttacatttcactrtgtatgaagaaacttttaagccaaacttaaaataggtaatttttaggctaaactctttggattttgactaaatttaacacttccaaagagttactttggt

SEQ ID NO: 22178 - DNA, 201 bp, Homo sapiens
gaatggcactaatgtgatcgttgaaaagcttaaagaaatgcagcgattttttgggttgaatgtgacggggaagccaaatgaggaaactctggacatgatgraaaagcctcgctgtggagtgcctgacagtggtggttttatgttaaccccaggaaaccccaagtgggaacgcactaacttgacctacaggtgatatctcta

SEQ ID NO: 22179 - DNA, 201 bp, Homo sapiens
aaccttttacagattagaatacacacacacacacacacacacacaataaaggtaacataatatttcaaactcacaaaaagtgatcatttgaaatttttgcwacctcatgatactaagtcaatttgggatttttttaaaaaaagaaagaagaagacatgctgaatctgattactgaccttacttcttaggtcagagatcaga

SEQ ID NO: 22180 - DNA, 201 bp, Homo sapiens
cagatcacggtgacaattctccatttgatggacccaatggaatccttgctcatgcctttcagccaggccaaggtattggaggagatgctcattttgatgcygaagaaacatggaccaacacctccgcaagtaagttaatcaagattatgtccacacacagcttctgaattaaccttttacagattagaatacacacacaca

SEQ ID NO: 22181 - DNA, 201 bp, Homo sapiens
tgaatgaatatgagaatgaaaatgttgagataccgtgggttctttccactccaaggcttcccgttttagtcttccttctccaacaatctaaagaggactayagcaatgttaggctgtctctctaagcacttactttaggacccaacaaaggcttaatcattgctggagagagtcaagtccctcctttcatacatcttaata

SEQ ID NO: 22182 - DNA, 201 bp, Homo sapiens
attgtacattcactgtttctaggtcacaccctatgctttttatcttcctcacatttgcttgaattgcttcctctccctgaaatactcttcccatgccccamgcaccaccttttaaaatctctctcatcttgccatgctatgtatgtcaaaggccaccttctgtcttgccttgtcctggaaatgagaacttcctctgcagaa

SEQ ID NO: 22183 - DNA, 201 bp, Homo sapiens
ctttcacggtattccaagcattcaaagatatttttctgaaatgcactcatgaatgcataattaaaaggatgtgatgataagaaacaattcttagagcatgrgtagaattttagcaggctaattatcaacaggaagttgaacattgcagtaagagcatggatcttgccattatacctgggtttgaccccaatctgtcactta

SEQ ID NO: 22184 - DNA, 201 bp, Homo sapiens
cttaacttgccctgaaactcatgttataatgaacaataccttcatttttaaaactttgttggcttgtttgttttttctagcaagatatctactcaacgggygaacaactcctgttcgcactgaagtgtaaatgactgatttgatttttgggggagagagcctgagagaactcagtcccagggaccagaagcaggtgaggca

SEQ ID NO: 22185 - DNA, 201 bp, Homo sapiens; identical to SEQ ID NO: 3974

SEQ ID NO: 22186 - DNA, 201 bp, Homo sapiens
aaactgaggtttaaagacatgtattaacttgttcagaacccacatctgtcctccaccctgagacctgcactccctccttatcctctccagtggtagcacascatgatgcaactcacttcaaaacagaacaactcatcagttgatggactactgttctaaataacatttaactcttcatacatcctctcattttgaaggatt

SEQ ID NO: 22187 - DNA, 201 bp, Homo sapiens
tgatgctgtgaacctcagggtgctcgccagggaagggccctacccagagggacagaaagaaagccaggaggggtagagtttgaagagaagatcatgttctvcctgaagacgcttccatttctgctcttactccatgtgcagatttccaaggcctttcctgtatcttctaaagagaaaaatacaaaaattgttcaggtaaat

SEQ ID NO: 22188 - DNA, 201 bp, Homo sapiens
gcccttccctggcgagcaccctgaggttcacagcatcatgtgtcactcacagctctcttgcagtcctctttaaagccatgtcttaaacaattgctgcatcrggaatatgaagcaacataggttaattacactctgacagttttgcaattttataatgtgatttagtacccccaaatgggggagtctttcaacagtctttca

SEQ ID NO: 22189 - DNA, 201 bp, Homo sapiens
gactggggactccgggaaacatctaaaaggcttaaaaactttgtctaacttcagccgggcatggtggctcacacctgtaatcccagcactttgggaggctraggcaggtggatcacaaggtcaggagtttgagacgagcctgaccaacatggtgaaaccccgtctctactaaaaatacaaaaattagccaggcatggtggc

SEQ ID NO: 22190 - DNA, 201 bp, Homo sapiens
gccaccaccaccccacccagcacacctccaacctcagccagacaaggttgttgacacaagagagccctcaggggcacagagagagtctggacacgtgggggagtcagccgtgtatcatcggaggcggccgggcacatggcagggatgagggaaagaccaagagtcctctgttgggcccaagtcctagacagacaaaaccta

SEQ ID NO: 22191 - DNA, 201 bp, Homo sapiens; identical to SEQ ID NO: 3981

SEQ ID NO: 22192 - DNA, 201 bp, Homo sapiens; identical to SEQ ID NO: 3982

SEQ ID NO: 22193 - DNA, 201 bp, Homo sapiens
ggctcacgcctctaatcctagcactttgagaggccaaggcgggcagattgcctgagcacaggagttcgagaccagcctggccaacatggtgaaaccctgtytctgtcaaaaatacaaaaaattagccaggtgtgttggcgcgtgcctataatcccagctgctcgggaggatgaggttcaaagaatcacttgaacccgggag

SEQ ID NO: 22194 - DNA, 201 bp, Homo sapiens
ggcagattgcctgagcacaggagttcgagaccagcctggccaacatggtgaaaccctgtctctgtcaaaaatacaaaaaattagccaggtgtgttggcgcrtgcctataatcccagctgctcgggaggatgaggttcaaagaatcacttgaacccgggaggcagaggctgcagtgagctgagatcatgccactgcactcca

SEQ ID NO: 22195 - DNA, 201 bp, Homo sapiens
cctgtctctattaaaaatacaaaaattagccagccgtggtagcgagcgcctatgatcccagctactccggaggctgaggccagagaatcacatgaacctgsgaggtggaggctgcagtgagccgagatcacgccactgcactccagcctgggggacagagcaagaatctgtttcaaaaaaaaaaaaagaaaaataggaagg

SEQ ID NO: 22196 - DNA, 201 bp, Homo sapiens; identical to SEQ ID NO: 4009

SEQ ID NO: 22197 - DNA, 201 bp, Homo sapiens
gaggccaaggcgggcggatcacttgaggtcaggagtttgagaccagcctggccaacatggtgaaaccctgtctctattaaaaatacaaaaattagccagcygtggtagcgagcgcctatgatcccagctactccggaggctgaggccagagaatcacatgaacctgggaggtggaggctgcagtgagccgagatcacgcca

SEQ ID NO: 22198 - DNA, 201 bp, Homo sapiens
tgcactccagcctgggtgacagagcaagactttgtctccaaaaaaaggaactagacgggttcatttaaacccctgactgcagccctttgacatacatccarttgaggactggggactccgggaaacatctaaaaggcttaaaaactttgtctaacttcagccgggcatggtggctcacacctgtaatcccagcactttggg

SEQ ID NO: 22199 - DNA, 201 bp, Homo sapiens; identical to SEQ ID NO: 4011

SEQ ID NO: 22200 - DNA, 201 bp, Homo sapiens
ggggaggccaaggcgggcggatcacttgaggtcaggagtttgagaccagcctggccaacatggtgaaaccctgtctctattaaaaatacaaaaattagccrgccgtggtagcgagcgcctatgatcccagctactccggaggctgaggccagagaatcacatgaacctgggaggtggaggctgcagtgagccgagatcacg

SEQ ID NO: 22201 - DNA, 201 bp, Homo sapiens; identical to SEQ ID NO: 4014

SEQ ID NO: 22202 - DNA, 201 bp, Homo sapiens
tctcaaaacaaacaaacaaacaaacaaaatacagaagctgaggcgggaggaacatttgaaccggattcggaggctgcagtgagctatgattgcaccactgygctccagtctgtgtgacagtgagaccctgtctcttacacacacacacacacacacacacacacatgcacacacacagagagagagaaattagaagatact

SEQ ID NO: 22203 - DNA, 201 bp, Homo sapiens
tctattgaacccgggagggggaggttgcagtgagccgagatcatgccattgcactccagcctgggcgacagagtgagactccttctcaaaacaaacaaacraacaaacaaaatacagaagctgaggcgggaggaacatttgaaccggattcggaggctgcagtgagctatgattgcaccactgcgctccagtctgtgtgac

SEQ ID NO: 22204 - DNA, 201 bp, Homo sapiens; identical to SEQ ID NO: 4016

SEQ ID NO: 22205 - DNA, 201 bp, Homo sapiens
agcaagaccctgcctctacaaaaaaaaaattttttttaattagccaggcttggtgacatgcatctgtagtctactcaagaagctgaggtgaggccaggcayggtggctcacgcctgtattcccagcactttgggaggtcaaggcgggtggatgacctgaggtcaggagttcaagaccagcctggccaacatggtgaaaccc

SEQ ID NO: 22206 - DNA, 201 bp, Homo sapiens
ccagctactcgggaggctgaggcaggagaatcacttgagcccgggaggtggaggttgcagtgagccgaacgaaattgagccacttcaccccagcctgggcraaagagtgaaattccattcaaaaaaaaaaaaaaaaaaaaaggatgaggactgggatgaactggtggctgggtgtggggaaaatggaagtgaaggaaggcc

SEQ ID NO: 22207 - DNA, 201 bp, Homo sapiens
gggatacccaaaagccaagagcgagagagagcctggcttccagaaatagtggagaagccaggagaactaggtgaaaacccagtgctgggttgccatcagcragagctggagccatttccaacgaaccatcttgtcgtcttcacagctgagttcaccacgcccgatggccattactacgacatcctggaactgccctaccac

SEQ ID NO: 22208 - DNA, 201 bp, Homo sapiens
ctgcccaagtaagccaccccgctatctccccgacctaccaacccctctctcctggctccctaaagtcaccgcccccaggttgaatttcccagatctgtgaygcttgcaggacatgcatgtgtgggaggctgatgggaaactgtggcctgggtttgattatgagtcttgcaatcatccctccccctgtttctgctggagggc

SEQ ID NO: 22209 - DNA, 201 bp, Homo sapiens
tgtagtcccagctacttgggaggctgaggtgggaggatcacttgagtccagcagttcaaggctgcagtgagctatgtttgcaccaccacactccagcctgrgtcacagaacaagacctcatctctaaaaaacaaacaaaaaccaaatccacatatcctaaaaaatgctccttttcagcattctcttctctatggacaaagg

SEQ ID NO: 22210 - DNA, 201 bp, Homo sapiens
ctctactaaaaatacaaaaaaaattagccaggcgtggtggcaggcgcctgtagtcccagctactcgggaggctgaggcaggagaatggcatgaacccaggmggcagagcttgcagtgagctgagatcgtgccactgcactccagcctgggcgacagagagagactccgtctcaaaaaaaaaaaataaaagaattcatggaa

SEQ ID NO: 22211 - DNA, 201 bp, Homo sapiens; identical to SEQ ID NO: 4028

SEQ ID NO: 22212 - DNA, 201 bp, Homo sapiens
cctgtaatcccagcccaacactttgggaggtctaggcgagaggaaggcttgaggcctggagtttgagaccagcctggccaacataacaagacctcatctcytcaaaaaatttaaaaaccagccgggcatggtggtgcacacctgtagtcccagctacttgggaggctgaggtgggaggatcacttgagtccagcagttcaa

SEQ ID NO: 22213 - DNA, 201 bp, Homo sapiens; identical to SEQ ID NO: 4002

SEQ ID NO: 22214 - DNA, 201 bp, Homo sapiens; identical to SEQ ID NO: 4031

SEQ ID NO: 22215 - DNA, 201 bp, Homo sapiens
ctgtttctcagcctggaaaacgggcttgggaccatggaaccctgtttcctcgcctgatggctcctaagttccctgactgtgaaaaggcctcctaaagaaaracccaagttgttcccacagtgggaagtaaacttaagaaacatgcttatcaggctgggcatggtggctcccacctgtaatcccagcgctttgggggaccaa

SEQ ID NO: 22216 - DNA, 201 bp, Homo sapiens; identical to SEQ ID NO: 4003

SEQ ID NO: 22217 - DNA, 201 bp, Homo sapiens
gcaggacatgcatgtgtgggaggctgatgggaaactgtggcctgggtttgattatgagtcttgcaatcatccctccccctgtttctgctggagggcagggracagctcttcctgaccacacccccacattgactatccccagaatacccagcaaaagcccccaaaaggagagtcagagaaatgagggaggtgggggcccaa

SEQ ID NO: 22218 - DNA, 201 bp, Homo sapiens
gagagagagcctggcttccagaaatagtggagaagccaggagaactaggtgaaaacccagtgctgggttgccatcagcgagagctggagccatttccaacraaccatcttgtcgtcttcacagctgagttcaccacgcccgatggccattactacgacatcctggaactgccctaccacggggacaccctcagcatgttca

SEQ ID NO: 22219 - DNA, 201 bp, Homo sapiens
ggcagcatagcaagaccctgcctctacaaaaaaaaaattttttttaattagccaggcttggtgacatgcatctgtagtctactcaagaagctgaggtgagsccaggcacggtggctcacgcctgtattcccagcactttgggaggtcaaggcgggtggatgacctgaggtcaggagttcaagaccagcctggccaacatgg

SEQ ID NO: 22220 - DNA, 201 bp, Homo sapiens
agcctcacatgtcctctcctctctgtcccggtgcagacaagggcatggcccccgccctccggcatctgtacaaggagctcatggggccatggaacaaggaygagatcagcaccacagacgcgatcttcgtccagcgggatctgaagctggtccagggcttcatgccccacttcttcaggctgttccggagcacggtcaagc

SEQ ID NO: 22221 - DNA, 201 bp, Homo sapiens
ttgaacctgggaggcggaggatgcagtgagccaagatcacacctccgcactccagcctgggcaacagagcaagactccatctcaaaaaaaaaaaaaaaaaaggcggtggagacacccagcactggttccctcctagagaaggggagagagccgagcccaaacacaggctatttttggagttgtgttgtttggagagcaacc

SEQ ID NO: 22222 - DNA, 201 bp, Homo sapiens
ccaagctcctggaggaaaccaggtctcagaggatgtccctaaacttttaaggttcatattcaggaaaacaaacaacttccagctgggcttagtggctcacwcctgtaatcccagcactttgggaggccgaggcaggaggatcgcttgagcccaggaatttgagaccagcctgggcaatataatgagactgtgtctctacaa

SEQ ID NO: 22223 - DNA, 201 bp, Homo sapiens; identical to SEQ ID NO: 3984

SEQ ID NO: 22224 - DNA, 201 bp, Homo sapiens
caacattctgagtgcccagctcatcagccactggaaaggcaacatgaccaggctgccccgcctcctggttctgcccaagtaagccaccccgctatctcccygacctaccaacccctctctcctggctccctaaagtcaccgcccccaggttgaatttcccagatctgtgatgcttgcaggacatgcatgtgtgggaggctg

SEQ ID NO: 22225 - DNA, 201 bp, Homo sapiens; identical to SEQ ID NO: 3985

SEQ ID NO: 22226 - DNA, 201 bp, Homo sapiens
gctcacacctgtaatcccagcactttgggaggctgaggcaggtggatcacaaggtcaggagtttgagacgagcctgaccaacatggtgaaaccccgtctcyactaaaaatacaaaaattagccaggcatggtggcaggcgcctgtaatcccagctattcgggaggctgaggcaggagaattgcttgaaccccggagacaga

SEQ ID NO: 22227 - DNA, 201 bp, Homo sapiens
tgacacggctggtgctggtgaatgccctctacttcaacggccagtggaagactcccttccccgactccagcacccaccgccgcctcttccacaaatcagayggcagcactgtctctgtgcccatgatggctcagaccaacaagttcaactatagtaagtccaagagccccttccccacagcccacagcaactgcatctcat

SEQ ID NO: 22228 - DNA, 201 bp, Homo sapiens; identical to SEQ ID NO: 3987

SEQ ID NO: 22229 - DNA, 201 bp, Homo sapiens
gagtttgagacgagcctgaccaacatggtgaaaccccgtctctactaaaaatacaaaaattagccaggcatggtggcaggcgcctgtaatcccagctattygggaggctgaggcaggagaattgcttgaaccccggagacagaggttgcagcgagccgagatcgcgccactgcactccagcctggcaatagagtgagactc

SEQ ID NO: 22230 - DNA, 201 bp, Homo sapiens; identical to SEQ ID NO: 3989

SEQ ID NO: 22231 - DNA, 201 bp, Homo sapiens; identical to SEQ ID NO: 4017

SEQ ID NO: 22232 - DNA, 201 bp, Homo sapiens; identical to SEQ ID NO: 3990

SEQ ID NO: 22233 - DNA, 201 bp, Homo sapiens
tccccagacccggaaaggaccccgcagccctctcggcacagagcagctctgtctgtgctcagccatcacccactccccacctgtttctcagcctggaaaaygggcttgggaccatggaaccctgtttcctcgcctgatggctcctaagttccctgactgtgaaaaggcctcctaaagaaaaacccaagttgttcccacagt

SEQ ID NO: 22234 - DNA, 201 bp, Homo sapiens; identical to SEQ ID NO: 4019

SEQ ID NO: 22235 - DNA, 201 bp, Homo sapiens; identical to SEQ ID NO: 3992

SEQ ID NO: 22236 - DNA, 201 bp, Homo sapiens; identical to SEQ ID NO: 4049

SEQ ID NO: 22237 - DNA, 201 bp, Homo sapiens; identical to SEQ ID NO: 3993

SEQ ID NO: 22238 - DNA, 201 bp, Homo sapiens
tctttccctgccagctgtgagaaaacaaagcctaaggcagattaaaaagcaggagggctgctcagtgtggttgcccttggtatctgtttactgaaaaaatycaaaacaaacatccgacgcttccacccactgaaacttcctgtgactctgctatcagctgttgccatggattctcccaactgaaccccaccacatacacta

SEQ ID NO: 22239 - DNA, 201 bp, Homo sapiens
gcacctgtagccccagttacttgggagactgaggtgggaggatcacttgagcccatgagttcaaggctgcagtgagccatgaaggtgccactgcactcccrcctgggcgacagagggagaccctgtctctaagaaaaacggcgggggtgggggtggtgccagtgccagcatccctctgttctaagacattgtcccttctct

SEQ ID NO: 22240 - DNA, 201 bp, Homo sapiens; identical to SEQ ID NO: 4022

SEQ ID NO: 22241 - DNA, 201 bp, Homo sapiens
gaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctaccaagctc

SEQ ID NO: 22242 - DNA, 201 bp, Homo sapiens
gaaccctcaattcagcataagcctcacatgtcctctcctctctgtcccggtgcagacaagggcatggcccccgccctccggcatctgtacaaggagctcayggggccatggaacaaggatgagatcagcaccacagacgcgatcttcgtccagcgggatctgaagctggtccagggcttcatgccccacttcttcaggctg

SEQ ID NO: 22243 - DNA, 201 bp, Homo sapiens; identical to SEQ ID NO: 4001

SEQ ID NO: 22244 - DNA, 201 bp, Homo sapiens
tggctcaggtgaggctccacgggtgtcgcctccatcgcccttcaggataactggtccccagacccggaaaggaccccgcagccctctcggcacagagcagytctgtctgtgctcagccatcacccactccccacctgtttctcagcctggaaaacgggcttgggaccatggaaccctgtttcctcgcctgatggctcctaa

SEQ ID NO: 22245 - DNA, 201 bp, Homo sapiens; identical to SEQ ID NO: 4004

SEQ ID NO: 22246 - DNA, 201 bp, Homo sapiens; identical to SEQ ID NO: 3980

SEQ ID NO: 22247 - DNA, 201 bp, Homo sapiens
aatgactgggtgaagacacacacaaaaggtgagcaggcagggaaaggaaacccatttcctgggcctcaagagaaagggaatttggaaataaatccacatawcccagttgggtgcagtagttcacacctgtaatcccagcccaacactttgggaggtctaggcgagaggaaggcttgaggcctggagtttgagaccagcctg

SEQ ID NO: 22248 - DNA, 201 bp, Homo sapiens
ctctactaaaaatacaaaaattagccaggcatggtggcaggcgcctgtaatcccagctattcgggaggctgaggcaggagaattgcttgaaccccggagayagaggttgcagcgagccgagatcgcgccactgcactccagcctggcaatagagtgagactccatctcaaaacaacaacaacaacaacaacaacaaaatcg

SEQ ID NO: 22249 - DNA, 201 bp, Homo sapiens
ctttctttcttttttgattttgcactggacggtgacgtcagccatgtacaggatccacaggggtggtgtcaaatgctattgaaattgtgttgaattgtatrctttttcacttttgataaataaacatgtaaaaatgtttcaaaaaaataataaaataaataaatacgaagaatatgtcaggacagtcactgccttcacctt

SEQ ID NO: 22250 - DNA, 201 bp, Homo sapiens
aagaagagagagagaaagaaagagagagaagaaagaaagaaagaaagaaagaaagaaagaaagaaagaaagaaagaaagaaagaaaaagaaaggaaagaargaacgaacgaaccaggcctccctctccaaccttcacctccgtccctattctggccacttgattcgggggacacctggtaggggatggggaaaggtgggag

SEQ ID NO: 22251 - DNA, 201 bp, Homo sapiens
tgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctaccaagct

SEQ ID NO: 22252 - DNA, 201 bp, Homo sapiens
tcatagtctcagcccgcatggcccccgaggagatcatcatggacagacccttcctctttgtggtccggcacaaccccacaggtgagcctggaacccatcaygttccacatcctcccacccattctttctctcaggaactagtcccgacagatgcagacatccctctatccctgagagggctctgggcagggaacccataac

SEQ ID NO: 22253 - DNA, 201 bp, Homo sapiens
gcagaacaaattagccctaactctgcagtatacagttcaaaaactgctcatccatgctgagatggctctagaggaaaaagagttcttcaaaaagccccctyaccacagaggaggcttgttccaggaaatgccccatttaacagactctcagctattgtgaggacaaaaatgatgtagactcacagcacgagacctgcccag

SEQ ID NO: 22254 - DNA, 201 bp, Homo sapiens
actctgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctacca

SEQ ID NO: 22255 - DNA, 201 bp, Homo sapiens
gactctgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctacc

SEQ ID NO: 22256 - DNA, 201 bp, Homo sapiens
aagggggattgcttgaggccagaagttgaataccagtctgggcagcatagcaagaccctgcctctacaaaaaaaaaattttttttaattagccaggcttgktgacatgcatctgtagtctactcaagaagctgaggtgaggccaggcacggtggctcacgcctgtattcccagcactttgggaggtcaaggcgggtggatg

SEQ ID NO: 22257 - DNA, 201 bp, Homo sapiens
ggggacagagcaagaatctgtttcaaaaaaaaaaaaagaaaaataggaaggaaggaaggaaaggaaaggaaagaagagagagagaaagaaagagagagaagaaagaaagaaagaaagaaagaaagaaagaaagaaagaaagaaagaaagaaagaaaaagaaaggaaagaaagaacgaacgaaccaggcctccctctccaac

SEQ ID NO: 22258 - DNA, 201 bp, Homo sapiens
gggaaaggagccgtggaccagctgacacggctggtgctggtgaatgccctctacttcaacggccagtggaagactcccttccccgactccagcacccaccrccgcctcttccacaaatcagacggcagcactgtctctgtgcccatgatggctcagaccaacaagttcaactatagtaagtccaagagccccttccccaca

SEQ ID NO: 22259 - DNA, 201 bp, Homo sapiens
atcccagcactttgggaggctgagaagggggattgcttgaggccagaagttgaataccagtctgggcagcatagcaagaccctgcctctacaaaaaaaaawttttttttaattagccaggcttggtgacatgcatctgtagtctactcaagaagctgaggtgaggccaggcacggtggctcacgcctgtattcccagcact

SEQ ID NO: 22260 - DNA, 201 bp, Homo sapiens
gggggacagagcaagaatctgtttcaaaaaaaaaaaaagaaaaataggaaggaaggaaggaaaggaaaggaaagaagagagagagaaagaaagagagagaagaaagaaagaaagaaagaaagaaagaaagaaagaaagaaagaaagaaagaaagaaaaagaaaggaaagaaagaacgaacgaaccaggcctccctctccaa

SEQ ID NO: 22261 - DNA, 201 bp, Homo sapiens
tgaacccgggaggcagaggctgcagtgagctgagatcatgccactgcactccagcctgggtgacagagcaagactttgtctccaaaaaaaggaactagacrggttcatttaaacccctgactgcagccctttgacatacatccaattgaggactggggactccgggaaacatctaaaaggcttaaaaactttgtctaactt

SEQ ID NO: 22262 - DNA, 201 bp, Homo sapiens
tgggggacagagcaagaatctgtttcaaaaaaaaaaaaagaaaaataggaaggaaggaaggaaaggaaaggaaagaagagagagagaaagaaagagagagragaaagaaagaaagaaagaaagaaagaaagaaagaaagaaagaaagaaagaaagaaaaagaaaggaaagaaagaacgaacgaaccaggcctccctctcca

SEQ ID NO: 22263 - DNA, 201 bp, Homo sapiens
ccaacatggtgaaaccctgtctctgtcaaaaatacaaaaaattagccaggtgtgttggcgcgtgcctataatcccagctgctcgggaggatgaggttcaargaatcacttgaacccgggaggcagaggctgcagtgagctgagatcatgccactgcactccagcctgggtgacagagcaagactttgtctccaaaaaaagg

SEQ ID NO: 22264 - DNA, 201 bp, Homo sapiens
ttcggaggctgcagtgagctatgattgcaccactgcgctccagtctgtgtgacagtgagaccctgtctcttacacacacacacacacacacacacacacaygcacacacacagagagagagaaattagaagatactgaattggcagaagagaagggaaatagaaattaaaatactgaataggggagcagtgaacaggggat

SEQ ID NO: 22265 - DNA, 201 bp, Homo sapiens; identical to SEQ ID NO: 4021

SEQ ID NO: 22266 - DNA, 201 bp, Homo sapiens; identical to SEQ ID NO: 3996

SEQ ID NO: 22267 - DNA, 201 bp, Homo sapiens
attcggaggctgcagtgagctatgattgcaccactgcgctccagtctgtgtgacagtgagaccctgtctcttacacacacacacacacacacacacacacatgcacacacacagagagagagaaattagaagatactgaattggcagaagagaagggaaatagaaattaaaatactgaataggggagcagtgaacagggga

SEQ ID NO: 22268 - DNA, 201 bp, Homo sapiens; identical to SEQ ID NO: 3995

SEQ ID NO: 22269 - DNA, 201 bp, Homo sapiens
aaaggaggcagtggcccacagaggagcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggtaggagaaaagcaaactccctccaacctctta

SEQ ID NO: 22270 - DNA, 201 bp, Homo sapiens; identical to SEQ ID NO: 3999

SEQ ID NO: 22271 - DNA, 201 bp, Homo sapiens
gattcggaggctgcagtgagctatgattgcaccactgcgctccagtctgtgtgacagtgagaccctgtctcttacacacacacacacacacacacacacacatgcacacacacagagagagagaaattagaagatactgaattggcagaagagaagggaaatagaaattaaaatactgaataggggagcagtgaacagggg

SEQ ID NO: 22272 - DNA, 201 bp, Homo sapiens; identical to SEQ ID NO: 4027

SEQ ID NO: 22273 - DNA, 201 bp, Homo sapiens
ggattcggaggctgcagtgagctatgattgcaccactgcgctccagtctgtgtgacagtgagaccctgtctcttacacacacacacacacacacacacacacatgcacacacacagagagagagaaattagaagatactgaattggcagaagagaagggaaatagaaattaaaatactgaataggggagcagtgaacaggg

SEQ ID NO: 22274 - DNA, 201 bp, Homo sapiens
ctctgttgggcccaagtcctagacagacaaaacctagacaatcacgtggctggctgcatgccctgtggctgttgggctgggcccaggaggagggaggggcrctctttcctggaggtggtccagagcaccgggtggacagccctgggggaaaacttccacgttttgatggaggttatctttgataactccacagtgacctgg

SEQ ID NO: 22275 - DNA, 201 bp, Homo sapiens; identical to SEQ ID NO: 4032

SEQ ID NO: 22276 - DNA, 201 bp, Homo sapiens
ggcgcggcgactcacgcctataatcccagcactttgggaggctgagaagggggattgcttgaggccagaagttgaataccagtctgggcagcatagcaagrccctgcctctacaaaaaaaaaattttttttaattagccaggcttggtgacatgcatctgtagtctactcaagaagctgaggtgaggccaggcacggtggc

SEQ ID NO: 22277 - DNA, 201 bp, Homo sapiens; identical to SEQ ID NO: 4005

SEQ ID NO: 22278 - DNA, 201 bp, Homo sapiens; identical to SEQ ID NO: 4006

SEQ ID NO: 22279 - DNA, 201 bp, Homo sapiens
ctgaaatccagagattccctcagggccacatttgtccacctgactccagggtctcatcttcgtgtgttgctagtgtgattacctggggatgagaaatcctkctgggggagttgaggttaagaggatgaggactccaggtgctgtggctcacgcctgtaatcccagcactttgggaggccaaggcaggtggatcaggagttt

SEQ ID NO: 22280 - DNA, 201 bp, Homo sapiens
cggattcggaggctgcagtgagctatgattgcaccactgcgctccagtctgtgtgacagtgagaccctgtctcttacacacacacacacacacacacacayacatgcacacacacagagagagagaaattagaagatactgaattggcagaagagaagggaaatagaaattaaaatactgaataggggagcagtgaacagg

SEQ ID NO: 22281 - DNA, 201 bp, Homo sapiens
tctgtcccggtgcagacaagggcatggcccccgccctccggcatctgtacaaggagctcatggggccatggaacaaggatgagatcagcaccacagacgcratcttcgtccagcgggatctgaagctggtccagggcttcatgccccacttcttcaggctgttccggagcacggtcaagcaagtggacttttcagaggtgg

SEQ ID NO: 22282 - DNA, 201 bp, Homo sapiens
catgaattgacactctgtttctatcccttttccccttgtgtctgtgtctggaggaagaggataaaggacaagctgccccaagtcctagcgggcagctcgargaagtgaaacttacacgttggtctcctgtttccttaccaagcttttaccatggtaacccctggtcccgttcagccaccaccaccccacccagcacacctc

SEQ ID NO: 22283 - DNA, 201 bp, Homo sapiens; identical to SEQ ID NO: 3983

SEQ ID NO: 22284 - DNA, 201 bp, Homo sapiens
acacacgtacacacacagagcagcacacacacacacacacacatgcctcagcaagtcccagagagggaggtgtcgagggggacccgctggctgttcagacrgactcccagagccagtgagtgggtggggctggaacatgagttcatctatttcctgcccacatctggtataaaaggaggcagtggcccacagaggagcaca

SEQ ID NO: 22285 - DNA, 201 bp, Homo sapiens; identical to SEQ ID NO: 3986

SEQ ID NO: 22286 - DNA, 201 bp, Homo sapiens; identical to SEQ ID NO: 3988

SEQ ID NO: 22287 - DNA, 201 bp, Homo sapiens
aacccgggagggggaggttgcagtgagccgagatcatgccattgcactccagcctgggcgacagagtgagactccttctcaaaacaaacaaacaaacaaamaaaatacagaagctgaggcgggaggaacatttgaaccggattcggaggctgcagtgagctatgattgcaccactgcgctccagtctgtgtgacagtgaga

SEQ ID NO: 22288 - DNA, 201 bp, Homo sapiens
acatcgcgccattgcactccagcctgggagacaagagcaaaactccaactcaaaaaaaaaaaaaaaaaaaaaacaggaagaaaatatttagggttcataayttaagaacagagaaaaatattctagcccaaagaaagggttgggatctgagacttttgaagaaaggaaggagatacagaaaagagatttcatcctggaatg

SEQ ID NO: 22289 - DNA, 201 bp, Homo sapiens; identical to SEQ ID NO: 3991

SEQ ID NO: 22290 - DNA, 201 bp, Homo sapiens
atcacttgagcccgggaggtggaggttgcagtgagccgaacgaaattgagccacttcaccccagcctgggcaaaagagtgaaattccattcaaaaaaaaaaaaaaaaaaaaaggatgaggactgggatgaactggtggctgggtgtggggaaaatggaagtgaaggaaggccaaaagagacagagaaggcctggcgcggcg

SEQ ID NO: 22291 - DNA, 201 bp, Homo sapiens
tctattaaaaatacaaaaattagccagccgtggtagcgagcgcctatgatcccagctactccggaggctgaggccagagaatcacatgaacctgggaggtsgaggctgcagtgagccgagatcacgccactgcactccagcctgggggacagagcaagaatctgtttcaaaaaaaaaaaaagaaaaataggaaggaaggaa

SEQ ID NO: 22292 - DNA, 201 bp, Homo sapiens
gacctgtcaaaaaaaaaaaaagaaagagagagagagagagaagagagagaaagaaagaagaagaaagaaagaaagagagagagagaaagaaagaaagaaasaaagaaacaaagaaacaaagaaagaaaggaaaagaaaaaaaaaactaaggccaggcaaggtggcttatgactgtaatttcagcactttggaagattgagg

SEQ ID NO: 22293 - DNA, 201 bp, Homo sapiens
gaggtagaggttgcagtgaactgagaccacaccattgcactccagcctgggcaagaagagcgaaactttgtctcaaaaaaaaaaaaaaaaaaaaaaaaaaattggcggggcatggtggtgcacacctgtagtcccaactagcaactcctcaggaggctgagatgggaggatctcttgagcctgggaggtcgaaatgcagtg

SEQ ID NO: 22294 - DNA, 201 bp, Homo sapiens
gttcgagaccagcctggccaacatggtgaaaccctgtctctgtcaaaaatacaaaaaattagccaggtgtgttggcgcgtgcctataatcccagctgctcrggaggatgaggttcaaagaatcacttgaacccgggaggcagaggctgcagtgagctgagatcatgccactgcactccagcctgggtgacagagcaagact

SEQ ID NO: 22295 - DNA, 201 bp, Homo sapiens
ggaggtagaggttgcagtgaactgagaccacaccattgcactccagcctgggcaagaagagcgaaactttgtctcaaaaaaaaaaaaaaaaaaaaaaaaaaattggcggggcatggtggtgcacacctgtagtcccaactagcaactcctcaggaggctgagatgggaggatctcttgagcctgggaggtcgaaatgcagt

SEQ ID NO: 22296 - DNA, 201 bp, Homo sapiens; identical to SEQ ID NO: 4052

SEQ ID NO: 22297 - DNA, 201 bp, Homo sapiens; identical to SEQ ID NO: 3998

SEQ ID NO: 22298 - DNA, 201 bp, Homo sapiens; identical to SEQ ID NO: 4000

SEQ ID NO: 22299 - DNA, 201 bp, Homo sapiens; identical to SEQ ID NO: 4058

SEQ ID NO: 22300 - DNA, 201 bp, Homo sapiens
gagccatttccaacgaaccatcttgtcgtcttcacagctgagttcaccacgcccgatggccattactacgacatcctggaactgccctaccacggggacamcctcagcatgttcattgctgccccttatgaaaaagaggtgcctctctctgccctcaccaacattctgagtgcccagctcatcagccactggaaaggcaac

SEQ ID NO: 22301 - DNA, 201 bp, Homo sapiens
ccattgcactccagcctgggcgacagagtgagactccttctcaaaacaaacaaacaaacaaacaaaatacagaagctgaggcgggaggaacatttgaaccrgattcggaggctgcagtgagctatgattgcaccactgcgctccagtctgtgtgacagtgagaccctgtctcttacacacacacacacacacacacacaca

SEQ ID NO: 22302 - DNA, 201 bp, Homo sapiens
gccattgcactccagcctgggcgacagagtgagactccttctcaaaacaaacaaacaaacaaacaaaatacagaagctgaggcgggaggaacatttgaacyggattcggaggctgcagtgagctatgattgcaccactgcgctccagtctgtgtgacagtgagaccctgtctcttacacacacacacacacacacacacac

SEQ ID NO: 22303 - DNA, 201 bp, Homo sapiens
tccagcctgggccacagagcgagactccatctccaaaaaaaaagacttaggaactcaattctgtgatagcaaaatacagaaatagagattatactttaggstaggtgttgtggctcacacctgtaatcccaatgcttttggaggctagggtgggaggatcactcgaagccaggagcttgagaccagactggacaacatagt

SEQ ID NO: 22304 - DNA, 201 bp, Homo sapiens
tgtgatagcaaaatacagaaatagagattatactttaggctaggtgttgtggctcacacctgtaatcccaatgcttttggaggctagggtgggaggatcamtcgaagccaggagcttgagaccagactggacaacatagtgagaccccccacctctacaaaaaattaaaaaaaaaaataagccaggtgggagaattgcttg

SEQ ID NO: 22305 - DNA, 201 bp, Homo sapiens
tgatagcaaaatacagaaatagagattatactttaggctaggtgttgtggctcacacctgtaatcccaatgcttttggaggctagggtgggaggatcactygaagccaggagcttgagaccagactggacaacatagtgagaccccccacctctacaaaaaattaaaaaaaaaaataagccaggtgggagaattgcttgag

SEQ ID NO: 22306 - DNA, 201 bp, Homo sapiens
gggtgtggtgacattcacctgtaatcccagctactcgggaggctgaggcaggaggatcgctttagcccaggagttccaggctgcagtgagccataatcatkccactgtaccccagcctgggtgagaccctatctcaaaaaaaaagattacactttcatattatggcaaaagcatgtaaatatcctccagcctccttcctta

SEQ ID NO: 22307 - DNA, 201 bp, Homo sapiens
ccagaaaggacaaagtgggagcaggagaccttagaactggggagggggagagggaggggacatgtggcaacagcagctcaagtgactcaggtctcgtatcsgcacctcagccatttctgcctcccctacaagccacagccactctgcaagaggaagctggggtttgtggttcctgttttgcctgggaagaaagagtagcag

SEQ ID NO: 22308 - DNA, 201 bp, Homo sapiens
cgggaggctgaggcaggaggatcgctttagcccaggagttccaggctgcagtgagccataatcatgccactgtaccccagcctgggtgagaccctatctcmaaaaaaaagattacactttcatattatggcaaaagcatgtaaatatcctccagcctccttccttatttatctgagcagtgctgcaagcccagggtttgta

SEQ ID NO: 22309 - DNA, 201 bp, Homo sapiens
ctgtctttcccaccgccaccacccccagttcctcagccgcctgcgcctcccgctctacagtggggactgcatctcccaggaggtaggagacaaaggtgccragggaatcctaggaaaaaagagagagagaggggagagtcattgaggagagtcccagccctttccctgggggccctggctggaggagcccaggttaaggaa

SEQ ID NO: 22310 - DNA, 201 bp, Homo sapiens
ctgtaacaccaggggttgaagtgctgtgatattttttggttctaggataatttggaaatagggatctcttaacatcttggatactgccaatagatcattcmcgaaatccctttagatgagtgttatgtttacttaggtctctaaaacaatttgtaaggtcaacagatggggataagaatgacctgaagctggtcgtctttg

SEQ ID NO: 22311 - DNA, 201 bp, Homo sapiens
cgctgccatatacaggacagccctcaccatgcagaacaaccagcaccaaacgccaagagtgctgcaattgagaaatcctggtttcgatggtcccacttccyttaagaagcctccatttttttttttttttttttttttttttttatgagacaggatcttgctctgtcacccaggctggagtgcagtggcacaatcatagct

SEQ ID NO: 22312 - DNA, 201 bp, Homo sapiens
aatccctttagatgagtgttatgtttacttaggtctctaaaacaatttgtaaggtcaacagatggggataagaatgacctgaagctggtcgtctttgttcscaaccagaaacagtcctgcctcaaaaaaaaaaaaaaaaaaaagggagtaggcaggtggccatatttgtttctggcaagtgagtgctgaaggaaaggagct

SEQ ID NO: 22313 - DNA, 201 bp, Homo sapiens
ttgtggttcctgttttgcctgggaagaaagagtagcagtgaagagggggctggtgggagctctgacacatttcggcgtcattaatgcttcccccaggggcrgaaggggccggattggtggctctggggtgcatcccctcacctatgattaggcttgcaaaaaagaacttggctaaactttatattgtggatatctgtgtct

SEQ ID NO: 22314 - DNA, 201 bp, Homo sapiens
gacagccctcaccatgcagaacaaccagcaccaaacgccaagagtgctgcaattgagaaatcctggtttcgatggtcccacttcctttaagaagcctccawttttttttttttttttttttttttttttatgagacaggatcttgctctgtcacccaggctggagtgcagtggcacaatcatagcttactgcagcctccac

SEQ ID NO: 22315 - DNA, 201 bp, Homo sapiens
tgtttacttaggtctctaaaacaatttgtaaggtcaacagatggggataagaatgacctgaagctggtcgtctttgttcgcaaccagaaacagtcctgccycaaaaaaaaaaaaaaaaaaaagggagtaggcaggtggccatatttgtttctggcaagtgagtgctgaaggaaaggagctgaagcctcccacagtcataac

SEQ ID NO: 22316 - DNA, 201 bp, Homo sapiens
ttttttttttttttttttttatgagacaggatcttgctctgtcacccaggctggagtgcagtggcacaatcatagcttactgcagcctccacctcctaggktcaagcaatcctcctgtctcagactcccgagtagctgggactgcaggtgcgtgccaccatgctcaactaatttttaaattttttgtagagacggagtttt

SEQ ID NO: 22317 - DNA, 201 bp, Homo sapiens
tttacttaggtctctaaaacaatttgtaaggtcaacagatggggataagaatgacctgaagctggtcgtctttgttcgcaaccagaaacagtcctgcctcmaaaaaaaaaaaaaaaaaaagggagtaggcaggtggccatatttgtttctggcaagtgagtgctgaaggaaaggagctgaagcctcccacagtcataactg

SEQ ID NO: 22318 - DNA, 201 bp, Homo sapiens
taggtcctcctgaatgttcctgtgttctccttcccagggccgtgatctcctggtggtcctcagggactgggggagctgggctgctgggggccctgtcctamctgggcctcacccaggccggcctctcccctcagcagaccctgctgtccatgctgggtatccctgccctgctgctggccaggtgagctgccctgagccggg

SEQ ID NO: 22319 - DNA, 201 bp, Homo sapiens
gagacaggatcttgctctgtcacccaggctggagtgcagtggcacaatcatagcttactgcagcctccacctcctaggttcaagcaatcctcctgtctcaractcccgagtagctgggactgcaggtgcgtgccaccatgctcaactaatttttaaattttttgtagagacggagttttgttatgttgcccaggctggtct

SEQ ID NO: 22320 - DNA, 201 bp, Homo sapiens
gaaaactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaac

SEQ ID NO: 22321 - DNA, 201 bp, Homo sapiens
tctttgccgagtcttcagtgtgaaaacttcatctgcccttctctctctgttcccctgcaggctccagctccagcctctcccttcgggaaaggtggacagtrttcaaggttcggatgatggctggggtatgtccctgtggggcttgctcacctccaggccccccgcttatatcttctgccttttccagggtctgctgtggta

SEQ ID NO: 22322 - DNA, 201 bp, Homo sapiens
tgctggtattacctgcatgagccactgcaccaggctgaggttgagaattttttttttttttttttgggatggagtctctctctgttgcccaggctggagtrcagtgctgcgatcttggctcactgcagcctctgcctcccaggttcaagtgattctcctgcctcagccttccaagtagctgggactacagaaccactacac

SEQ ID NO: 22323 - DNA, 201 bp, Homo sapiens
aaaactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaact

SEQ ID NO: 22324 - DNA, 201 bp, Homo sapiens
aaactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaactc

SEQ ID NO: 22325 - DNA, 201 bp, Homo sapiens; identical to SEQ ID NO: 4065

SEQ ID NO: 22326 - DNA, 201 bp, Homo sapiens
aactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaactcc

SEQ ID NO: 22327 - DNA, 201 bp, Homo sapiens
actttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaactcct

SEQ ID NO: 22328 - DNA, 201 bp, Homo sapiens
tcagtttccccatatctcaaatggcagttgttcttgctttccttggaggtgatgagggtaatgcattcagcacagtgtggttcccaaggtgattagaagtwggatgagggtggactttatttgattagttccttttttttttttttttttttttaatcagtgttgaccaggttggcctcgaatgtgtagccttgcctgcct

SEQ ID NO: 22329 - DNA, 201 bp, Homo sapiens
tgtcctttttaatgctcatctttaagtctacctcagatttaatgaattaggacctctagggtaagccccgcttggggcatttgtacctagatccccaggcrattcttacatatacgaaaagtatgaaccgccacgaggaggcctacacactgcacaagaggcaatgtggcgtggtcagtgctgggaggatggcacctcctt

SEQ ID NO: 22330 - DNA, 201 bp, Homo sapiens
ctatgatattcccattttccagatgaggaaactgaagctcagagagtataaactcttgacacacaactaaggagtgggagagctgagacttgaacccaggygtgcctgactccagagcctgtgtttgtagcaggcctgtttggccagctcctgcctctccttggccacgtggttgggagggttgtcccctggaagctctgc

SEQ ID NO: 22331 - DNA, 201 bp, Homo sapiens
caagtgattctcccacctcagcctccaagtaggtgtggctacaggtgtgcaccaccgcatctgcctaatttttatatttttttatagagatgggggtctcrctatgggacctgggctggtctcaaactcgtggcctcaagtgatcctcctacctcaaccttccaaagtgctgagattacaagcatgagccaccatgccggg

SEQ ID NO: 22332 - DNA, 201 bp, Homo sapiens
gccatggccagacacattagaggcctgggcagtgtggcaaggtgtggtgtgaccatcccagtgcttgtcctccccccaggtgtggtcttcgctagcatctsatcaggccttggggaggtcaccttcctctccctcactgccttctaccccaggtaagcaggtggagcagggagtgtggggagaggctgtcccatggtcagc

SEQ ID NO: 22333 - DNA, 201 bp, Homo sapiens
ggcagtgtggcaaggtgtggtgtgaccatcccagtgcttgtcctccccccaggtgtggtcttcgctagcatctcatcaggccttggggaggtcaccttccyctccctcactgccttctaccccaggtaagcaggtggagcagggagtgtggggagaggctgtcccatggtcagcctaggtcctcctgaatgttcctgtgtt

SEQ ID NO: 22334 - DNA, 201 bp, Homo sapiens
gcagctgccctgcccagtaggcaccggggggagcgggatggtccctggaggagcctcctctcctccccccaaccctaacctcaggtaccagatgctgtacyaggctggcgtctttgcctcccgctcttctctccgctgctgtcgcatccgtttcacctgggccctggccctgctgcaggtaccaaacccctgcccctcact

SEQ ID NO: 22335 - DNA, 201 bp, Homo sapiens
taacctcaggtaccagatgctgtaccaggctggcgtctttgcctcccgctcttctctccgctgctgtcgcatccgtttcacctgggccctggccctgctgyaggtaccaaacccctgcccctcacttcactcccaccttggctcccagcttggctcccagcttccccaaaccccctgcttcccactatcagtgggaagtgt

SEQ ID NO: 22336 - DNA, 201 bp, Homo sapiens
ggatggatcacttgagaccaggagttcaagaccagcctggccaacatggtgaaaccccatctgtactaaaaatacaaaaattagccaggcatggtggtgcrcgcctgtaatcccagctactcaggaggctgaggcaggagaatcacttgaacccaggaggtggaggttgtagtgagccaagatcgagccactacactccag

SEQ ID NO: 22337 - DNA, 201 bp, Homo sapiens
gtcacccttagaagcctgctagggctatcagcagtaggcgatgggagactgggacaatttggaggggtaggcagtggaggagatgggagaaaatggatgamttagatggagattgaggtgaacaaagtcaagactctgtgatggaccaggcacagtgactcatgcctataatcccagcactttggaaagccaaggcaggca

SEQ ID NO: 22338 - DNA, 201 bp, Homo sapiens
tgggacaatttggaggggtaggcagtggaggagatgggagaaaatggatgaattagatggagattgaggtgaacaaagtcaagactctgtgatggaccagscacagtgactcatgcctataatcccagcactttggaaagccaaggcaggcagatcacctgaggtcaggagttcgaaaccagcctggccaacatggagaaa

SEQ ID NO: 22339 - DNA, 201 bp, Homo sapiens
atggatgaattagatggagattgaggtgaacaaagtcaagactctgtgatggaccaggcacagtgactcatgcctataatcccagcactttggaaagccawggcaggcagatcacctgaggtcaggagttcgaaaccagcctggccaacatggagaaaccccgtctctaccaaaaatacaaaaattagctgggtgtggtgg

SEQ ID NO: 22340 - DNA, 201 bp, Homo sapiens
cactttggaaagccaaggcaggcagatcacctgaggtcaggagttcgaaaccagcctggccaacatggagaaaccccgtctctaccaaaaatacaaaaatyagctgggtgtggtggcaggagcctgtaatcccagctactcgggaggctgaggcaggagaatctcttgaacctgggaggcagaggttgcagtgagccgaga

SEQ ID NO: 22341 - DNA, 201 bp, Homo sapiens
ctcaaatggcagttgttcttgctttccttggaggtgatgagggtaatgcattcagcacagtgtggttcccaaggtgattagaagtaggatgagggtggacyttatttgattagttccttttttttttttttttttttttaatcagtgttgaccaggttggcctcgaatgtgtagccttgcctgcctgagtgccagggcaac

SEQ ID NO: 22342 - DNA, 201 bp, Homo sapiens
gtttagtagagaccaggccaggctggtctcgaaatcctgacctcaggtgatctgcccacctcagcctcccaaagtgctgggattacaggtgtgagccaccrcaccgggctggtgttgagattttatctagacctggcagccctctccttcaccagtaactcctaaaaccagggacccctggaggggaggccacctctcctt

SEQ ID NO: 22343 - DNA, 201 bp, Homo sapiens
aatggcagttgttcttgctttccttggaggtgatgagggtaatgcattcagcacagtgtggttcccaaggtgattagaagtaggatgagggtggactttawttgattagttccttttttttttttttttttttttaatcagtgttgaccaggttggcctcgaatgtgtagccttgcctgcctgagtgccagggcaacaggc

SEQ ID NO: 22344 - DNA, 201 bp, Homo sapiens
tccagggtctgctgtggtacattgttcccttggtcgtagtttactttgccgagtatttcattaaccagggacttgtaagtgaggggtgctaggaggggtgyggaggtggcgattggggctgggacccacacagccccgtccatctcccctgtctggtatttgttgcagtttgaactcctctttttctggaacacttccctg

SEQ ID NO: 22345 - DNA, 201 bp, Homo sapiens
gtggcctcaagtgatcctcctacctcaaccttccaaagtgctgagattacaagcatgagccaccatgccgggcctgaaccttttttttttttttttttttkgagacggagtctctctctgtcctccaggctggagtgcagtggcgcaatctcggctcactgcaaactccgcctcccaggttcacaccattcttttgcctca

SEQ ID NO: 22346 - DNA, 201 bp, Homo sapiens
gtctcgatctcctgacctcgtgatccgcccgcctcggcctcccaaagtgctgggattacaggtgtgagccaccgcgcccagcttttttttttttttttttwaattttattttatttttgagacagagtctcactctatcacccaggctggagagcagtggcacaatctcggctcactgaaacctccacctccaaggttcaa

SEQ ID NO: 22347 - DNA, 201 bp, Homo sapiens
ttttagtaaagacaggatttcaccatgttggtcaggctggtctagaactcctgaccttaggtgatccgcttgcctccacttcccaaagtgctgggattacrggcgtgagccaccgtgccccgccctgacataggggctttgggatcacagacttggattcacttccagcctccaaggcctctcccagaaactctctgtgac

SEQ ID NO: 22348 - DNA, 201 bp, Homo sapiens
accgtgccccgccctgacataggggctttgggatcacagacttggattcacttccagcctccaaggcctctcccagaaactctctgtgaccactctccttttttttttttttttttgagatagagtctcgctcttgtagcccaggctggagtgcaatggcacaatctcggcttactgcaacctccgcctttcgggttcaag

SEQ ID NO: 22349 - DNA, 201 bp, Homo sapiens
agactcactctcaaaatatatatatatatagtttctgagtcctttctgtctgcaccatatattagctcatttaagccacacagcagtcctgtgagctaggygctatgatattcccattttccagatgaggaaactgaagctcagagagtataaactcttgacacacaactaaggagtgggagagctgagacttgaacccag

SEQ ID NO: 22350 - DNA, 201 bp, Homo sapiens
ggcaagggctgggggtggcctgtccagggacacccagggcagggatgtctgggactgaagcctcacccctgctctctgccctcccagaccagtgatgagcrccgggagtttgcaatggcggccacctgcatctctgacacactggggatctccctgtcggggctcctggctttgcctctgcatgacttcctctgccagctc

SEQ ID NO: 22351 - DNA, 201 bp, Homo sapiens
ctctttttctggaacacttccctgagtcacgctcagcaataccgctggtaagaggagcgagggcagtgggctgggagggcgccgtggtgatgcagctgccstgcccagtaggcaccggggggagcgggatggtccctggaggagcctcctctcctccccccaaccctaacctcaggtaccagatgctgtaccaggctggcg

SEQ ID NO: 22352 - DNA, 201 bp, Homo sapiens
acccagggcagggatgtctgggactgaagcctcacccctgctctctgccctcccagaccagtgatgagcaccgggagtttgcaatggcggccacctgcatytctgacacactggggatctccctgtcggggctcctggctttgcctctgcatgacttcctctgccagctctcctgatactcgggatcctcaggacgcaggt

SEQ ID NO: 22353 - DNA, 201 bp, Homo sapiens
tgagactctgtctcaaaaaataaaaaaaattaaaaatcaaagagacgtgaagaggtctcacctggttagcttttattttcatcatgataaagtatgtataktacttgaagtttaccattttattattttttatcttactttatttttttgaggcggagtttcgctcttgttgcccaggctggagtgcaatggcgcaatctc

SEQ ID NO: 22354 - DNA, 201 bp, Homo sapiens
cagggccgtgatctcctggtggtcctcagggactgggggagctgggctgctgggggccctgtcctacctgggcctcacccaggccggcctctcccctcagyagaccctgctgtccatgctgggtatccctgccctgctgctggccaggtgagctgccctgagccgggagggagaggggtccaaggagagaaaacttggcca

SEQ ID NO: 22355 - DNA, 201 bp, Homo sapiens
gtgattagaagtaggatgagggtggactttatttgattagttccttttttttttttttttttttttaatcagtgttgaccaggttggcctcgaatgtgtarccttgcctgcctgagtgccagggcaacaggcctgaaccatggcgactcccttttttttttttttttttttttttttttgagacggagtctcatggtgtca

SEQ ID NO: 22356 - DNA, 201 bp, Homo sapiens
ggggactcaggtgcacatttggaaataaaggacaagcaagaggccagaaaggacaaagtgggagcaggagaccttagaactggggagggggagagggaggrgacatgtggcaacagcagctcaagtgactcaggtctcgtatccgcacctcagccatttctgcctcccctacaagccacagccactctgcaagaggaagct

SEQ ID NO: 22357 - DNA, 201 bp, Homo sapiens
gttcctgttttgcctgggaagaaagagtagcagtgaagagggggctggtgggagctctgacacatttcggcgtcattaatgcttcccccaggggcggaagrggccggattggtggctctggggtgcatcccctcacctatgattaggcttgcaaaaaagaacttggctaaactttatattgtggatatctgtgtctgcctc

SEQ ID NO: 22358 - DNA, 201 bp, Homo sapiens
ttttttttttttttttaatcagtgttgaccaggttggcctcgaatgtgtagccttgcctgcctgagtgccagggcaacaggcctgaaccatggcgactccyttttttttttttttttttttttttttttgagacggagtctcatggtgtcactcaggctggagtgcagtgactggtgtgatctcagctcactgcagcctcg

SEQ ID NO: 22359 - DNA, 201 bp, Homo sapiens
ctagtgattctcctgcctcagcctcccgagtagctgggactacaggcccatgccaccatgcctggctaattttttatatttttagtagagacggggtttcrctgtattggccaggctggtctcaaactcctgacctcaagtgatccacctgccttggcctcccataatgctaggaatacaggcgtgagccaccgcgcccgg

SEQ ID NO: 22360 - DNA, 201 bp, Homo sapiens
cccatgccaccatgcctggctaattttttatatttttagtagagacggggtttcactgtattggccaggctggtctcaaactcctgacctcaagtgatccrcctgccttggcctcccataatgctaggaatacaggcgtgagccaccgcgcccggcctgattagttctgtgtattttcatgcatattacaaaacactttgg

SEQ ID NO: 22361 - DNA, 201 bp, Homo sapiens
accatgcctggctaattttttatatttttagtagagacggggtttcactgtattggccaggctggtctcaaactcctgacctcaagtgatccacctgcctyggcctcccataatgctaggaatacaggcgtgagccaccgcgcccggcctgattagttctgtgtattttcatgcatattacaaaacactttggccgggcat

SEQ ID NO: 22362 - DNA, 201 bp, Homo sapiens
atcgcttgaacccaggaggcagaggttgcagtgagccgtgattgtgccactgcactccaggctgggcaacagagcgagactccgtctaaaaaaaaaaaaaacacacactttgaactagccagacacacctggcccttcacaagattagtgcttaggacaagtctaagtagaaaaagtgagtccatttaaagaaaaatatta

SEQ ID NO: 22363 - DNA, 201 bp, Homo sapiens
tcgcttgaacccaggaggcagaggttgcagtgagccgtgattgtgccactgcactccaggctgggcaacagagcgagactccgtctaaaaaaaaaaaaaacacacactttgaactagccagacacacctggcccttcacaagattagtgcttaggacaagtctaagtagaaaaagtgagtccatttaaagaaaaatattaa

SEQ ID NO: 22364 - DNA, 201 bp, Homo sapiens
aaggtgggaggatcacttgagcctaggagtttgagaccagcctgggcagtatagtgagacccccatcttaaggaaaaaaattaaaaaatatatatatatawaataattgagaccttaatataatttctgaggctgaggcggatggatcacttgagaccaggagttcaagaccagcctggccaacatggtgaaaccccatct

SEQ ID NO: 22365 - DNA, 201 bp, Homo sapiens
atacaggaggaatatggatatggcaaataacatgaagccagaacctaagtgactaaaatcgaggaagttctggcctagcacagagtgaacgtataattaakgggagctagagcgaccattagaataataatggccagaaaacagaactgactcgctaggtatgagccagcagtccgaacaagggcctgctgagcacagtgg

SEQ ID NO: 22366 - DNA, 201 bp, Homo sapiens
caaaaaatggaaaatatgaggcgggcttggtggcacgtgcctgtagtccccgctacttgggaggctgaggcgggaggattgcttgagcctgggaggtcgcrgctgcagtgagctatgattgcaccactgcattccagcctggatgctggagaaagaccctgtctctgaaaaaaatcaaaacaaaatgaaggcccatgaata

SEQ ID NO: 22367 - DNA, 201 bp, Homo sapiens
ctttgggagaccaaggtgggaggatcacttgagcctaggagtttgagaccagcctgggcagtatagtgagacccccatcttaaggaaaaaaattaaaaaawatatatatatataataattgagaccttaatataatttctgaggctgaggcggatggatcacttgagaccaggagttcaagaccagcctggccaacatggt

SEQ ID NO: 22368 - DNA, 201 bp, Homo sapiens
tatacaggaggaatatggatatggcaaataacatgaagccagaacctaagtgactaaaatcgaggaagttctggcctagcacagagtgaacgtataattawtgggagctagagcgaccattagaataataatggccagaaaacagaactgactcgctaggtatgagccagcagtccgaacaagggcctgctgagcacagtg

SEQ ID NO: 22369 - DNA, 201 bp, Homo sapiens
gatgttctagaaccagagaatggccagtgagactgggcagggtgggccaatggccatctgtggagctgtacaagagacattggccgggcgtggtggttcayacctgtaatcccagcactttgggaggctgaggcagatggatcatttgagatcaagagtttgagaccagtctggccaacatggtaaaaccccgtctctact

SEQ ID NO: 22370 - DNA, 201 bp, Homo sapiens
cacttgtaatcccagcactttgggagaccaaggtgggaggatcacttgagcctaggagtttgagaccagcctgggcagtatagtgagacccccatcttaargaaaaaaattaaaaaatatatatatatataataattgagaccttaatataatttctgaggctgaggcggatggatcacttgagaccaggagttcaagacc

SEQ ID NO: 22371 - DNA, 201 bp, Homo sapiens
caggtgtggtggtgcatgcctgtagtcccagctacttgggaagctgaggcacgagaatcacttgaacccaggaggcagaggctgcagtgagctgagattgsaccactgcactgcagcctgggcaactgagtgagactctgtctcaaaaaataaaaaaaattaaaaatcaaagagacgtgaagaggtctcacctggttagct

SEQ ID NO: 22372 - DNA, 201 bp, Homo sapiens
agatcctgccactgcactccagcctgggcaacagagcaaaaccctgtcaaaaaaaaaaaaaaatctggtctaagcaccacctttgatggaggcaggaatcytgcagcagcctggagccaacccaatggctccctgcctctggtgctctatttcttatcaccatacaggtctctaaggtcacctttaggtctaacattgtat

SEQ ID NO: 22373 - DNA, 201 bp, Homo sapiens
cccaggagttccaggctgcagtgagccataatcatgccactgtaccccagcctgggtgagaccctatctcaaaaaaaaagattacactttcatattatggmaaaagcatgtaaatatcctccagcctccttccttatttatctgagcagtgctgcaagcccagggtttgtacccacaaaaccccaaatttataactcaggg

SEQ ID NO: 22374 - DNA, 201 bp, Homo sapiens
ccagcactttgggaggctgaggcaggaggaccacttgagctcagaagtctgagtccagcctgggcaacagagcaagaccttgtcgcaaaaaaaaaaaaaaraaaaaaaaaaagaaaagaaaggaaggaagggagggagagaagaagggatattaattgagtacttaccatgtgccaggcattccaatcacaagtgctgagg

SEQ ID NO: 22375 - DNA, 201 bp, Homo sapiens
acttaggaactcaattctgtgatagcaaaatacagaaatagagattatactttaggctaggtgttgtggctcacacctgtaatcccaatgcttttggaggstagggtgggaggatcactcgaagccaggagcttgagaccagactggacaacatagtgagaccccccacctctacaaaaaattaaaaaaaaaaataagcca

SEQ ID NO: 22376 - DNA, 201 bp, Homo sapiens
ggtctcacctggttagcttttattttcatcatgataaagtatgtatattacttgaagtttaccattttattattttttatcttactttatttttttgaggyggagtttcgctcttgttgcccaggctggagtgcaatggcgcaatctcagctcactacaacctctgcctcccgggttcaagtgattctcctgcctcagcca

SEQ ID NO: 22377 - DNA, 201 bp, Homo sapiens
catgataaagtatgtatattacttgaagtttaccattttattattttttatcttactttatttttttgaggcggagtttcgctcttgttgcccaggctggwgtgcaatggcgcaatctcagctcactacaacctctgcctcccgggttcaagtgattctcctgcctcagccacccgagtagctgggactacagacacctgc

SEQ ID NO: 22378 - DNA, 201 bp, Homo sapiens; identical to SEQ ID NO: 4078

SEQ ID NO: 22379 - DNA, 201 bp, Homo sapiens
attttttatcttactttatttttttgaggcggagtttcgctcttgttgcccaggctggagtgcaatggcgcaatctcagctcactacaacctctgcctccygggttcaagtgattctcctgcctcagccacccgagtagctgggactacagacacctgccaccacacatggctaatttttgtatttttagtagagatgggg

SEQ ID NO: 22380 - DNA, 201 bp, Homo sapiens
gctccccacttcatgtcttctgtcatctccaggccctctcagccttccagccccctcgttttggctgcctctaaggccctccaggtcctcctgggcttcckcctctacaatcttccctgtctttcccaccgccaccacccccagttcctcagccgcctgcgcctcccgctctacagtggggactgcatctcccaggaggta

SEQ ID NO: 22381 - DNA, 201 bp, Homo sapiens
gtgtggccaatacctatttttcagggtagttgtaagaaatagagatgagagaaagaatcgaagaacaagattttgtagtgtgtgtgtgtgtgtgtgtgtgygtgtgtgtgtgtgtgtgtgtgtgtgtgtgtgtgtgtgttttaagcattgggattgggccgggccaggtggctcatgcctgtaatcccagcactatgggag

SEQ ID NO: 22382 - DNA, 201 bp, Homo sapiens
gtggccaatacctatttttcagggtagttgtaagaaatagagatgagagaaagaatcgaagaacaagattttgtagtgtgtgtgtgtgtgtgtgtgtgtgygtgtgtgtgtgtgtgtgtgtgtgtgtgtgtgtgtgttttaagcattgggattgggccgggccaggtggctcatgcctgtaatcccagcactatgggaggc

SEQ ID NO: 22383 - DNA, 201 bp, Homo sapiens
aggctgaggttgagaattttttttttttttttttgggatggagtctctctctgttgcccaggctggagtgcagtgctgcgatcttggctcactgcagcctytgcctcccaggttcaagtgattctcctgcctcagccttccaagtagctgggactacagaaccactacacccagataatttttgtatttttagttgagatg

SEQ ID NO: 22384 - DNA, 201 bp, Homo sapiens
ctgcccagcggatgtttggcaacgtctgcaggcatgctttggttgtcacaactgagggatgctatgggcatctagcgggcagaggccagggatcctgctawatgcgctgccatatacaggacagccctcaccatgcagaacaaccagcaccaaacgccaagagtgctgcaattgagaaatcctggtttcgatggtcccact

SEQ ID NO: 22385 - DNA, 201 bp, Homo sapiens
gaacaagattttgtagtgtgtgtgtgtgtgtgtgtgtgtgtgtgtgtgtgtgtgtgtgtgtgtgtgtgtgtgtgtgttttaagcattgggattgggccggsccaggtggctcatgcctgtaatcccagcactatgggaggctgaggcaggtggatcatttgagcttggtagttcaagtccagcctgggcaacatggcacaa

SEQ ID NO: 22386 - DNA, 201 bp, Homo sapiens
tgtagtcttagctactgggaagctgaggtgggaggatcacttgaacccatgaggtcaaggctgcagtaaccaaggtcatgccactgcactccagcctaggsaatagagcgagaccctgtctcccagaaaaagaaaaaagaaaggaaaagtcggaaccttcctctgtcgcctaggctggagtacagtggcatgatcataggt

SEQ ID NO: 22387 - DNA, 201 bp, Homo sapiens
tttacctcaggcaaagagacaggctttcaaataatgtttctaactataagaaaatgtacagttcttttattctagatagttaattataatagaattggtgrctttgaagtcagtgggttatttatcttgagggtggtgagcaaattcaactgcccttggcaaacagtagtttacagctttaagggcgcaaacacccttcct

SEQ ID NO: 22388 - DNA, 201 bp, Homo sapiens
ataatagaattggtgactttgaagtcagtgggttatttatcttgagggtggtgagcaaattcaactgcccttggcaaacagtagtttacagctttaagggsgcaaacacccttccttacaacagtctaataaaaggagtttcatataaccagcattcattgtttcaaggttacaaatccacagcccctgcaggtaactgtt

SEQ ID NO: 22389 - DNA, 201 bp, Homo sapiens
ttgcagtgagccgagattgcagtactgtactccagcctgggccacagagcgagactccatctccaaaaaaaaagacttaggaactcaattctgtgatagcmaaatacagaaatagagattatactttaggctaggtgttgtggctcacacctgtaatcccaatgcttttggaggctagggtgggaggatcactcgaagcca

SEQ ID NO: 22390 - DNA, 201 bp, Homo sapiens
gctgaggtgggaggatcacctgagcctgggaggtcaaggttgcagcaaaccaagatcctgccactgcactccagcctgggcaacagagcaaaaccctgtcaaaaaaaaaaaaaaatctggtctaagcaccacctttgatggaggcaggaatcctgcagcagcctggagccaacccaatggctccctgcctctggtgctcta

SEQ ID NO: 22391 - DNA, 201 bp, Homo sapiens
aggcattccaatcacaagtgctgaggccctgcggtggggataagctgggatgttctagaaccagagaatggccagtgagactgggcagggtgggccaatgsccatctgtggagctgtacaagagacattggccgggcgtggtggttcatacctgtaatcccagcactttgggaggctgaggcagatggatcatttgagatc

SEQ ID NO: 22392 - DNA, 201 bp, Homo sapiens
actgtagcttcaacctcctgggcacaagtgatcctcccacctcagcttccaaggtacctgtgactacaggaatgcgccaccatgcccggctaattttgttwtatatatatatatatatatttgtaccttggttttctcatctgtaacaccaggggttgaagtgctgtgatattttttggttctaggataatttggaaatag

SEQ ID NO: 22393 - DNA, 201 bp, Homo sapiens
actacaggaatgcgccaccatgcccggctaattttgttatatatatatatatatatatttgtaccttggttttctcatctgtaacaccaggggttgaagtsctgtgatattttttggttctaggataatttggaaatagggatctcttaacatcttggatactgccaatagatcattcacgaaatccctttagatgagtgt

SEQ ID NO: 22394 - DNA, 201 bp, Homo sapiens
gtaccttggttttctcatctgtaacaccaggggttgaagtgctgtgatattttttggttctaggataatttggaaatagggatctcttaacatcttggatmctgccaatagatcattcacgaaatccctttagatgagtgttatgtttacttaggtctctaaaacaatttgtaaggtcaacagatggggataagaatgacc

SEQ ID NO: 22395 - DNA, 201 bp, Homo sapiens; identical to SEQ ID NO: 4074

SEQ ID NO: 22396 - DNA, 201 bp, Homo sapiens
aggctgaggagaagaatcgcttgaacccaggaggcagaggttgcagtgagccgtgattgtgccactgcactccaggctgggcaacagagcgagactccgtytaaaaaaaaaaaaaacacacactttgaactagccagacacacctggcccttcacaagattagtgcttaggacaagtctaagtagaaaaagtgagtccatt

SEQ ID NO: 22397 - DNA, 201 bp, Homo sapiens
aagttctggcctagcacagagtgaacgtataattaatgggagctagagcgaccattagaataataatggccagaaaacagaactgactcgctaggtatgasccagcagtccgaacaagggcctgctgagcacagtggctcacagctgtaatcccagtgctttaggaggctgaggctggaggaccactagaggctagaaatt

SEQ ID NO: 22398 - DNA, 201 bp, Homo sapiens
ctggtgctctatttcttatcaccatacaggtctctaaggtcacctttaggtctaacattgtatgaatgattgtcagcaactttccaatttttttcatatayatatattttttttattttattttttactttttctttttttgagacaggatctcactctgtcacccaggctggagtgcagtggcgtgatcatagctcactg

SEQ ID NO: 22399 - DNA, 201 bp, Homo sapiens
cctgtttggccagctcctgcctctccttggccacgtggttgggagggttgtcccctggaagctctgcggtctcactctattctcctgtcccaggctgtgcycctggcggacatcctccccacactcgtcatcaaattgttggctcctcttggccttcacctgctgccctacaggtctgggtgagggtagtgggaggcaggg

SEQ ID NO: 22400 - DNA, 201 bp, Homo sapiens
atctctacaaaaattagccaggtgcagtggcgcacacctgtagtcttagctactgggaagctgaggtgggaggatcacttgaacccatgaggtcaaggctkcagtaaccaaggtcatgccactgcactccagcctaggcaatagagcgagaccctgtctcccagaaaaagaaaaaagaaaggaaaagtcggaaccttcctc

SEQ ID NO: 22401 - DNA, 201 bp, Homo sapiens
aattagccaggtgcagtggcgcacacctgtagtcttagctactgggaagctgaggtgggaggatcacttgaacccatgaggtcaaggctgcagtaaccaakgtcatgccactgcactccagcctaggcaatagagcgagaccctgtctcccagaaaaagaaaaaagaaaggaaaagtcggaaccttcctctgtcgcctagg

SEQ ID NO: 22402 - DNA, 201 bp, Homo sapiens; identical to SEQ ID NO: 4087

SEQ ID NO: 22403 - DNA, 201 bp, Homo sapiens
ctgctactctttcttcccaggcaaaacaggaaccacaaaccccagcttcctcttgcagagtggctgtggcttgtaggggaggcagaaatggctgaggtgcsgatacgagacctgagtcacttgagctgctgttgccacatgtcccctccctctccccctccccagttctaaggtctcctgctcccactttgtcctttctgg

SEQ ID NO: 22404 - DNA, 201 bp, Homo sapiens
ttccttaacctgggctcctccagccagggcccccagggaaagggctgggactctcctcaatgactctcccctctctctctcttttttcctaggattccctyggcacctttgtctcctacctcctgggagatgcagtccccactgtagagcgggaggcgcaggcggctgaggaactgggggtggtggcggtgggaaagacag

SEQ ID NO: 22405 - DNA, 201 bp, Homo sapiens
gcggaggtgccgctgcagatcgcggaggtccagcctcatggcccacagctgcatcctctccatgttggtccagcggccctgggtccccagccctcccagcrgggcatggaagggctgaagcgtggtggagatgaagcagagacgctccgggtcctgaaggggagggagatggtcaggaaaggtccacaggccaaggatggc

SEQ ID NO: 22406 - DNA, 201 bp, Homo sapiens
gagatgaagcagagacgctccgggtcctgaaggggagggagatggtcaggaaaggtccacaggccaaggatggccatatcacacccaccccctccctatcygggtctccttcccattccacgctccagcctccagtccatccctgtagctcttcccccacctcagcccagctgtgtccccattccttccatctccactgtc

SEQ ID NO: 22407 - DNA, 201 bp, Homo sapiens; identical to SEQ ID NO: 4195

SEQ ID NO: 22408 - DNA, 201 bp, Homo sapiens; identical to SEQ ID NO: 4196

SEQ ID NO: 22409 - DNA, 201 bp, Homo sapiens
gttccaggctgcagggagctgtgattgcactactgcattccaacctgggaaacagagcaagaccctgtctcaaaaagaaaaaaaaataagataaaataaaataaattaaaaaaataaaaaagttttagtagtgatgcatttatttaaacgttcactaggaaaacgctggttttccaagtggagtcgtgatttaaagttttc

SEQ ID NO: 22410 - DNA, 201 bp, Homo sapiens
tttccagcctccctttcactcctatgccaatgatcttctctaacccaccccctctcagtccctgaagcactctccatccacagccctgttcccttccctcytccaccatcccatcatacctcctgcccatgtgtttccatcccatcttcagcctcattcccattcctaaccccaactccatccttcctccatgtgcccaga

SEQ ID NO: 22411 - DNA, 201 bp, Homo sapiens
agttccaggctgcagggagctgtgattgcactactgcattccaacctgggaaacagagcaagaccctgtctcaaaaagaaaaaaaaataagataaaataaaataaattaaaaaaataaaaaagttttagtagtgatgcatttatttaaacgttcactaggaaaacgctggttttccaagtggagtcgtgatttaaagtttt

SEQ ID NO: 22412 - DNA, 201 bp, Homo sapiens; identical to SEQ ID NO: 4198

SEQ ID NO: 22413 - DNA, 201 bp, Homo sapiens; identical to SEQ ID NO: 4197

SEQ ID NO: 22414 - DNA, 201 bp, Homo sapiens
gagttccaggctgcagggagctgtgattgcactactgcattccaacctgggaaacagagcaagaccctgtctcaaaaagaaaaaaaaataagataaaataaaataaattaaaaaaataaaaaagttttagtagtgatgcatttatttaaacgttcactaggaaaacgctggttttccaagtggagtcgtgatttaaagttt

SEQ ID NO: 22415 - DNA, 201 bp, Homo sapiens; identical to SEQ ID NO: 4199

SEQ ID NO: 22416 - DNA, 201 bp, Homo sapiens; identical to SEQ ID NO: 4200

SEQ ID NO: 22417 - DNA, 201 bp, Homo sapiens
ggagttccaggctgcagggagctgtgattgcactactgcattccaacctgggaaacagagcaagaccctgtctcaaaaagaaaaaaaaataagataaaataaaataaattaaaaaaataaaaaagttttagtagtgatgcatttatttaaacgttcactaggaaaacgctggttttccaagtggagtcgtgatttaaagtt

SEQ ID NO: 22418 - DNA, 201 bp, Homo sapiens; identical to SEQ ID NO: 4201

SEQ ID NO: 22419 - DNA, 201 bp, Homo sapiens
aggagttccaggctgcagggagctgtgattgcactactgcattccaacctgggaaacagagcaagaccctgtctcaaaaagaaaaaaaaataagataaaataaaataaattaaaaaaataaaaaagttttagtagtgatgcatttatttaaacgttcactaggaaaacgctggttttccaagtggagtcgtgatttaaagt

SEQ ID NO: 22420 - DNA, 201 bp, Homo sapiens; identical to SEQ ID NO: 4221

SEQ ID NO: 22421 - DNA, 201 bp, Homo sapiens
aggaggtgctgccaacagctggagcgaggtgagggctcttggtggggtctcggggggaacgagtggaatcccgaagccggccccatggtcctctgtgcccsctttcctgcaggccccgctccccgggtccctcctagacgtctctgtcccaaggagtcgcgtgcacctctcgagaagctcctcacagcgtcgctcccggcc

SEQ ID NO: 22422 - DNA, 201 bp, Homo sapiens; identical to SEQ ID NO: 4204

SEQ ID NO: 22423 - DNA, 201 bp, Homo sapiens; identical to SEQ ID NO: 4206

SEQ ID NO: 22424 - DNA, 201 bp, Homo sapiens; identical to SEQ ID NO: 4207

SEQ ID NO: 22425 - DNA, 201 bp, Homo sapiens; identical to SEQ ID NO: 4208

SEQ ID NO: 22426 - DNA, 201 bp, Homo sapiens; identical to SEQ ID NO: 4209

SEQ ID NO: 22427 - DNA, 201 bp, Homo sapiens
ctcccacacactctcacactcacagacccacactcacacactctcacagtcacactgtcacactcatggacccacacagtcacactcactctcccacactyacggacccacacagtcactctcacactcatgaacccacacactcatggacactcagtcacactcacactctcacactcacacacactcagagcatgggat

SEQ ID NO: 22428 - DNA, 201 bp, Homo sapiens; identical to SEQ ID NO: 4191

SEQ ID NO: 22429 - DNA, 201 bp, Homo sapiens; identical to SEQ ID NO: 4192

SEQ ID NO: 22430 - DNA, 201 bp, Homo sapiens
acacactcacagtcacactcacacacggacgcacatacacacagtcatgctcacactcatacagcccccccacacacacactcacagtcacacccacacastctcacagtcaggtacactcacacagacccacacactcactctcacactcacggacccacaccctcacacacagtcatgctcacactcatacagacccac

SEQ ID NO: 22431 - DNA, 201 bp, Homo sapiens; identical to SEQ ID NO: 4194

SEQ ID NO: 22432 - DNA, 201 bp, Homo sapiens
tctgttagtgggggccagaagggattgggggtctgcccatctccagcgccagctgcattagggggacttacaaagcggtgggcctggccccgaacctcggmgagcagcttcctggcgagatgcaggctgactgtgaactccctccgcagctcctgcaggctcagctggggcctccctgggggccttgggaatccccagaca

SEQ ID NO: 22433 - DNA, 201 bp, Homo sapiens
cccaagacaataaataaaccatcatctccctaaacaataaataaatatccaagaaataaatagctggcgaggaccagaggggctttcagttactgggtagrgcctggggcagggggctggaagagccctcccttgtccaaggctgatgatgcgaaggctgccctgatgccaagactccagtcctaaagttctaaagggtgg

SEQ ID NO: 22434 - DNA, 201 bp, Homo sapiens; identical to SEQ ID NO: 4203

SEQ ID NO: 22435 - DNA, 201 bp, Homo sapiens; identical to SEQ ID NO: 4205

SEQ ID NO: 22436 - DNA, 201 bp, Homo sapiens
agcttcctcttgcagagtggctgtggcttgtaggggaggcagaaatggctgaggtgcggatacgagacctgagtcacttgagctgctgttgccacatgtcycctccctctccccctccccagttctaaggtctcctgctcccactttgtcctttctggcctcttgcttgtcctttatttccaaatgtgcacctgagtcccc

SEQ ID NO: 22437 - DNA, 201 bp, Homo sapiens
ataaaaatggtattaattgatgaactgacacctttaagtagatgataagggatggcaattggggcaccagaagagggtctggctctggctgggagcagaakggttaacccacaacagtccctcacatggtaaaacgcctgacatgtggtgcagctgcaaatgcatgagcagacagtggtggaatctgtgaagttgtcttct

SEQ ID NO: 22438 - DNA, 201 bp, Homo sapiens
gtgagccatgcagggagagggtgattgctggccatggtagggacttcctatgtggtttggaatcctaaattttaagagaccagtcagcgtactgtgtgctkctctccagcctcctgcagctcatgggggcaggctcagcataggcagaggtggaacccaccagctgtgtagttttgccaggtgagtgtgacaattcaaggg

SEQ ID NO: 22439 - DNA, 201 bp, Homo sapiens
acatagaattgaaaatgaaccatcacatgtaggttattttttacacccttaagtcctgcccaagccagggctgggccaaggccctcgaacatccagctgtrgcctcctcctgctgcaggtgaggagtgggcagcagggagggccgtggtgcctgctttgtccccatcccggtctctgtctctcaggcttaccaggttgcat

SEQ ID NO: 22440 - DNA, 201 bp, Homo sapiens
gatagcgaattggttagccacttttcagtctcgggcagttttgttttccaaaacatgggtttttatctcaggaccttcttgtccccagatgatcaaaaccrgggccatccactcccttctgagccacctctgcctggggggcccgtggctgtgtcctccagtcacaacagaacactccttcagaacactcgcaggaagaca

SEQ ID NO: 22441 - DNA, 201 bp, Homo sapiens
ctcagacagctccttgcctcacctgccacagtcctccctctcccctggcctccaagtacccgggagtgcgagcctgggccccgggaaccggcaccttgagrgctggagagggaccccgcccgctccctgtctccctgacgcgctctctccgcctccccgcggggacccagcctcccgggctccctcctgcctaccgcccgg

SEQ ID NO: 22442 - DNA, 201 bp, Homo sapiens
cctcctgcttggaacttctgacctcccctctccagcttctcctctgccttcctcctctgcagaatctgactccaaccagggcaggctctctgcttttaatrgctcttgtgatttgattgggcccacacagagagtccagcagaatctccctattttaaggtccttaatcttcattacatgagtaatatcccttttgccacg

SEQ ID NO: 22443 - DNA, 201 bp, Homo sapiens
agacagctccttgcctcacctgccacagtcctccctctcccctggcctccaagtacccgggagtgcgagcctgggccccgggaaccggcaccttgagggcdggagagggaccccgcccgctccctgtctccctgacgcgctctctccgcctccccgcggggacccagcctcccgggctccctcctgcctaccgcccggccc

SEQ ID NO: 22444 - DNA, 201 bp, Homo sapiens
cagattggctaatttaaagagagtgaaacaggtgatcagaatgagtcagggtggtgcaggtaactggaatgagtcaggctggggcaagtaatcaggatgartcagggtggagcaggtaatcagaatgagtcagggtggagcaggtgactggaatgagtcagggtggagcaggtaaccagaatgagtcaggctggagcaagt

SEQ ID NO: 22445 - DNA, 201 bp, Homo sapiens
tcaaatagttccaagacttcagtgccataagaatgatgccttgaaaataagtctttgttttgtctaagatgtctcaaatttagtggaagtatgccccaagygccaattttcttattgacatatcatcttcagaaaacatttgcctacacttaaaaaaaaaatacacacacactgctctgtctatggagtagccattctttt

SEQ ID NO: 22446 - DNA, 201 bp, Homo sapiens
tatactgtccacacttctctggtgacaaacttaatgtgtagttcagtgggctgtcttttgtctgcttttaagggtaccctcctttgcaaaccaggacctcrtaccctgcacagcccagtgttctgagataaaacatgtcaaataccccattaggtgaatctaagagattagacatggagccatacctgcttccaccgtttg

SEQ ID NO: 22447 - DNA, 201 bp, Homo sapiens
tgttactttttccagcccccgagggtcatagtacccagtgggctgttttttgggctttgttctgtgctctgtggcctcaccttgcctttcctgagccaatktttttgttcttagtgtagtcgctgcctggtaagtttaaaataagagacagtcagaatcatgtcccccacagtcaggttgtttgaggggagaggaaaagag

SEQ ID NO: 22448 - DNA, 201 bp, Homo sapiens
gaggagactcctcttctcaccaggtggtctctgggcatatactgtccacacttctctggtgacaaacttaatgtgtagttcagtgggctgtcttttgtctscttttaagggtaccctcctttgcaaaccaggacctcgtaccctgcacagcccagtgttctgagataaaacatgtcaaataccccattaggtgaatctaag

SEQ ID NO: 22449 - DNA, 201 bp, Homo sapiens
agggtcatagtacccagtgggctgttttttgggctttgttctgtgctctgtggcctcaccttgcctttcctgagccaatttttttgttcttagtgtagtcrctgcctggtaagtttaaaataagagacagtcagaatcatgtcccccacagtcaggttgtttgaggggagaggaaaagagcaagcagaaagttttgagttt

SEQ ID NO: 22450 - DNA, 201 bp, Homo sapiens
aagggatacaatgtccccagacctaccagagaaggcaaactcatacagcttgcaggaccagacaaggacaagaaacaagttcaaaagagggaaagggaaaytacagacgtacctcagagatactgcagatttggtttcagaccatggcaacaaacaagtcacacaaatttttgtttttccagtacatataaaagttatatt

SEQ ID NO: 22451 - DNA, 201 bp, Homo sapiens
cctggggatgaggatctattacctgggcctggagaggaggagactcctcttctcaccaggtggtctctgggcatatactgtccacacttctctggtgacamacttaatgtgtagttcagtgggctgtcttttgtctgcttttaagggtaccctcctttgcaaaccaggacctcgtaccctgcacagcccagtgttctgaga

SEQ ID NO: 22452 - DNA, 201 bp, Homo sapiens
tgggctgttttttgggctttgttctgtgctctgtggcctcaccttgcctttcctgagccaatttttttgttcttagtgtagtcgctgcctggtaagtttavaataagagacagtcagaatcatgtcccccacagtcaggttgtttgaggggagaggaaaagagcaagcagaaagttttgagtttctgcaaagacagaggca

SEQ ID NO: 22453 - DNA, 201 bp, Homo sapiens
tgtgtagggagcctcactagtccaacagagcttggtaccagtgtcatatgccaggaaccaaggttataagggatacaatgtccccagacctaccagagaargcaaactcatacagcttgcaggaccagacaaggacaagaaacaagttcaaaagagggaaagggaaactacagacgtacctcagagatactgcagatttgg

SEQ ID NO: 22454 - DNA, 201 bp, Homo sapiens
tggatctctggtttccacacttctgcctttattgtgtgaaagtagccatgcctcctcctggggatgaggatctattacctgggcctggagaggaggagackcctcttctcaccaggtggtctctgggcatatactgtccacacttctctggtgacaaacttaatgtgtagttcagtgggctgtcttttgtctgcttttaag

SEQ ID NO: 22455 - DNA, 201 bp, Homo sapiens
ctactctcacttgcaatggggtgagggaaaacagaaggcccccaggtggatctctggtttccacacttctgcctttattgtgtgaaagtagccatgcctchtcctggggatgaggatctattacctgggcctggagaggaggagactcctcttctcaccaggtggtctctgggcatatactgtccacacttctctggtgac

SEQ ID NO: 22456 - DNA, 201 bp, Homo sapiens
aacagcacctaattatcatgttacagtcctgtaggttgcaagtccacacagtcttatggggctaagatcaaggtatgggcaggtctgtgttccctcctggrgactctggggaagaatccatttccaagctcattcaggttcttgtctgaattcacttccttgcacatagaacagaggtttccacttccttgttaagagcca

SEQ ID NO: 22457 - DNA, 201 bp, Homo sapiens
ggaggattacccaggagtgtgactcaaaccttctgccctgatgggtctgggcccttggaaatcaaatcctctcaggctgaattgctggataattctactcwcacttgcaatggggtgagggaaaacagaaggcccccaggtggatctctggtttccacacttctgcctttattgtgtgaaagtagccatgcctcctcctgg

SEQ ID NO: 22458 - DNA, 201 bp, Homo sapiens
agagagaggagaaggtcatggaggagaggagttccaggatctgagagtccagggagcaagggcatcttctctgctgtataggtgtctattgctgccataaraattaccacaaaccaagtggctttaaacagcacctaattatcatgttacagtcctgtaggttgcaagtccacacagtcttatggggctaagatcaaggta

SEQ ID NO: 22459 - DNA, 201 bp, Homo sapiens
cataattgtgtgagccaattagcccaataaatcacctatctatctatctgtctgtctatctatctatctatctatctatctatctatctatcatcatctawcatctatctatcatctatcatctatctatctattatctatctatcatctatgtacctatgctattggttctttctttcttggtaaccttaataaatcaac

SEQ ID NO: 22460 - DNA, 201 bp, Homo sapiens
ggggccatccattccattctgagccacttctgcccaggggcccatggctatttcctccagtcacaacagaacaccccttcagaacagcctgcaggaaggcmccgtctcctcacaggctcacacatgcacggtgtgtgcacagagcttttgctctagttcaggaggtgtgtagggagcctcactagtccaacagagcttggt

SEQ ID NO: 22461 - DNA, 201 bp, Homo sapiens
agtctgtgtcctcagagcctgtggccaccttgcatgggatgagtggaaagatggccagagagtgggaagtgtgaaattgagagtatggaagggctggggtycttgggcatgatgaggcctaggggatgacaggggcatgagattcaggcagagagaggagaaggtcatggaggagaggagttccaggatctgagagtccag

SEQ ID NO: 22462 - DNA, 201 bp, Homo sapiens
tccataattgtgtgagccaattagcccaataaatcacctatctatctatctgtctgtctatctatctatctatctatctatctatctatctatcatcatctaacatctatctatcatctatcatctatctatctattatctatctatcatctatgtacctatgctattggttctttctttcttggtaaccttaataaatca

SEQ ID NO: 22463 - DNA, 201 bp, Homo sapiens
gattgttggaattgatgtgctaaagggtggacttcaagcctggaatgcaggcacatatgcaatgagtagtcactgatattacctcacagcatatgataaartgatagagtctgtgtcctcagagcctgtggccaccttgcatgggatgagtggaaagatggccagagagtgggaagtgtgaaattgagagtatggaagggc

SEQ ID NO: 22464 - DNA, 201 bp, Homo sapiens
gttcgatgatctttggactctgacttttgcaccagtgagcccctttatcctcctgttctgtattctgggtcctcagggctttgactttggactgagccacrctactggcttttctagttctccagcttccagacagtctatcatgggacttctcagcctccataattgtgtgagccaattagcccaataaatcacctatct

SEQ ID NO: 22465 - DNA, 201 bp, Homo sapiens
ccaggacttggggctctggcactttcttctcactgtgcgtcctccttctctggctcaaaagagaaccacatgtaacagaaaccaagggctacaattctcayagaacccagaaaactggactaggggcctagagagtcatgtgcctgccattgttccaccgcttacgtgctgtgtgacctcaggagaagctctctgctcttt

SEQ ID NO: 22466 - DNA, 201 bp, Homo sapiens
cccagctacttgggtgtctgaggtgggagggttgcttaagcctggaagattcaggctgcagtgagccatgaacaacactgcactccagccagcaagcccartctcaaaaaaataaattatagactactcaaattgtaagtattaaaccagtgtctgtgagagtttttctggaagggatgtgagtgggtggactggtgggga

SEQ ID NO: 22467 - DNA, 201 bp, Homo sapiens
atgcctgtacttccagcactttgggaggctcaggctggcagattgcttgagcccctgagtttgtgaccagcctaggcaacatagagaaaccctgtctctasaaaaaattcaaaagaattagccgggcttggtggcacatgcctgtagtcccagctacttgggtgtctgaggtgggagggttgcttaagcctggaagattca

SEQ ID NO: 22468 - DNA, 201 bp, Homo sapiens
gttttctcagtgaggtaggaaccaaggttgtcagctgagataagaatggggaaggagggttggatgtgtgagcacagagagaaggtgtgtaagggtcaccyaggccaggaggaggctgagggtgagccatgcagggagagggtgattgctggccctggtgggggctccccatgtggtttgggtcatgaagttagagaagac

SEQ ID NO: 22469 - DNA, 201 bp, Homo sapiens
agttttggggttttttttaagatggagtctcactctgtcccccaggggctggagtgcagtggcatgatctcggctcactgcaacctctgcatctcggatgmaagtgagtcttctgcctcagcccctcgagtagctgggattacagatgtgcactaccacgcctggctaattttgtgtttttaatatagatggggttacact

SEQ ID NO: 22470 - DNA, 201 bp, Homo sapiens
gaactgacacctttaagtagatgataagggatgacattttgggcaccagaagagggactggctctgatgggagcagaatggtttacccacaacagtccccracatggtaaaacacctgacatgtgttgcagctgcaaatgcatgagcagatggtgatggaatctgtcttctaatgtgttcagttttctcagtgaggtagga

SEQ ID NO: 22471 - DNA, 201 bp, Homo sapiens
tcctcccggcgcggctacccgggtcctgcgtccccgccgggcgggccccttgcttctccccgcagaggcggtttccccacgaccccgcactcacccgcccwggtctgggtcagggccagggcccccaagagtagcaggaggagggttcggggcgccatgacggccatcctcggcgtctggggagaatctgagtcccggtgg

SEQ ID NO: 22472 - DNA, 201 bp, Homo sapiens
ccataccaaaaccctaggttctcagggactcagattttcatctgtggaagaaaagaatccatctcactctctcaggtgtgatggtaattatatatattataatataatatatatatacataattataatttatatatctataaaagagataatcagtattccataaattgatgatattctcagtgttgacttcattgccca

SEQ ID NO: 22473 - DNA, 201 bp, Homo sapiens
cccataccaaaaccctaggttctcagggactcagattttcatctgtggaagaaaagaatccatctcactctctcaggtgtgatggtaattatatatattataatataatatatatatacataattataatttatatatctataaaagagataatcagtattccataaattgatgatattctcagtgttgacttcattgccc

SEQ ID NO: 22474 - DNA, 201 bp, Homo sapiens
acccataccaaaaccctaggttctcagggactcagattttcatctgtggaagaaaagaatccatctcactctctcaggtgtgatggtaattatatatattataatataatatatatatacataattataatttatatatctataaaagagataatcagtattccataaattgatgatattctcagtgttgacttcattgcc

SEQ ID NO: 22475 - DNA, 201 bp, Homo sapiens
aacccataccaaaaccctaggttctcagggactcagattttcatctgtggaagaaaagaatccatctcactctctcaggtgtgatggtaattatatatattataatataatatatatatacataattataatttatatatctataaaagagataatcagtattccataaattgatgatattctcagtgttgacttcattgc

SEQ ID NO: 22476 - DNA, 201 bp, Homo sapiens
ggctcttatggcaacttcttaaaataagacaatgaagtttgcggcatggattataaagggggaatcagtacttaagtaaggtcaatataagttttcaagtyaggtggacctgaatatgaaccctccaggcctttccaccagctagctatagagccttggacacatcttggccatagctggccctgacagacacttgcccag

SEQ ID NO: 22477 - DNA, 201 bp, Homo sapiens
cgcagacaatggtgctgaggctgtgggagatgagggaggaggagcaggggtggctctcacctgggctctgtccgtggaggtgaggacaatgaggtggttgkgtctcagtgctgtgtggaactttcttttgacctccttatgagtggatggtctgtctgagatagaacgggtcttagaggatttactcattaccctgagaga

SEQ ID NO: 22478 - DNA, 201 bp, Homo sapiens
ctgtgctctgtggcctcaccttgcctttcctgagccaatttttttgttcttagtgtagtcgctgcctggtaagtttaaaataagagacagtcagaatcatdtcccccacagtcaggttgtttgaggggagaggaaaagagcaagcagaaagttttgagtttctgcaaagacagaggcagtgcaggggacagtgagagtctg

SEQ ID NO: 22479 - DNA, 201 bp, Homo sapiens
gagtgcgagcctgggccccgggaaccggcaccttgagggctggagagggaccccgcccgctccctgtctccctgacgcgctctctccgcctccccgcgggdacccagcctcccgggctccctcctgcctaccgcccggccctggagccgcttacctgggagcttcttacggtgtagggggagctggggaggggacagaggg

SEQ ID NO: 22480 - DNA, 201 bp, Homo sapiens
tcccccacagtcaggttgtttgaggggagaggaaaagagcaagcagaaagttttgagtttctgcaaagacagaggcagtgcaggggacagtgagagtctgrggtgtccaggaaacccgagtctttctgccatttctccacttccgtgtgtctggccagtgaggtggtggtgactcatccttgaacctaattgcacagttag

SEQ ID NO: 22481 - DNA, 201 bp, Homo sapiens
tgcaagatgaaacagtttgtctgttaccttggaggggacacacctgcattcccctaaacacttggccattgttcacccataaaactttacttcaatgcccrctatctttttctttttgagatggaattttgctcttgttgcccactctggagtgcaatggcacgatcttggctcactgcaatctctgcctcctgggttcaa

SEQ ID NO: 22482 - DNA, 201 bp, Homo sapiens
acctaattgcacagttagttggccactcaggcctgggcagatgggacggttcatcccctgccctgcagcaagagggccccgtccaggaggcaaccacagcrcgggcagtgcaggtctgtggttgctcctgctctcacctgcggtgtctcctatagagggattgtcagttctggttccctgtaggcaggaaaggttttctcg

SEQ ID NO: 22483 - DNA, 201 bp, Homo sapiens
aaaaaggcatgaaaattacatgttagtttctcaaaattcctgctttaagtattggtgtccatcaacataatttcagctggataatcttaataggatttccbccaatactgatgttgtaaaggatgttgaatagaacaggaagtcaaatttggggcttcgtttctcagagggtccatgtgggagacagtgcctgtggcagtg

SEQ ID NO: 22484 - DNA, 201 bp, Homo sapiens
ggcatgaaaattacatgttagtttctcaaaattcctgctttaagtattggtgtccatcaacataatttcagctggataatcttaataggatttcccccaahactgatgttgtaaaggatgttgaatagaacaggaagtcaaatttggggcttcgtttctcagagggtccatgtgggagacagtgcctgtggcagtggcaat

SEQ ID NO: 22485 - DNA, 201 bp, Homo sapiens
aaatgcaggttatggggagggcaggctgggcctccttgagcaagggggtccccagcatcaggtcaggtgcagactccatggcagccacatatttccatgcvgggcctgtgagccccagggcttcctgataggatctctagttaggagctgtctgctcagagctgggaggggaggaacagtgagctgctggtggagggcaga

SEQ ID NO: 22486 - DNA, 201 bp, Homo sapiens
caccaatgccactgaggatgtcagagcacaggagcacggccttggaggattacccaggagtgtgactcaaaccttctgccctgatgggtctgggcccttgraaatcaaatcctctcaggctgaattgctggataattctactctcacttgcaatggggtgagggaaaacagaaggcccccaggtggatctctggtttccac

SEQ ID NO: 22487 - DNA, 201 bp, Homo sapiens
tagtgtcactggtgtgacccatcactggttgggaatagtccatgggaagcagggcctcagcaccaatgccactgaggatgtcagagcacaggagcacggchttggaggattacccaggagtgtgactcaaaccttctgccctgatgggtctgggcccttggaaatcaaatcctctcaggctgaattgctggataattctac

SEQ ID NO: 22488 - DNA, 201 bp, Homo sapiens
gggaagagggtcatggtggacatgggggtgggttggtctccccacctcctcatattatgcctacaggaacacaggcacattcaggtgcctttgcagaaagwgagtcagggtttttgaagtcacaaagggaaggcgtgaacaaatcttgcctctcagtcccacacaaggcagctgtctcacactataaaataaaatattcat

SEQ ID NO: 22489 - DNA, 201 bp, Homo sapiens
aaaagtgccatgggagggagaaaaaagtggggacgtcatcttccgtcagagaaagggtaaatctgatttgggagtgactgaggagggagaactcctcaggraataaaaagcagcactctgcacccaggggagcatttattggtttctctcttttttccagagcgcgtgagcctgcaaggcctgggtcaacacctggttggg

SEQ ID NO: 22490 - DNA, 201 bp, Homo sapiens
ttctaaaacatgggtttttatctgagaatcttcctgttcccagatgatcaaaactggggccatccattccattctgagccacttctgcccaggggcccatkgctatttcctccagtcacaacagaacaccccttcagaacagcctgcaggaaggcaccgtctcctcacaggctcacacatgcacggtgtgtgcacagagct

SEQ ID NO: 22491 - DNA, 201 bp, Homo sapiens
ccttagtgtcactggtgtgacccatcactggttgggaatagtccatgggaagcagggcctcagcaccaatgccactgaggatgtcagagcacaggagcacrgccttggaggattacccaggagtgtgactcaaaccttctgccctgatgggtctgggcccttggaaatcaaatcctctcaggctgaattgctggataattc

SEQ ID NO: 22492 - DNA, 201 bp, Homo sapiens
tcctgccttagtgtcactggtgtgacccatcactggttgggaatagtccatgggaagcagggcctcagcaccaatgccactgaggatgtcagagcacaggrgcacggccttggaggattacccaggagtgtgactcaaaccttctgccctgatgggtctgggcccttggaaatcaaatcctctcaggctgaattgctggat

SEQ ID NO: 22493 - DNA, 201 bp, Homo sapiens
gttcgctcggtcagtctgtgactgggccttcacattccgtgtctgcaggtcccaatactccggcccctcctgctctatccacggtgcccgcggctccatcytctggctcgcggcgtcgctgtcaaaccgcacgaactgcgtgtcgtccacgtagcccacggcgatgaagcggggctccccgcggccgggccgggacacgga

SEQ ID NO: 22494 - DNA, 201 bp, Homo sapiens
cagtcaggttgtttgaagggaggggaaaagagcaagcagcaagttttgtgtttctgcaaagacagagacagtgcaggagacactgagagcctggagtgtcygggaaacccgagtctttctgccatttccccacttctgtgtatctggcagggggtggtgatttctcatccttgaacctaattgcactgtcagttggcccct

SEQ ID NO: 22495 - DNA, 201 bp, Homo sapiens
gaataagatgcaagtgtgacccccagtgatggaaagaaggaaggaaggattacttaacatgtcctagaccacaggcaatctaaggagagttgagcaaggchatggaggagtcctccagccacagctggccatcagaggagtcccctgtcttccaggaatgtcctgccttagtgtcactggtgtgacccatcactggttggg

SEQ ID NO: 22496 - DNA, 201 bp, Homo sapiens
gttgatgataaagagaaaaaaaggtattaattgatgaactgacacctttaagtagatgataagggatgacattttgggcaccagaagagggactggctctratgggagcagaatggtttacccacaacagtccccaacatggtaaaacacctgacatgtgttgcagctgcaaatgcatgagcagatggtgatggaatctgt

SEQ ID NO: 22497 - DNA, 201 bp, Homo sapiens
ggaaaaaggttgatgataaagagaaaaaaaggtattaattgatgaactgacacctttaagtagatgataagggatgacattttgggcaccagaagagggaytggctctgatgggagcagaatggtttacccacaacagtccccaacatggtaaaacacctgacatgtgttgcagctgcaaatgcatgagcagatggtgatg

SEQ ID NO: 22498 - DNA, 201 bp, Homo sapiens
cgaaaatgattttgtagtccaaatgctccaaaaagcaagtgccatcataggattaaagttacagcattttattaggggacacacctgtcagacgatatggkgagggaggtaggttaccctgggaaaggcaatagaataagatgcaagtgtgacccccagtgatggaaagaaggaaggaaggattacttaacatgtcctaga

SEQ ID NO: 22499 - DNA, 201 bp, Homo sapiens
ccaccccacatccttcagctctctcatggtgatgtgacccccacagtactttcagtgccttccacaagacacatgaggttgcctggttgctgtggtgcccrctttccaccccaccctcccgtacccccatgtcactttcattgtgtcctgaataacagtttcaagtttgtctatggcttctgcgaggagccaggacatcca

SEQ ID NO: 22500 - DNA, 201 bp, Homo sapiens
attggttgtgggttgtttaaacttatactgtgtagttttacatatctgtaacagcagtagtttgggcctcttatattctaataattaagactttcagctgwgtacacactgtaattcaagcacgagtcatgcataaccctagcactaagagacaagaggggaatccctctctctgaaaattttgcaaaattctgggttctt

SEQ ID NO: 22501 - DNA, 201 bp, Homo sapiens
tgatccagtggggagagaggaaaaaggttgatgataaagagaaaaaaaggtattaattgatgaactgacacctttaagtagatgataagggatgacatttkgggcaccagaagagggactggctctgatgggagcagaatggtttacccacaacagtccccaacatggtaaaacacctgacatgtgttgcagctgcaaatg

SEQ ID NO: 22502 - DNA, 201 bp, Homo sapiens
aacaaaaagattttacacgttggaataagtaagaggtcactggtgtgcagacgaaaatgattttgtagtccaaatgctccaaaaagcaagtgccatcatargattaaagttacagcattttattaggggacacacctgtcagacgatatggtgagggaggtaggttaccctgggaaaggcaatagaataagatgcaagtgt

SEQ ID NO: 22503 - DNA, 201 bp, Homo sapiens
acaatgatccagtggggagagaggaaaaaggttgatgataaagagaaaaaaaggtattaattgatgaactgacacctttaagtagatgataagggatgacrttttgggcaccagaagagggactggctctgatgggagcagaatggtttacccacaacagtccccaacatggtaaaacacctgacatgtgttgcagctgca

SEQ ID NO: 22504 - DNA, 201 bp, Homo sapiens
aaacaaaaagattttacacgttggaataagtaagaggtcactggtgtgcagacgaaaatgattttgtagtccaaatgctccaaaaagcaagtgccatcatrggattaaagttacagcattttattaggggacacacctgtcagacgatatggtgagggaggtaggttaccctgggaaaggcaatagaataagatgcaagtg

SEQ ID NO: 22505 - DNA, 201 bp, Homo sapiens
gaacccataccaaaaccctaggttctcagggactcagattttcatctgtggaagaaaagaatccatctcactctctcaggtgtgatggtaattatatatattataatataatatatatatacataattataatttatatatctataaaagagataatcagtattccataaattgatgatattctcagtgttgacttcattg

SEQ ID NO: 22506 - DNA, 201 bp, Homo sapiens
acaggattgactcatgaccctgagggatgtgctcactccaggtctcaggtctgtcctgacacctttatttgtggcttagagctccctactgtaaattattrggagttagttcattttggagtttataacttaaagcagaaattcagatggttgaaatgtcattttcatgaaggtttgttattagtgtatcatttagattgt

SEQ ID NO: 22507 - DNA, 201 bp, Homo sapiens
cacaatgatccagtggggagagaggaaaaaggttgatgataaagagaaaaaaaggtattaattgatgaactgacacctttaagtagatgataagggatgayattttgggcaccagaagagggactggctctgatgggagcagaatggtttacccacaacagtccccaacatggtaaaacacctgacatgtgttgcagctgc

SEQ ID NO: 22508 - DNA, 201 bp, Homo sapiens
aagtgaaggaagccagtcacaggaggctacgtaacttatgagcccatttttgtgaaatattcataagaggcaagtcgatagagaaagaagtggatttgtgrcgacagggtctgctggcaggtggaaatggagggtgactgcttaatgggtgcagagttccccctgaggtgataaaaacactctggaactagagagtgatga

SEQ ID NO: 22509 - DNA, 201 bp, Homo sapiens
gccactatcaattctgcttactctagctgaggggctgggatgtgcattctcatgactgccacaatgatccagtggggagagaggaaaaaggttgatgataragagaaaaaaaggtattaattgatgaactgacacctttaagtagatgataagggatgacattttgggcaccagaagagggactggctctgatgggagcag

SEQ ID NO: 22510 - DNA, 201 bp, Homo sapiens
tctccttcagaaatgatggagaaatcacgacattcacaggttaaaaaaagctgactgagattgtctcaaccctacaagacatatatatatacacacacacmtatatatatttgtaattcctctcttgtttttcctatttgatttaaaagaaaatgtccatcgaccaatgaatggagaaacaacatatagttttttcctaca

SEQ ID NO: 22511 - DNA, 201 bp, Homo sapiens
atcttgaaagcaataacagagaaggaacttttcaggtacaatggatcctcaataagattaacatacaaattttcatcagaaaccatggggttcaggaggcrttgggatgacaaatttaaagctgagaaagtaaaaggactatcaaccaagaattgtatgtctgcaaaactctccttcagaaatgatggagaaatcacgaca

SEQ ID NO: 22512 - DNA, 201 bp, Homo sapiens
tgcaattaaactagacagtaagacccattctcaagaaaaaagaggaattgacagaaactgttcctgagaaaggccattgaacatacttactggacaaacaactttgaattgactgcttaaatatgttcacagagctaaaggaaactatgggcaaaaaactaaaggaaatcagaagaactatcttaactcaaatagagaaca

SEQ ID NO: 22513 - DNA, 201 bp, Homo sapiens
gaactctcttaggtcacagaggcagagggcatctgctaaaaccatttaagtgccactgaaccagcagctgcccccttggggcaaaaatatattacatgagraaggtaatagacatacagaaaagcctggaggagaaactgggtgagtgagatgggaatatgggttttgaaaagcttccatatccctgggaatctgtatagc

SEQ ID NO: 22514 - DNA, 201 bp, Homo sapiens
ctactaaatatacaaaattagctgggtgtggtggctcgcgcctgtagtcccagctactcgggaggtgaggaaggagaatcgcttgaacccgggaggcagakgttgcagttagccgggatcatgccattgcactccaccctgggcaacaagagcaaaactccatcaaaaaaaaaaaaaaaaaaattccctcggagagctgtt

SEQ ID NO: 22515 - DNA, 201 bp, Homo sapiens
tcgagaccagactgatcaacatggagaatcccagtctctactaaatatacaaaattagctgggtgtggtggctcgcgcctgtagtcccagctactcgggargtgaggaaggagaatcgcttgaacccgggaggcagaggttgcagttagccgggatcatgccattgcactccaccctgggcaacaagagcaaaactccatc

SEQ ID NO: 22516 - DNA, 201 bp, Homo sapiens
atcctctggctcgcggcgtcgctgtcaaaccgcacgaactgcgtgtcgtccacgtagcccacggcgatgaagcggggctccccgcggccgggccgggacayggatgtggtgaaatacctcatggagtgggagcctgggggcgaggagtggctgagacccacccgaccctcctcccggcgcggctacccgggtcctgcgtcc

SEQ ID NO: 22517 - DNA, 201 bp, Homo sapiens
cacaggctaaactaattcagattggctaatttaaagagagtgaaacaggtgatcagaatgagtcagggtggtgcaggtaactggaatgagtcaggctgggrcaagtaatcaggatgagtcagggtggagcaggtaatcagaatgagtcagggtggagcaggtgactggaatgagtcagggtggagcaggtaaccagaatga

SEQ ID NO: 22518 - DNA, 201 bp, Homo sapiens
ttattcccctattggctagggttagaccgcacaggctaaactaattcagattggctaatttaaagagagtgaaacaggtgatcagaatgagtcagggtggwgcaggtaactggaatgagtcaggctggggcaagtaatcaggatgagtcagggtggagcaggtaatcagaatgagtcagggtggagcaggtgactggaatg

SEQ ID NO: 22519 - DNA, 201 bp, Homo sapiens
gggaagtaagaagttacagctcagtgcacataaagttgagacagagatggagacatctcagcctcacctctatggagcaggaatgattaattattggagasggaacacaggtcagcatgagggaagagggtcatggtggacatgggggtgggttggtctccccacctcctcatattatgcctacaggaacacaggcacatt

SEQ ID NO: 22520 - DNA, 201 bp, Homo sapiens
ttatgaacatgagtgatgttaacatttttgtcaactgtttcttctgcatcttttgagataattatgtctttttttccattaatacagtgcattccatgaaytgattttcaaatgttaatccaaccatatgttcctgggatgaatcccattggtcatggagtgtaatccttttttatgtggctttgtattatctgccaatgt

SEQ ID NO: 22521 - DNA, 201 bp, Homo sapiens
atggggtatttgcagctgtgccatattatttttgttattttgttattttattatattttgatatattacatatgcagtaattgtattattataggtgagcwttatgagtgagtgtcctgctgatggctccttggtcctggcccagcaccagctttcctggcaccttgaggtcctgtcatctctgtcatgctctcctgcatt

SEQ ID NO: 22522 - DNA, 201 bp, Homo sapiens
ttatagatgccctttatcagagtgaagaaggtctcctccattcctattttgttgaaacttatgaacatgagtgatgttaacatttttgtcaactgtttctyctgcatcttttgagataattatgtctttttttccattaatacagtgcattccatgaattgattttcaaatgttaatccaaccatatgttcctgggatgaa

SEQ ID NO: 22523 - DNA, 201 bp, Homo sapiens
tctgggaagggatagtgtgaggttcaggagagaaggagaggtctgtctccatgctttgacacagcataaagaaacctcccctcctcccccacatctccccrccagttctcagtgagggacagattcacagcaacaccgaaagggctgggaagggatggggggacatttgcagccagtgttcaggggctgaccctgtggggc

SEQ ID NO: 22524 - DNA, 201 bp, Homo sapiens
gcagggatgggagccttctgtgcagccagagtggatgcaggacctgcctggatgcaagagaaggatgagggaccctagctgggtcctgttccctgactccbtgtgttcacagggcaaccagtaagggagctggggtagggaattcattcataagctatctatctagagatgtgtttatagacatattatttcatgtttgta

SEQ ID NO: 22525 - DNA, 201 bp, Homo sapiens
tacatgttcttcatcacagatgtaatttgtgataaattgtgaaatattttctctcaatctacggcttgtcttctcattttctcaatattgtcttttggagyacttaagttttaaattttaactaagcccaatttgtctctcacttttttttcatctgtagatcatgttttttgtattttatgtaagaatcttttgcctaac

SEQ ID NO: 22526 - DNA, 201 bp, Homo sapiens
tcactttcattgtgtcctgaataacagtttcaagtttgtctatggcttctgcgaggagccaggacatccagatagaatgggccacatgaatcaattggtaygtgtttctcctttcaggcagagtctcactcacttcacacaagcacagagatccccatataggcaactagattatgagaaacaaacgcacccatccaaacc

SEQ ID NO: 22527 - DNA, 201 bp, Homo sapiens
agttgaataaacaaaaagattttacacgttggaataagtaagaggtcactggtgtgcagacgaaaatgattttgtagtccaaatgctccaaaaagcaagtrccatcataggattaaagttacagcattttattaggggacacacctgtcagacgatatggtgagggaggtaggttaccctgggaaaggcaatagaataaga

SEQ ID NO: 22528 - DNA, 201 bp, Homo sapiens
tgcaggtagaagaagttgaataaacaaaaagattttacacgttggaataagtaagaggtcactggtgtgcagacgaaaatgattttgtagtccaaatgcthcaaaaagcaagtgccatcataggattaaagttacagcattttattaggggacacacctgtcagacgatatggtgagggaggtaggttaccctgggaaagg

SEQ ID NO: 22529 - DNA, 201 bp, Homo sapiens
tgctgtgtaaaacactacccccaaatttagtgacttacagcaacaaacattggtgaactcaaaaacataatacaaataccagcaaaatggagccaatgcargtagaagaagttgaataaacaaaaagattttacacgttggaataagtaagaggtcactggtgtgcagacgaaaatgattttgtagtccaaatgctccaaa

SEQ ID NO: 22530 - DNA, 201 bp, Homo sapiens
aatattatcaaaataggaggaaataaaatagacgtagttaacctctatcgaataacggaaatgtaagaaggcttcattagttatctgttgctgtgtaaaamactacccccaaatttagtgacttacagcaacaaacattggtgaactcaaaaacataatacaaataccagcaaaatggagccaatgcaggtagaagaagtt

SEQ ID NO: 22531 - DNA, 201 bp, Homo sapiens
gccccagaaccatcagagtgatccagtctgcccactcttcttattattctgtctctccaatcactctccctgagctggactctccacccaccctcacattytggatagtgcagagatgtgagcatggccctggggcaggattgtctgcgtgcaagcccagctccaccacgacttgtaggcgaccttctttcctattgtatc

SEQ ID NO: 22532 - DNA, 201 bp, Homo sapiens
ggaaactcccccatgtgggaggacttcggagggggtcatgtcctcagggagacccaggttgctgctggagctgcgagatgcaggaacatcctgagagaggmtgaggaggttttgctgatgtggactgagaaatccagggggtgcactgggaagatttctgtggctggggaggtcggggagacagaatagaggtgtgcagag

SEQ ID NO: 22533 - DNA, 201 bp, Homo sapiens
tgggaactggaaaccctctgtatggctaatattatcaaaataggaggaaataaaatagacgtagttaacctctatcgaataacggaaatgtaagaaggctdcattagttatctgttgctgtgtaaaacactacccccaaatttagtgacttacagcaacaaacattggtgaactcaaaaacataatacaaataccagcaaa

SEQ ID NO: 22534 - DNA, 201 bp, Homo sapiens
aaagaaaagaataggcgttgggaactggaaaccctctgtatggctaatattatcaaaataggaggaaataaaatagacgtagttaacctctatcgaataamggaaatgtaagaaggcttcattagttatctgttgctgtgtaaaacactacccccaaatttagtgacttacagcaacaaacattggtgaactcaaaaacat

SEQ ID NO: 22535 - DNA, 201 bp, Homo sapiens
tccctattttaaggtccttaatcttcattacatgagtaatatcccttttgccacgcaatgcaacctgttcacaggttccaacgattaagactggacatcthtggggaccattactcagcccaccacatctgcgtatgttgaagtcaccaagagtcaaggagacagcaatgctggagagggtgacagtgaaccaggagctac

SEQ ID NO: 22536 - DNA, 201 bp, Homo sapiens
ctaaaataaagaaaagaataggcgttgggaactggaaaccctctgtatggctaatattatcaaaataggaggaaataaaatagacgtagttaacctctatmgaataacggaaatgtaagaaggcttcattagttatctgttgctgtgtaaaacactacccccaaatttagtgacttacagcaacaaacattggtgaactca

SEQ ID NO: 22537 - DNA, 201 bp, Homo sapiens
caaaggagaaaagaaactaaaataaagaaaagaataggcgttgggaactggaaaccctctgtatggctaatattatcaaaataggaggaaataaaatagamgtagttaacctctatcgaataacggaaatgtaagaaggcttcattagttatctgttgctgtgtaaaacactacccccaaatttagtgacttacagcaaca

SEQ ID NO: 22538 - DNA, 201 bp, Homo sapiens
aggaagccctagagcttcagtcagccttcagagaagaaatgttcctgccttagtttctgccctgctttcctcagtcattggcaggaaaagacagggggcakgtgtggtctcagagcaaatgtggcaataggtttcaggattcaaaagttgaggccactatcaattctgcttactctagctgaggggctgggatgtgcattc

SEQ ID NO: 22539 - DNA, 201 bp, Homo sapiens
caaggcaattacttctatacaagggtgtgccctcacagatggagcaatggtgagcacacccctggacaaggaaggggaaggggttcttatccctgatgcaygtggcccctgctgctgtgttattcccctattggctagggttagaccgcacaggctaaactaattcagattggctaatttaaagagagtgaaacaggtgat

SEQ ID NO: 22540 - DNA, 201 bp, Homo sapiens
aaagaaatagcactcaaatataaaattttctttttttcttctcagcaaggcaattacttctatacaagggtgtgccctcacagatggagcaatggtgagcrcacccctggacaaggaaggggaaggggttcttatccctgatgcacgtggcccctgctgctgtgttattcccctattggctagggttagaccgcacaggct

SEQ ID NO: 22541 - DNA, 201 bp, Homo sapiens
cttaaaaggatttccaccaatactaatgttgtaacctatatcaaatgaaacaggaactcaaatgtggagctccctctccaggacggtccatgtgggagacrgtggctgtggcagtggcaatccccaagtgcaaagggtgggcagaggcagcctcaggctgaggggtctcaagaaactttctactccacagggagaagaaga

SEQ ID NO: 22542 - DNA, 201 bp, Homo sapiens
ttttgcctgttttcatggatcacccttcatactacttgtgttagttagggtcccctgaggagcggaccccaatacagtattcaatgtgcaaggatttattrgaggaaatagttatgagagaaattcaggacacagacggaaaatgctgggaatgtcatcagaccacaaagcaactctgagccccagtgaggtaaacagtgc

SEQ ID NO: 22543 - DNA, 201 bp, Homo sapiens
ggccggggtcactcaccggcctcgctctggttgtagtagccgcgcagggtccccaggttcgctcggtcagtctgtgactgggccttcacattccgtgtctbcaggtcccaatactccggcccctcctgctctatccacggtgcccgcggctccatcctctggctcgcggcgtcgctgtcaaaccgcacgaactgcgtgtcg

SEQ ID NO: 22544 - DNA, 201 bp, Homo sapiens
gggccgcctcccacttgcgctgggtgatctgagccgccatgtccgccgcggtccaagagcgcaggtcctcgttcaaggcgatgtaatccttgccgtcgtargcgtcctgccggtacccgcggaggaagcgcccgtccgaccccacgtcgcagccatacatcatctggatggtgtgagaacctggccccgaccccacggtca

SEQ ID NO: 22545 - DNA, 201 bp, Homo sapiens
gggccttcacattccgtgtctgcaggtcccaatactccggcccctcctgctctatccacggtgcccgcggctccatcctctggctcgcggcgtcgctgtcraaccgcacgaactgcgtgtcgtccacgtagcccacggcgatgaagcggggctccccgcggccgggccgggacacggatgtggtgaaatacctcatggagt

SEQ ID NO: 22546 - DNA, 201 bp, Homo sapiens
accccccatccttcagctctctaatggcagtgccacccctacaatacctgcagtaccctcctgaagtcccacctggggcgcaatattgcttctggcttggytgggatgagggaagttttagatgattccctttgggcttcagcacaatgatagcccttactctccagactagggatgtagtgtgggggtgactccctttgc

SEQ ID NO: 22547 - DNA, 201 bp, Homo sapiens
gtgactgctgggatcaggtcccatcaccacagtcatcaaggtgataaatctgtccctcattgtaacaggtgctttacaaaagagtaagtgctggcacacasggcccaggctgggtaggcccatgagtgtggatggtgcttcccagtaaccaggcagggcacttctacctggggcttggaactctcagtgagacaagaaatc

SEQ ID NO: 22548 - DNA, 201 bp, Homo sapiens
ggattgtctgcgtgcaagcccagctccaccacgacttgtaggcgaccttctttcctattgtatcacctgaaaacggaaaattagcaggcacaccccatagwtgtatagtgacaattaaatgaattcatattttgaaagtgctaaggacacagattaacacatagcaccatgacagtgtatgatattatcgctgttggtttt

SEQ ID NO: 22549 - DNA, 201 bp, Homo sapiens
tctgcgtgcaagcccagctccaccacgacttgtaggcgaccttctttcctattgtatcacctgaaaacggaaaattagcaggcacaccccatagttgtatmgtgacaattaaatgaattcatattttgaaagtgctaaggacacagattaacacatagcaccatgacagtgtatgatattatcgctgttggtttttttttt

SEQ ID NO: 22550 - DNA, 201 bp, Homo sapiens
tggtggaatcactggattggtattcccagggtgggggtcgaaggattgttggaattgatgtgctaaagggtggacttcaagcctggaatgcaggcacataygcaatgagtagtcactgatattacctcacagcatatgataaaatgatagagtctgtgtcctcagagcctgtggccaccttgcatgggatgagtggaaaga

SEQ ID NO: 22551 - DNA, 201 bp, Homo sapiens
cagggagagggtgattgctggccctggtgggggctccccatgtggtttgggtcatgaagttagagaagacaccaacgatgagggacagtgagtagatggtrgaatcactggattggtattcccagggtgggggtcgaaggattgttggaattgatgtgctaaagggtggacttcaagcctggaatgcaggcacatatgcaa

SEQ ID NO: 22552 - DNA, 201 bp, Homo sapiens
actctgttaataacttcctgttgtttacttgtttctcatataccatggtattatacttttgacatatagattcagaaaatgcttactgataacacaatcamgtaggggttatttaatatgttaggaaaatttcataataaaaaggaaaaaatggaggaagggagagaaagaaggaggaattgaggaaggagtgaaagaaga

SEQ ID NO: 22553 - DNA, 201 bp, Homo sapiens
tttattcagactctgttaataacttcctgttgtttacttgtttctcatataccatggtattatacttttgacatatagattcagaaaatgcttactgatarcacaatcacgtaggggttatttaatatgttaggaaaatttcataataaaaaggaaaaaatggaggaagggagagaaagaaggaggaattgaggaaggagt

SEQ ID NO: 22554 - DNA, 201 bp, Homo sapiens
tagcaggcatttttattcagactctgttaataacttcctgttgtttacttgtttctcatataccatggtattatacttttgacatatagattcagaaaatrcttactgataacacaatcacgtaggggttatttaatatgttaggaaaatttcataataaaaaggaaaaaatggaggaagggagagaaagaaggaggaatt

SEQ ID NO: 22555 - DNA, 201 bp, Homo sapiens
ccttgttaagagccacccttagctcctagagccttctctcagatactcacacacggtgcctaaggcacattcaatcctcctgcttggaacttctgacctcycctctccagcttctcctctgccttcctcctctgcagaatctgactccaaccagggcaggctctctgcttttaatggctcttgtgatttgattgggcccac

SEQ ID NO: 22556 - DNA, 201 bp, Homo sapiens
ttgaaggaattgagttaaaagccactgtcttggctgcagaattatagcaggcatttttattcagactctgttaataacttcctgttgtttacttgtttctbatataccatggtattatacttttgacatatagattcagaaaatgcttactgataacacaatcacgtaggggttatttaatatgttaggaaaatttcataa

SEQ ID NO: 22557 - DNA, 201 bp, Homo sapiens
acttaaactcatgtgttctgaaaacacctagttgaaggaattgagttaaaagccactgtcttggctgcagaattatagcaggcatttttattcagactctrttaataacttcctgttgtttacttgtttctcatataccatggtattatacttttgacatatagattcagaaaatgcttactgataacacaatcacgtagg

SEQ ID NO: 22558 - DNA, 201 bp, Homo sapiens
gacgatatgttgtatggactttaaccatactagataatgataatatgatttccaaggtgattgtgtcaacttaaactcatgtgttctgaaaacacctagtygaaggaattgagttaaaagccactgtcttggctgcagaattatagcaggcatttttattcagactctgttaataacttcctgttgtttacttgtttctca

SEQ ID NO: 22559 - DNA, 201 bp, Homo sapiens
gctgattccagtttttgccataaacatcagtgtgcctgtctcctgggcacataggcaagaaagcccgctagagtgtatggttaggagtgggagggttggamgatatgttgtatggactttaaccatactagataatgataatatgatttccaaggtgattgtgtcaacttaaactcatgtgttctgaaaacacctagttga

SEQ ID NO: 22560 - DNA, 201 bp, Homo sapiens
acagcatatgataaaatgatagtatctgtgtcctcagagcctgtggccaccttgcaaggggatgagtggaaagatggtcagagagtgggaagtgtgagatwgagagtatggaagggctggggttcttagccatgatgaggcctaggggataacaagggcatgagattcaggcagacaggagaagatcatggaggagaggag

SEQ ID NO: 22561 - DNA, 201 bp, Homo sapiens
gcagggagagggtgattgctggccctggtgggggctccccatgtggtttgggtcatgaagttagagaagacaccaacgatgagggacagtgagtagatggyggaatcactggattggtattcccagggtgggggtcgaaggattgttggaattgatgtgctaaagggtggacttcaagcctggaatgcaggcacatatgca

SEQ ID NO: 22562 - DNA, 201 bp, Homo sapiens
tggctagctgccagagacacatacctgtgatgcgagggttatctttttccattttgtgttgctataaagaaatgtctgagactgactaatttatataaacraggttcatgtggctcaagattctgatgtctggaaatgtttgcgcatttagtgagggcctcaggctgcttccactcatggcagaagacaaaggggagctgg

SEQ ID NO: 22563 - DNA, 201 bp, Homo sapiens
agcctgagagtagctccctccttttcaatctgtgggaagaaaatgtcctgtgagaggccagaaaggtggcagggccatgaggtcctagaggaacctcctartcttggaccctcgagaagtttccagaaatgtgtgactgcagactcagggcgggatcaggaaaaacaaggaaagcagatgtgggtcctcgaccaactgccc

SEQ ID NO: 22564 - DNA, 201 bp, Homo sapiens
gcagaaagagaaaacagaggcccttgaagtctcaaagtggagccatgaacaaatcttgcatctcagtccctcacaaggcagtcttggaaagaaaatagtcrtgaacaaattcaagtcagtcatggtaagtggtgacactgaacagcccaccacacattgaaaaattccaaatcaaagactctctagagcctagttgtgtcc

SEQ ID NO: 22565 - DNA, 201 bp, Homo sapiens
cagttggccatcagaggagtccctggtctcccaggaatgtcctgctttcgtgtcactggtgtgatctgtcactggttgggaacagcccattggaagcaggrcctcagcaccaatgctactgaggatgtcagagcacaggagcagggccttgggagattacccagcattactcaaaccttctgccctgacgggtctgggtcc

SEQ ID NO: 22566 - DNA, 201 bp, Homo sapiens
ggttgctggattacgtagagacaatagacagccccaacaccatcccacatccttcagctctgtaatggtgatgtgatccccacaatacttgaagtatcttmcacaagacccaccctgggacacactatgatttttgatttggccaggatgggggcagtgtcagaggtttccctttggctttcagcacaatgaaagtcctta

SEQ ID NO: 22567 - DNA, 201 bp, Homo sapiens
tgaggccatcatagaatcagcctagcaagggctggatcttctttttgtgttcacttgggacacagttgcaaattgaagttcaagtaaagtaatcattgtgracggtaataaaatacatccttttcagccacgaaaattctccttaccttttaaaactaagttacatatttatatcttttaattaatttaggccagatttgg

SEQ ID NO: 22568 - DNA, 201 bp, Homo sapiens
ttcaatgtgcaaggatttattagaggaaatagttatgagagaaattcaggacacagacggaaaatgctgggaatgtcatcagaccacaaagcaactctgarccccagtgaggtaaacagtgcaggaaggtcagctggaagcatcctagaccctgtgcaggctaacagaagttcagtaagcgtggcaggaagccctagagct

SEQ ID NO: 22569 - DNA, 201 bp, Homo sapiens
ctgccaggcagtgggcaagcttttttcaaattctcatttttgcctgttttcatggatcacccttcatactacttgtgttagttagggtcccctgaggagcrgaccccaatacagtattcaatgtgcaaggatttattagaggaaatagttatgagagaaattcaggacacagacggaaaatgctgggaatgtcatcagacc

SEQ ID NO: 22570 - DNA, 201 bp, Homo sapiens
caccatgccccgccgttgttgctatttctttcatcctttttgcttgagcctcttctcttctttctaggttcccagggaaattctctgttggaagattatgbctgcaagaggcctccacctgggaaatgctggcccatggggggatctcccttttattaaatggaatgattgttggtgaagtgacagctagtgagccagtga

SEQ ID NO: 22571 - DNA, 201 bp, Homo sapiens
atatttcctattgatgtatatgtggctgattccagtttttgccataaacatcagtgtgcctgtctcctgggcacataggcaagaaagcccgctagagtgtrtggttaggagtgggagggttggacgatatgttgtatggactttaaccatactagataatgataatatgatttccaaggtgattgtgtcaacttaaactca

SEQ ID NO: 22572 - DNA, 201 bp, Homo sapiens
ttttcactgctgaaggtttacattttatgccacaatttcctattgatgtatatttcctattgatgtatatgtggctgattccagtttttgccataaacatmagtgtgcctgtctcctgggcacataggcaagaaagcccgctagagtgtatggttaggagtgggagggttggacgatatgttgtatggactttaaccatac

SEQ ID NO: 22573 - DNA, 201 bp, Homo sapiens
cctaattttgaatgaccgaatgagacttggataatatgccaatgcttctttactgttataatccttttcgtatgaaaaatatgtggtcaaagaaaaggggrtaatatgagttatcacaaaaacatttagttttgtccctggtttctcctaaaaaccttagaatctcttgagtgattagagtgtctttagaatactgaggaa

SEQ ID NO: 22574 - DNA, 201 bp, Homo sapiens
gatattacatcacagcatatgataaaatgatagtatctgtgtcctcagagcctgtggccaccttgcaaggggatgagtggaaagatggtcagagagtgggwagtgtgagatagagagtatggaagggctggggttcttagccatgatgaggcctaggggataacaagggcatgagattcaggcagacaggagaagatcatg

SEQ ID NO: 22575 - DNA, 201 bp, Homo sapiens
tgtgtgtgtatatatatatatatatacacacatatatatccaaaaaaaattatttacttctgctggtttttaagcttcctgtacagcaaattcctactgcrtttattttcccatgatgcacattacgtacaggagttatctgtggtgtgggaggctgtcattcattcattttcactgctgaaggtttacattttatgccac

SEQ ID NO: 22576 - DNA, 201 bp, Homo sapiens
caatgcttctttactgttataatccttttcgtatgaaaaatatgtggtcaaagaaaagggggtaatatgagttatcacaaaaacatttagttttgtccctsgtttctcctaaaaaccttagaatctcttgagtgattagagtgtctttagaatactgaggaaaggactcttggctgagtggatcctggataccttgagaat

SEQ ID NO: 22577 - DNA, 201 bp, Homo sapiens
gggtgagggacagtgagtagatggcaggatcactggattgggaatcccaggagggtggaacgattgttggaattgatgtactacagggtagactccaagcrtggaaagcaagcacatatgcaatgagtggtccactgatattacatcacagcatatgataaaatgatagtatctgtgtcctcagagcctgtggccaccttg

SEQ ID NO: 22578 - DNA, 201 bp, Homo sapiens
gtcttctaatgtgttcagttttctcagtgaagtgggaagcaaggtcatcagctgaagtaagaatggggaaggcaggttggatgtgtgagcacaaagaaaargtgtgtaagagtcacccaggccaggaggaggctgagggtgagccatgcagggagagggtgattgctggccatggtagggacttcctatgtggtttggaat

SEQ ID NO: 22579 - DNA, 201 bp, Homo sapiens
gacatgtggtgcagctgcaaatgcatgagcagacagtggtggaatctgtgaagttgtcttctaatgtgttcagttttctcagtgaagtgggaagcaaggthatcagctgaagtaagaatggggaaggcaggttggatgtgtgagcacaaagaaaaagtgtgtaagagtcacccaggccaggaggaggctgagggtgagcca

SEQ ID NO: 22580 - DNA, 201 bp, Homo sapiens
tcttgttaaggatccttgcaatgaactttggtattcttttctctttcatttttataaataccaggtatattttaatttgaaaactctgtttaacaaattayaatcatgtaactaaaaagatgcccagcactggtgtaaaacacaaacctgtaaagctcccctgggctgctgcccagtcacatcccccagagagagactcca

SEQ ID NO: 22581 - DNA, 201 bp, Homo sapiens
tggggccatcatcaattctgcttcttctagatgaggggctgggatgtgcattctcatgactgccacaatgatccagtggggagagaggaaaaaggttgacrataaagataaaaatggtattaattgatgaactgacacctttaagtagatgataagggatggcaattggggcaccagaagagggtctggctctggctggga

SEQ ID NO: 22582 - DNA, 201 bp, Homo sapiens
aatacagtagtaaacatgtaaggatttattaggggaaatacttgtgagagaaattcatgagacagaaaatgctgggaaagccactggaccacaaagcaackctgagcctcagtgatgtagagagtgcaggaaggtcagctggaagcatcctagaccctgtgcaggctaagggaagttcagtaagggtggcagggagccctg

SEQ ID NO: 22583 - DNA, 201 bp, Homo sapiens
cacttgtgttagttagggtcccctgagaagcggaccccaatacagtagtaaacatgtaaggatttattaggggaaatacttgtgagagaaattcatgagahagaaaatgctgggaaagccactggaccacaaagcaactctgagcctcagtgatgtagagagtgcaggaaggtcagctggaagcatcctagaccctgtgca

SEQ ID NO: 22584 - DNA, 201 bp, Homo sapiens
ggactttctgtgtctgccaccaacccgggtggcatcctcttggcctgccaggcagtgggaagcttatttcaaattcccatttttgcctgttttcatggatsacccttcatgccacttgtgttagttagggtcccctgagaagcggaccccaatacagtagtaaacatgtaaggatttattaggggaaatacttgtgagaga

SEQ ID NO: 22585 - DNA, 201 bp, Homo sapiens
ggaaagaggtttaattgactcacagttctgcatggctgaggagcctgccccaggaaacttacagtcatgacagaagtggaagcaaacacatccttcttcayatgatgacaggagagagaagtgcagaatgaagcagggaaaagccccttataaaaccatcagatctcatgagaattccctcagtatcacgagaacagcatg

SEQ ID NO: 22586 - DNA, 201 bp, Homo sapiens
ccgtcattattgtgcagggcattctatcaccccacctgccatagcttcccctaaccagggcatcctctcagctcagcactggtgagacccatagcagctcrgctgcatcttgtgctatggaatttctgtgtctcccacaaccctggtggcatcctcttggcctgccaggcagtgggcaagcttttttcaaattctcatttt

SEQ ID NO: 22587 - DNA, 201 bp, Homo sapiens
cttgagtgattagagtgtctttagaatactgaggaaaggactcttggctgagtggatcctggataccttgagaatgggggctggctgccacagacacatasctatgatgagagggttgtcttattccgttttgtgttgctataaagaaatgtctgagactgactaatttatataaacaaggttcatttggctcaggattct

SEQ ID NO: 22588 - DNA, 201 bp, Homo sapiens
ggcagctgtttcacactacagaaaaatattcatgaacaaattcatatcagtcacagtgaggggtgacactttaaacagcccatcacatgctcaatacattsaagtcaaagaaacctcatagcacagctatgtccactgttcccctcaacaacccacacacatcaggccccccggggtgtcacatttacaagccgtgagaga

SEQ ID NO: 22589 - DNA, 201 bp, Homo sapiens
acccgcggggattttggcctaaacggaaaatgaaacctggtaaaggcgcctgggcctctcccgggtcgaggatctggcgggtcccgcagcctcggggtggrtctcggagccggagactcgcgggggggacccgggacgtccgtgggggatgaggaggggtcgtgaccttcgccccaggccggggtcattcaccggcctagc

SEQ ID NO: 22590 - DNA, 201 bp, Homo sapiens
actgaggaaaggactcttggctgagtggatcctggataccttgagaatgggggctggctgccacagacacatacctatgatgagagggttgtcttattccrttttgtgttgctataaagaaatgtctgagactgactaatttatataaacaaggttcatttggctcaggattctgatgtctggaaatgtttgagcatttag

SEQ ID NO: 22591 - DNA, 201 bp, Homo sapiens
aacaaattcatatcagtcacagtgaggggtgacactttaaacagcccatcacatgctcaatacattcaagtcaaagaaacctcatagcacagctatgtccvctgttcccctcaacaacccacacacatcaggccccccggggtgtcacatttacaagccgtgagagacacattagagccctgggcactgtcactgcctaga

SEQ ID NO: 22592 - DNA, 201 bp, Homo sapiens
aggttcccagggaaattctctgttggaagattatgcctgcaagaggcctccacctgggaaatgctggcccatggggggatctcccttttattaaatggaahgattgttggtgaagtgacagctagtgagccagtgacagtacggttcatgtaaaaaagaccacatacctaggattacctccattttaataaagacacatcc

SEQ ID NO: 22593 - DNA, 201 bp, Homo sapiens
gccccgcccccgctgtcagccccgcccaccgagccccgcccccgccccgaccaacccgcggggattttggcctaaacggaaaatgaaacctggtaaaggckcctgggcctctcccgggtcgaggatctggcgggtcccgcagcctcggggtggatctcggagccggagactcgcgggggggacccgggacgtccgtggggg

SEQ ID NO: 22594 - DNA, 201 bp, Homo sapiens
ttcatatcagtcacagtgaggggtgacactttaaacagcccatcacatgctcaatacattcaagtcaaagaaacctcatagcacagctatgtccactgttbccctcaacaacccacacacatcaggccccccggggtgtcacatttacaagccgtgagagacacattagagccctgggcactgtcactgcctagagtagaa

SEQ ID NO: 22595 - DNA, 201 bp, Homo sapiens
atttcaaatctctgcttctcatttcacactatctggctcatgagtgaaggtgataagtgtcgtactatgctctcaggtttgtctgtcagagtcatagtcahgtattacacataaagattattttcttgttatcatttatttatatatattatactcatgggatatagatagatattattacagtgcttaaatggctactac

SEQ ID NO: 22596 - DNA, 201 bp, Homo sapiens
tttctctcttggtatatgatattaacacatagaattgtatactgttactttggtttccagcaattgctgattaggtcatttggaccacttctcccattgastacaactggaaaaatgggaggaaaatacatatttgaaaagtctggttgaatttatagatgggctagcaaagcagtgaagatttgcttggccaggaaccag

SEQ ID NO: 22597 - DNA, 201 bp, Homo sapiens
tatctggagggtgttagaccctggccccgcccccgctgtcagccccgcccaccgagccccgcccccgccccgaccaacccgcggggattttggcctaaackgaaaatgaaacctggtaaaggcgcctgggcctctcccgggtcgaggatctggcgggtcccgcagcctcggggtggatctcggagccggagactcgcgggg

SEQ ID NO: 22598 - DNA, 201 bp, Homo sapiens
cgttggcgtgctgttcatacccgcggaggaggcgcccttccagccccaagtcgcagccatacattatctggagggtgttagaccctggccccgcccccgckgtcagccccgcccaccgagccccgcccccgccccgaccaacccgcggggattttggcctaaacggaaaatgaaacctggtaaaggcgcctgggcctctcc

SEQ ID NO: 22599 - DNA, 201 bp, Homo sapiens
gatggaattaccttgcacatcagattgaagattgtatacatgaaaatctacagagatgccagtgagccaaggatcaaatgacctatttgtagccaaagccrttttcatggcctcgtggtcctctctgtcacatggctccttacaattctgtgtggttttgttccaatgtaagtagttcttgttaaggatgcttgcaatgaa

SEQ ID NO: 22600 - DNA, 201 bp, Homo sapiens
gaagttgcaaattttcccccattttcttgtcttctgaactctccaaactcttccaacctctgcctgttacccagttccaaagctgtttccacattttcaasaatttttatagtaatacccaactcctggtaccgattttctgaattagttcattctcacacttttataaagaaatacctgagactgggtaatttataaaca

SEQ ID NO: 22601 - DNA, 201 bp, Homo sapiens
ctgtttttatgctagcaccatgctgatttggttactataactttatattgtatcctgaattcagtaagtgtgatgcctctagctttgttcttcttgctcakgattgctttggctatttgggatattttacgattccatatgaatttcacgattttttctatttctgtgaataatgatattggtattttgatagggattgaa

SEQ ID NO: 22602 - DNA, 201 bp, Homo sapiens
caagaaggaattaccttgcacatcagattgaacattgtatacttgaaaatccagagagatgccagtgagctaaggatcaaatgacctattattaaccaagrccattttcatcacatcctggtcctctctgtcacatggctgcttacatttctctgtggttttctttcaatgtaagtagttcttgttaaggatccttgcaat

SEQ ID NO: 22603 - DNA, 201 bp, Homo sapiens
cgccgcggtccaggagcgcaggtcctagttccgggctatgtaatccttgccatcgttggcgtgctgttcatacccgcggaggaggcgcccttccagccccragtcgcagccatacattatctggagggtgttagaccctggccccgcccccgctgtcagccccgcccaccgagccccgcccccgccccgaccaacccgcgg

SEQ ID NO: 22604 - DNA, 201 bp, Homo sapiens
agaatttttatagtaatacccaactcctggtaccgattttctgaattagttcattctcacacttttataaagaaatacctgagactgggtaatttataaasaaaataggtttctttctttctcctcccaccatccaagatgccaaaaggaaagaaggccaaggagaagaaggtggctccagcccctgctgtcgtgaagaag

SEQ ID NO: 22605 - DNA, 201 bp, Homo sapiens
aacaccaaatcctttgcaagaaggaattaccttgcacatcagattgaacattgtatacttgaaaatccagagagatgccagtgagctaaggatcaaatgamctattattaaccaaggccattttcatcacatcctggtcctctctgtcacatggctgcttacatttctctgtggttttctttcaatgtaagtagttcttgt

SEQ ID NO: 22606 - DNA, 201 bp, Homo sapiens
gccgccatgtccgccgcggtccaggagcgcaggtcctagttccgggctatgtaatccttgccatcgttggcgtgctgttcatacccgcggaggaggcgccsttccagccccaagtcgcagccatacattatctggagggtgttagaccctggccccgcccccgctgtcagccccgcccaccgagccccgcccccgccccga

SEQ ID NO: 22607 - DNA, 201 bp, Homo sapiens
ttcagttgtatgtgtggtaaaatgtaacaccaaatcctttgcaagaaggaattaccttgcacatcagattgaacattgtatacttgaaaatccagagagaygccagtgagctaaggatcaaatgacctattattaaccaaggccattttcatcacatcctggtcctctctgtcacatggctgcttacatttctctgtggtt

SEQ ID NO: 22608 - DNA, 201 bp, Homo sapiens
tctgcctcccacttgcgcttggtgatctgagccgccatgtccgccgcggtccaggagcgcaggtcctagttccgggctatgtaatccttgccatcgttggsgtgctgttcatacccgcggaggaggcgcccttccagccccaagtcgcagccatacattatctggagggtgttagaccctggccccgcccccgctgtcagc

SEQ ID NO: 22609 - DNA, 201 bp, Homo sapiens
ggcaacttctcagctcagcactggtgagacccccagctgctcagctgcaccttgtgccatggactttctgtgtctgccaccaacccgggtggcatcctctwggcctgccaggcagtgggaagcttatttcaaattcccatttttgcctgttttcatggatcacccttcatgccacttgtgttagttagggtcccctgagaa

SEQ ID NO: 22610 - DNA, 201 bp, Homo sapiens
ttaattcagttgtatgtgtggtaaaatgtaacaccaaatcctttgcaagaaggaattaccttgcacatcagattgaacattgtatacttgaaaatccagaragatgccagtgagctaaggatcaaatgacctattattaaccaaggccattttcatcacatcctggtcctctctgtcacatggctgcttacatttctctgt

SEQ ID NO: 22611 - DNA, 201 bp, Homo sapiens
ccaggtgtctgcgagcctctccacgcacgtgccctccaggtaggccctgatctgctctgcaaattcttctgcctcccacttgcgcttggtgatctgagcckccatgtccgccgcggtccaggagcgcaggtcctagttccgggctatgtaatccttgccatcgttggcgtgctgttcatacccgcggaggaggcgcccttc

SEQ ID NO: 22612 - DNA, 201 bp, Homo sapiens
cttttgtattccattagtctatgtgtctgtttttatgctagcaccatgctgatttggttactataactttatattgtatcctgaattcagtaagtgtgatrcctctagctttgttcttcttgctcatgattgctttggctatttgggatattttacgattccatatgaatttcacgattttttctatttctgtgaataatg

SEQ ID NO: 22613 - DNA, 201 bp, Homo sapiens
tgctcattggccagggctatgatactcacactcattccttggaggagccaagcttcgggtttggctgcctctgggacatttcatgctagaaaaaccccaabatgtgtagataaatggtatagaggacaccagccacccttcgatggagctctgcccagtagtgtcccctcacttccactcagagacaacatgcccatttca

SEQ ID NO: 22614 - DNA, 201 bp, Homo sapiens
tcttattttgctttccattcatatttgctattccatcactggttgttcctttctactcttttcttgtttcatttattttgatcagtgatgtgtatttccawttctgtgaaagtttaattcagttgtatgtgtggtaaaatgtaacaccaaatcctttgcaagaaggaattaccttgcacatcagattgaacattgtatact

SEQ ID NO: 22615 - DNA, 201 bp, Homo sapiens
gcctgccttggctgagtgtcaaacatctctggagcactgtggccctcatagtgatgtagagctaacattccttgctatctgcccttttgctacaggagatraagacctgtccatgagacactgccgagggtgtcaaatgtagccagtcatagctgtcaacaatccgcagattctcattatctttttacacagcatcgatgc

SEQ ID NO: 22616 - DNA, 201 bp, Homo sapiens
tttttgggtgtggtattgcatgagatgtggtagaagtgatttggacactactacagttctaaatagcactgctattatgtgcttctgaagctttctttttyttttttttttagctgtcttattttgctttccattcatatttgctattccatcactggttgttcctttctactcttttcttgtttcatttattttgatcag

SEQ ID NO: 22617 - DNA, 201 bp, Homo sapiens
taggggtgaggattgtgtagcatcttccagcagtgaaagtgggaaccattactagagaagggtgagcctcctctgcatgcccagaagatcctggagggcahgcatcgcataatcctgttccagtttgcagaatctcaggtttccccaccaaagccctgactttcctgtaacaggcctgccttggctgagtgtcaaacatct

SEQ ID NO: 22618 - DNA, 201 bp, Homo sapiens
aaacttaacatttttgggtgtggtattgcatgagatgtggtagaagtgatttggacactactacagttctaaatagcactgctattatgtgcttctgaagytttcttttttttttttttttagctgtcttattttgctttccattcatatttgctattccatcactggttgttcctttctactcttttcttgtttcattta

SEQ ID NO: 22619 - DNA, 201 bp, Homo sapiens
tgtgagttctcttttgtattccattagtctatgtgtctgtttttatgctagcaccatgctgatttggttactataactttatattgtatcctgaattcagkaagtgtgatgcctctagctttgttcttcttgctcatgattgctttggctatttgggatattttacgattccatatgaatttcacgattttttctatttct

SEQ ID NO: 22620 - DNA, 201 bp, Homo sapiens
ttccttgatcaaacaccctcaaattccaatcccagaagtagtccctgggctcctatggggacgtgctggctagttcctgcaaacctcctgagtgggattcbcgcggcatcataggggtgaggattgtgtagcatcttccagcagtgaaagtgggaaccattactagagaagggtgagcctcctctgcatgcccagaagatc

SEQ ID NO: 22621 - DNA, 201 bp, Homo sapiens
caggggcattctattgtaaacttaacatttttgggtgtggtattgcatgagatgtggtagaagtgatttggacactactacagttctaaatagcactgctrttatgtgcttctgaagctttcttttttttttttttttagctgtcttattttgctttccattcatatttgctattccatcactggttgttcctttctactc

SEQ ID NO: 22622 - DNA, 201 bp, Homo sapiens
atcctctacatgttccagggcaactaagacatgtctaccttgttgagagttgggcatgtttttttctagactatgtggatacaccccagcagtgggtttaytccacttatcaaagtcctggagtgtttgataaatccatgccctgagaaagtgtcttcaagccaaaggattatattcatccagcctgaaattctggttcct

SEQ ID NO: 22623 - DNA, 201 bp, Homo sapiens
tcagtcaacacatctagcttagcataatgccagtaactttggtttgatgcagtagcccaaaatgcttaactcgaattgagaatcaaattttttccaaaaayggctcaggggcattctattgtaaacttaacatttttgggtgtggtattgcatgagatgtggtagaagtgatttggacactactacagttctaaatagcac

SEQ ID NO: 22624 - DNA, 201 bp, Homo sapiens
cctcagcttgttattccatcctctacatgttccagggcaactaagacatgtctaccttgttgagagttgggcatgtttttttctagactatgtggatacaycccagcagtgggtttactccacttatcaaagtcctggagtgtttgataaatccatgccctgagaaagtgtcttcaagccaaaggattatattcatccagc

SEQ ID NO: 22625 - DNA, 201 bp, Homo sapiens
tcctgaggctctggtggaaggtgtgtcctctgggccctcttgtagagcatggttttggtaggccttcaccaagcccactcccctcagcttgttattccatyctctacatgttccagggcaactaagacatgtctaccttgttgagagttgggcatgtttttttctagactatgtggatacaccccagcagtgggtttactc

SEQ ID NO: 22626 - DNA, 201 bp, Homo sapiens
caaaggggacattccccactaagagtccacctgtccttcgagcaggagttaacaccatcaccaccttggtggagaacaagaaagctcagctggtggtgatwgcacatgatgtagatcccatcaagctggttgtcttcttgcctgtcctgtgtcataaaatggggtcccttactgcattatcaaagggaaggcaagactggg

SEQ ID NO: 22627 - DNA, 201 bp, Homo sapiens
ttctgcaggctatacagaaagtatgattctggcatctgctcatcttatgagagggcctcagggaactttcgattatgctggaaggctaaggggaagcagayattacttacatgcctggagcaggagggagagagagcagggaggtgacacagatttttaaacaccagatcttatgagaattatcacaagaatagcaccaaa

SEQ ID NO: 22628 - DNA, 201 bp, Homo sapiens
tggttctaaaccgttcatgaaggatccatcctcatgagccgatcacctgccaccagacaccacctccaaaattagggattacaattgaacatgagatttgkgtggggacacagatccaaacaatatcaggggtcatggtggacatgaggatgggctggtctcccatttcttacctgttactgtagacatagacacattcag

SEQ ID NO: 22629 - DNA, 201 bp, Homo sapiens
tggggacacagatccaaacaatatcaggggtcatggtggacatgaggatgggctggtctcccatttcttacctgttactgtagacatagacacattcagabgctttggcagaaagagaagccagaggcccttaatgtcacaaagaggaggcatgaacaaatcttgcatctcagtccctcacaaggcaatcttagaaaaaac

SEQ ID NO: 22630 - DNA, 201 bp, Homo sapiens
ggtcatggtggacatgaggatgggctggtctcccatttcttacctgttactgtagacatagacacattcagacgctttggcagaaagagaagccagaggchcttaatgtcacaaagaggaggcatgaacaaatcttgcatctcagtccctcacaaggcaatcttagaaaaaacatagtcataaactaatccaggtcagtca

SEQ ID NO: 22631 - DNA, 201 bp, Homo sapiens
gagccaagcttcgggtttggctgcctctgggacatttcatgctagaaaaaccccaacatgtgtagataaatggtatagaggacaccagccacccttcgatkgagctctgcccagtagtgtcccctcacttccactcagagacaacatgcccatttcactaaattcatgaggacatggccaacataagtaagagaacaccgg

SEQ ID NO: 22632 - DNA, 201 bp, Homo sapiens
tttggctgcctctgggacatttcatgctagaaaaaccccaacatgtgtagataaatggtatagaggacaccagccacccttcgatggagctctgcccagtrgtgtcccctcacttccactcagagacaacatgcccatttcactaaattcatgaggacatggccaacataagtaagagaacaccgggaggtaccttggaca

SEQ ID NO: 22633 - DNA, 201 bp, Homo sapiens
ttggtcccattttccttctctctttgtgggaagccagcccaggagatctacaggcgatcagggagacgtcttgtgttccctggtacccgtgagctgcagcrtctccttcccgttctccaggtgtctgcgagcctctccacgcacgtgccctccaggtaggccctgatctgctctgcaaattcttctgcctcccacttgcgc

SEQ ID NO: 22634 - DNA, 201 bp, Homo sapiens
tccctcaggaccagagagaggacgacattctagtgttggtcccattttccttctctctttgtgggaagccagcccaggagatctacaggcgatcagggagrcgtcttgtgttccctggtacccgtgagctgcagcatctccttcccgttctccaggtgtctgcgagcctctccacgcacgtgccctccaggtaggccctga

SEQ ID NO: 22635 - DNA, 201 bp, Homo sapiens
catggatttattgtgagttctcttttgtattccattagtctatgtgtctgtttttatgctagcaccatgctgatttggttactataactttatattgtatmctgaattcagtaagtgtgatgcctctagctttgttcttcttgctcatgattgctttggctatttgggatattttacgattccatatgaatttcacgattt

SEQ ID NO: 22636 - DNA, 201 bp, Homo sapiens
ctgctctgtctatggagtagccattcttttgtttctttacttctctaataaacttgctttcacttagaaaaaattgcataatcagattgcttctcatttayaaaaatgggaatctcatacttcagtcaacacatctagcttagcataatgccagtaactttggtttgatgcagtagcccaaaatgcttaactcgaattgag

SEQ ID NO: 22637 - DNA, 201 bp, Homo sapiens
gagggactcagaagagctggactcagacccccacacacattgagtgtaaagcagagagcaaggcctgagaggaaaagtaacggggcccaaggctgctgccrgtgtcaaagggaacccctcatcagtattccagggattgtcttcccttcatttcctcagagatttcatcccttaattgtatcagagagcagggcagaccct

SEQ ID NO: 22638 - DNA, 201 bp, Homo sapiens
tgagggactcagaagagctggactcagacccccacacacattgagtgtaaagcagagagcaaggcctgagaggaaaagtaacggggcccaaggctgctgcyagtgtcaaagggaacccctcatcagtattccagggattgtcttcccttcatttcctcagagatttcatcccttaattgtatcagagagcagggcagaccc

SEQ ID NO: 22639 - DNA, 201 bp, Homo sapiens
tacaaaggacaataccctgacacttcttagtgatgcaggtccctctcaccatcaagttcctgaggctctggtggaaggtgtgtcctctgggccctcttgtrgagcatggttttggtaggccttcaccaagcccactcccctcagcttgttattccatcctctacatgttccagggcaactaagacatgtctaccttgttga

SEQ ID NO: 22640 - DNA, 201 bp, Homo sapiens
gtgtcttctggtcctgacctgagtggaggctgagggactcagaagagctggactcagacccccacacacattgagtgtaaagcagagagcaaggcctgagrggaaaagtaacggggcccaaggctgctgccagtgtcaaagggaacccctcatcagtattccagggattgtcttcccttcatttcctcagagatttcatcc

SEQ ID NO: 22641 - DNA, 201 bp, Homo sapiens
tctttactaccatcacccccagcctacaaaggacaataccctgacacttcttagtgatgcaggtccctctcaccatcaagttcctgaggctctggtggaakgtgtgtcctctgggccctcttgtagagcatggttttggtaggccttcaccaagcccactcccctcagcttgttattccatcctctacatgttccagggca

SEQ ID NO: 22642 - DNA, 201 bp, Homo sapiens
gaggagggaacagtgtcttctggtcctgacctgagtggaggctgagggactcagaagagctggactcagacccccacacacattgagtgtaaagcagagarcaaggcctgagaggaaaagtaacggggcccaaggctgctgccagtgtcaaagggaacccctcatcagtattccagggattgtcttcccttcatttcctca

SEQ ID NO: 22643 - DNA, 201 bp, Homo sapiens
ttgtctcttcagggccacactctccccagtgatattagaaatgaaactctgggactatctttactaccatcacccccagcctacaaaggacaataccctgwcacttcttagtgatgcaggtccctctcaccatcaagttcctgaggctctggtggaaggtgtgtcctctgggccctcttgtagagcatggttttggtaggc

SEQ ID NO: 22644 - DNA, 201 bp, Homo sapiens
ctttgtctcttcagggccacactctccccagtgatattagaaatgaaactctgggactatctttactaccatcacccccagcctacaaaggacaatacccygacacttcttagtgatgcaggtccctctcaccatcaagttcctgaggctctggtggaaggtgtgtcctctgggccctcttgtagagcatggttttggtag

SEQ ID NO: 22645 - DNA, 201 bp, Homo sapiens
tattctcagttcctttaccaaaaatgagttggctatcaatgcatggatttattgtgagttctcttttgtattccattagtctatgtgtctgtttttatgckagcaccatgctgatttggttactataactttatattgtatcctgaattcagtaagtgtgatgcctctagctttgttcttcttgctcatgattgctttggc

SEQ ID NO: 22646 - DNA, 201 bp, Homo sapiens
gcttctcctccgaggttgccatagtaaccgtgccctctggcttttgcaagtcactgccaccacttggtctttgtctcttcagggccacactctccccagtratattagaaatgaaactctgggactatctttactaccatcacccccagcctacaaaggacaataccctgacacttcttagtgatgcaggtccctctcacc

SEQ ID NO: 22647 - DNA, 201 bp, Homo sapiens
atcatagatatcaaccagctgcctgtcctaaccctgggacaccaccctctattatacttccccacattccctgcagcttgagtcctcttggcttctcctchgaggttgccatagtaaccgtgccctctggcttttgcaagtcactgccaccacttggtctttgtctcttcagggccacactctccccagtgatattagaaa

SEQ ID NO: 22648 - DNA, 201 bp, Homo sapiens
gagtcaaacaccttcaccctcctgcttctcaattcttgctttcttatcatagatatcaaccagctgcctgtcctaaccctgggacaccaccctctattatmcttccccacattccctgcagcttgagtcctcttggcttctcctccgaggttgccatagtaaccgtgccctctggcttttgcaagtcactgccaccacttg

SEQ ID NO: 22649 - DNA, 201 bp, Homo sapiens
gtctggtcctccccatcccgctgccaggtcagtgtgatctccgcagggtagaagcccagggcccagcacctcagggtggcctcatggtcagagatggggtrgtgggtcatatgtgtcttgggggggtctgacgggaagagtcagaaaattcaggcattttgcatctgtcatgggacactccaccagcacgcatgtggccat

SEQ ID NO: 22650 - DNA, 201 bp, Homo sapiens
cttgagaatggacaggacgcctggggtggggaagggagcacagaacccagacaacagcctggacacaggcacctgggataatctcctattccgtggaaaaytctagtccctgaggagggaacagcgacttctggtcctgacctgagtggaggctgagggactcagaagagctggactcagacccccaggcacattgagtgt

SEQ ID NO: 22651 - DNA, 201 bp, Homo sapiens
gcttgaaatccaccaatggaagaaggaaactcagagctcacccctttcctacctgggatcttattcctccacatcacagcagcgaccacagctacagtgawtacagcaactagaagaaccaggccagcaatgatgcccacaacggggatgatgggctgggaagacagctctaagaaaggaggtgaacgtgaggggccctga

SEQ ID NO: 22652 - DNA, 201 bp, Homo sapiens
aaggaggtgaacgtgaggggccctgacccccaggcctcagccctgaccctgcttaaaggctccagaaggacttctgctttgcctgagaagagacatgaccbctcattcgtctccttaccccatcttagtgtgaggggctcaggcaacccctcgtgctgcacatggcatgtgtacctctgcttctctccagaagacaccact

SEQ ID NO: 22653 - DNA, 201 bp, Homo sapiens
ttaaaggctccagaaggacttctgctttgcctgagaagagacatgacccctcattcgtctccttaccccatcttagtgtgaggggctcaggcaacccctcrtgctgcacatggcatgtgtacctctgcttctctccagaagacaccactgcagctgcccacttctggaaggttctgtaccctgcaagtctggtctccacaa

SEQ ID NO: 22654 - DNA, 201 bp, Homo sapiens; identical to SEQ ID NO: 4349

SEQ ID NO: 22655 - DNA, 201 bp, Homo sapiens; identical to SEQ ID NO: 4350

SEQ ID NO: 22656 - DNA, 201 bp, Homo sapiens
aggacaccagccacccttcgatggagctctgcccagtagtgtcccctcacttccactcagagacaacatgcccatttcactaaattcatgaggacatggcbaacataagtaagagaacaccgggaggtaccttggacagagttccatgcagtcacagcttttgcgtctctgtgtcttttcccttcatctcaaccagagagc

SEQ ID NO: 22657 - DNA, 201 bp, Homo sapiens
cagacgccaacctggacacaggtacctgggataatctcctatccgtggaaaattctagtccctgaggagggaacagtgtcttctggtcctgacctgagtgsaggctgagggactcagaagagctggactcagacccccacacacattgagtgtaaagcagagagcaaggcctgagaggaaaagtaacggggcccaaggctg

SEQ ID NO: 22658 - DNA, 201 bp, Homo sapiens
ccagtagtgtcccctcacttccactcagagacaacatgcccatttcactaaattcatgaggacatggccaacataagtaagagaacaccgggaggtacctkggacagagttccatgcagtcacagcttttgcgtctctgtgtcttttcccttcatctcaaccagagagcatttgccgaggccgaagaacaaaaaacttcaa

SEQ ID NO: 22659 - DNA, 201 bp, Homo sapiens
gtggggaagggagcacagaacccagacgccaacctggacacaggtacctgggataatctcctatccgtggaaaattctagtccctgaggagggaacagtgwcttctggtcctgacctgagtggaggctgagggactcagaagagctggactcagacccccacacacattgagtgtaaagcagagagcaaggcctgagagga

SEQ ID NO: 22660 - DNA, 201 bp, Homo sapiens
tgagaatggacaggacacctggggtggggaagggagcacagaacccagacgccaacctggacacaggtacctgggataatctcctatccgtggaaaattcyagtccctgaggagggaacagtgtcttctggtcctgacctgagtggaggctgagggactcagaagagctggactcagacccccacacacattgagtgtaaa

SEQ ID NO: 22661 - DNA, 201 bp, Homo sapiens
tctttctccattgtatattctcagttcctttaccaaaaatgagttggctatcaatgcatggatttattgtgagttctcttttgtattccattagtctatgbgtctgtttttatgctagcaccatgctgatttggttactataactttatattgtatcctgaattcagtaagtgtgatgcctctagctttgttcttcttgct

SEQ ID NO: 22662 - DNA, 201 bp, Homo sapiens
agtaagagaacaccgggaggtaccttggacagagttccatgcagtcacagcttttgcgtctctgtgtcttttcccttcatctcaaccagagagcatttgcbgaggccgaagaacaaaaaacttcaaatattggagcggaatctaagaccactgatccattgtgatcaggaggctggagccatgtggtccaggaataatgaa

SEQ ID NO: 22663 - DNA, 201 bp, Homo sapiens
agacactccagcagcacgcatgtggccatcctgagaatggacaggacacctggggtggggaagggagcacagaacccagacgccaacctggacacaggtayctgggataatctcctatccgtggaaaattctagtccctgaggagggaacagtgtcttctggtcctgacctgagtggaggctgagggactcagaagagctg

SEQ ID NO: 22664 - DNA, 201 bp, Homo sapiens
tttgcatctctcatgagacactccagcagcacgcatgtggccatcctgagaatggacaggacacctggggtggggaagggagcacagaacccagacgccarcctggacacaggtacctgggataatctcctatccgtggaaaattctagtccctgaggagggaacagtgtcttctggtcctgacctgagtggaggctgagg

SEQ ID NO: 22665 - DNA, 201 bp, Homo sapiens
gcactttgcatctctcatgagacactccagcagcacgcatgtggccatcctgagaatggacaggacacctggggtggggaagggagcacagaacccagacrccaacctggacacaggtacctgggataatctcctatccgtggaaaattctagtccctgaggagggaacagtgtcttctggtcctgacctgagtggaggct

SEQ ID NO: 22666 - DNA, 201 bp, Homo sapiens
cacagggtagaagcccagggcccagcacctcagggtggccttatagtcagagatggaatggtggatcatatgtgtcttggtgggggggtctaacaggaagwgtcagaaaattcaggcactttgcatctctcatgagacactccagcagcacgcatgtggccatcctgagaatggacaggacacctggggtggggaagggag

SEQ ID NO: 22667 - DNA, 201 bp, Homo sapiens
attctgttctgttggtctatatgcttgtttttctaccagtaccatgctgttttggttactttagccttatagtatagttttaagtaggatagcctgatgcytccagctttattctttttgcttagcattctcctggctacacaacctcttttttggatccatatgaattttcaaatttttttttctaattctgtgataagc

SEQ ID NO: 22668 - DNA, 201 bp, Homo sapiens
ctgccaggtcagtgtgatctccacagggtagaagcccagggcccagcacctcagggtggccttatagtcagagatggaatggtggatcatatgtgtcttgstgggggggtctaacaggaagagtcagaaaattcaggcactttgcatctctcatgagacactccagcagcacgcatgtggccatcctgagaatggacagga

SEQ ID NO: 22669 - DNA, 201 bp, Homo sapiens
tgtttttgtcaggtttgttgaagatcacatggttgtagatgtgaggtcttatttctgagttttctattctgttctgttggtctatatgcttgtttttctaycagtaccatgctgttttggttactttagccttatagtatagttttaagtaggatagcctgatgcctccagctttattctttttgcttagcattctcctgg

SEQ ID NO: 22670 - DNA, 201 bp, Homo sapiens
tcccgagtctggtcctctccatcctgctgccaggtcagtgtgatctccacagggtagaagcccagggcccagcacctcagggtggccttatagtcagagayggaatggtggatcatatgtgtcttggtgggggggtctaacaggaagagtcagaaaattcaggcactttgcatctctcatgagacactccagcagcacgca

SEQ ID NO: 22671 - DNA, 201 bp, Homo sapiens
tctgttcatgtgctttgtccacttcttaatgaagttgtttttttcatgtaaatttgcttaagttctttttagattatgaatattagacctttgtcagatcratagattgcataaattttctcccattctgtaggttgtctccttttcgctctgatgatagtttcttttcctgtgcagaagctcttttgtttaattagatcc

SEQ ID NO: 22672 - DNA, 201 bp, Homo sapiens
gttgttctgggtgctcagtgtccagagaggaggatggggaggaggctttgtgcagaacaggaaccgtggagctggatgcacactcagtaatgagacagccmtgccaggggtcctggggctgccggttgttctgggtgctcagtgtccagagaggaggatggggaggaggctttgtgcagaacaggaaccgtgccccataac

SEQ ID NO: 22673 - DNA, 201 bp, Homo sapiens
ccacctgtatgtcttcttttgagaagtgtctgttcatgtgctttgtccacttcttaatgaagttgtttttttcatgtaaatttgcttaagttctttttagrttatgaatattagacctttgtcagatcaatagattgcataaattttctcccattctgtaggttgtctccttttcgctctgatgatagtttcttttcctgt

SEQ ID NO: 22674 - DNA, 201 bp, Homo sapiens
tccccccagttctgcctgtttcctttccccagtgtacaatctcctgagtaaatggctatatggtcctttgccgaaggactgagggaattgtcccagcatabacttccacggggttgcagagtattccgcctagagatatggactcttcctctgtcactgagatctgaatctgcatcttggctgaggtctaggcattgagga

SEQ ID NO: 22675 - DNA, 201 bp, Homo sapiens
tcgccagaatctgttgtttcttaactttttaataattgccattctgactggcatgagatggtatcttattgtggttttgatttgcatttctctaacgatcrgtgatattgagctttttaaaatatgttttttggccacctgtatgtcttcttttgagaagtgtctgttcatgtgctttgtccacttcttaatgaagttgtt

SEQ ID NO: 22676 - DNA, 201 bp, Homo sapiens
acatatgaatctaaactagactctgctttataaattgatgagtttctattggagccagcactaggattactacaactcagggcaggaagaagagtaggagwgcagaagaggagttccaacagaaagttacctatgatgagaaactatgggaccctgcctcttggcaaatttcagaatctggttcctttaaaaagattgcag

SEQ ID NO: 22677 - DNA, 201 bp, Homo sapiens
ttccgtggaaaattctagtccctgaggagggaacagcgacttctggtcctgacctgagtggaggctgagggactcagaagagctggactcagacccccagrcacattgagtgtgaagcagagaacaaggcctgagaggaaaagtcacggggcccaaggctgctgccagtgtcaaagggaaccactcatcagtattccaggg

SEQ ID NO: 22678 - DNA, 201 bp, Homo sapiens
gaagagctggactcagacccccaggcacattgagtgtgaagcagagaacaaggcctgagaggaaaagtcacggggcccaaggctgctgccagtgtcaaagrgaaccactcatcagtattccagggattgtcttcccttcatttcctcagagatttcatcccttaattgtgtcagagagcacggcggaccctcagagtcact

SEQ ID NO: 22679 - DNA, 201 bp, Homo sapiens
cattgtgatcaggaggctggagccatgtggtccaggaataatgaagtctgtgaggccttggtcaccccaaggctctctcccattaggagctgcctctcacdgctatcagggaggacccaggagctggacatggctttttttttttttttttttcatttctgatgagaacctggagaggtcccagagcatatagaccttgat

SEQ ID NO: 22680 - DNA, 201 bp, Homo sapiens; identical to SEQ ID NO: 4272

SEQ ID NO: 22681 - DNA, 201 bp, Homo sapiens
ttttttttttcatttctgatgagaacctggagaggtcccagagcatatagaccttgattgaaatggggccagagtggagtcaggcaaaaaactctaatgabtcagaggcacctaagtataaaataaaatctcaactcagagcttccatcagagcatcaggctcagtatctcctgtgtttgcactgtgagtactggagcttg

SEQ ID NO: 22682 - DNA, 201 bp, Homo sapiens
ggggtttcaccatgttagctaggatggtctcgatctcctgaccttgtgatccacgcgcctcggcctcccaaagtgctgggattacaggcgtgagccaccgygcccggccttttttaacctttttatcttagagaggcaattaggttttagacagccccacagaatgcattaaagaccaaggtgcaagtaacactgtgccag

SEQ ID NO: 22683 - DNA, 201 bp, Homo sapiens
ttgtgatccacgcgcctcggcctcccaaagtgctgggattacaggcgtgagccaccgcgcccggccttttttaacctttttatcttagagaggcaattagsttttagacagccccacagaatgcattaaagaccaaggtgcaagtaacactgtgccaggctttgcggataaatgcattaaaaatctataaaacactgtatt

SEQ ID NO: 22684 - DNA, 201 bp, Homo sapiens
tggagcttgatgagaagaaaaatagctacatgtgcagaaaaacatatgtagttagaaagctgggtcatggttcaaggtaagagggacccttgtcttttccrtggtagatagtggggctttctgccatcttagttctgatggaccaagtgcagaagataaactttcctgctttcagcttagtgactggtaatagaagctgga

SEQ ID NO: 22685 - DNA, 201 bp, Homo sapiens
gcacatgtatctctgttcctctccagaaggcaccaccacagctgcccacttctggaagtttccatcccctgcaggcctggtctctacaagctccatgtccygagtctggtcctctccatcctgctgccaggtcagtgtgatctccacagggtagaagcccagggcccagcacctcagggtggccttatagtcagagatgga

SEQ ID NO: 22686 - DNA, 201 bp, Homo sapiens
tgaccctcagcccccagcaccgaccctgctgaagttctccagagaggctcctgctttccctaagagacatgaccccccctccactcatctcctgcctaacyccatctcagggtgaggggcttgggcaacccctcatgctgcacatggcacatgtatctctgttcctctccagaaggcaccaccacagctgcccacttctgg

SEQ ID NO: 22687 - DNA, 201 bp, Homo sapiens
ccctgaccctcagcccccagcaccgaccctgctgaagttctccagagaggctcctgctttccctaagagacatgaccccccctccactcatctcctgcctwactccatctcagggtgaggggcttgggcaacccctcatgctgcacatggcacatgtatctctgttcctctccagaaggcaccaccacagctgcccacttc

SEQ ID NO: 22688 - DNA, 201 bp, Homo sapiens
tctgctctgcagtgatatccagacaacataaaagctgcaattataattcctgcttggccaggcctggagtaatctcattcattctttagtcctcatcaggsttcctcagggacaggttgctggattatgtagagacaatagacaaccccaacaccatcccacatccttcagctctctaatggtggtgtgacccccacatta

SEQ ID NO: 22689 - DNA, 201 bp, Homo sapiens
gcgtccctgaccctcagcccccagcaccgaccctgctgaagttctccagagaggctcctgctttccctaagagacatgaccccccctccactcatctcctrcctaactccatctcagggtgaggggcttgggcaacccctcatgctgcacatggcacatgtatctctgttcctctccagaaggcaccaccacagctgccca

SEQ ID NO: 22690 - DNA, 201 bp, Homo sapiens
aatccatagctgcacgctgtgtgcccgaggctttattattctgctctgcagtgatatccagacaacataaaagctgcaattataattcctgcttggccagrcctggagtaatctcattcattctttagtcctcatcaggcttcctcagggacaggttgctggattatgtagagacaatagacaaccccaacaccatcccac

SEQ ID NO: 22691 - DNA, 201 bp, Homo sapiens
gagcgtccctgaccctcagcccccagcaccgaccctgctgaagttctccagagaggctcctgctttccctaagagacatgaccccccctccactcatctcytgcctaactccatctcagggtgaggggcttgggcaacccctcatgctgcacatggcacatgtatctctgttcctctccagaaggcaccaccacagctgcc

SEQ ID NO: 22692 - DNA, 201 bp, Homo sapiens
tcctcatccattccttacctgagttcttcttcctgcacatcacagcagaaaccacagctccagtgactacagctccaaggagaaccaggccagcaacgatrcccacgatggggatggtgggctgagaagactgctctgggaaaaaaggggaaggtgagcgtccctgaccctcagcccccagcaccgaccctgctgaagttc

SEQ ID NO: 22693 - DNA, 201 bp, Homo sapiens
accccactcctcatccattccttacctgagttcttcttcctgcacatcacagcagaaaccacagctccagtgactacagctccaaggagaaccaggccagyaacgatacccacgatggggatggtgggctgagaagactgctctgggaaaaaaggggaaggtgagcgtccctgaccctcagcccccagcaccgaccctgct

SEQ ID NO: 22694 - DNA, 201 bp, Homo sapiens
tctttatctagtccctcattggtgggcatttgggttgattccatgtctttgctgttgtgaattgtgctgcaatgaacaaacacatgcacatatctttatartagaatgatttatattcctttgggtatataccctgcaatgggattgctgggtcaaatggtatttctggttctaaatctttgaggaatcaccacactgcct

SEQ ID NO: 22695 - DNA, 201 bp, Homo sapiens
tgctgggatcaggtccccatcatcataatcatcaaggtgataaatctgtccttcattgtcacaggtgctttacaaaagagtaagtgctggcacacagggcscaggctgggtaggcccatgagtgtggatggtgcttcccagtaaccaggcaggacacacttctaactggggcttgaaaccctcagtgggacaagaaatctc

SEQ ID NO: 22696 - DNA, 201 bp, Homo sapiens
catatatgtatcatattttctttatctagtccctcattggtgggcatttgggttgattccatgtctttgctgttgtgaattgtgctgcaatgaacaaacayatgcacatatctttataatagaatgatttatattcctttgggtatataccctgcaatgggattgctgggtcaaatggtatttctggttctaaatctttga

SEQ ID NO: 22697 - DNA, 201 bp, Homo sapiens
ttattattaatttttttattttttatttatttacagacagggcgtcactctgttaccctggctaaagtgcagtggcacgctcatgactcactgaagcctckacctccttggctcatgtgatcaatgctcctccctcagcctcccaagtagctggcaccacaggcttgtgccaccactcctggctaatttttctaaaaataa

SEQ ID NO: 22698 - DNA, 201 bp, Homo sapiens
tgtgactgctgggatcaggtccccatcatcataatcatcaaggtgataaatctgtccttcattgtcacaggtgctttacaaaagagtaagtgctggcacasagggcccaggctgggtaggcccatgagtgtggatggtgcttcccagtaaccaggcaggacacacttctaactggggcttgaaaccctcagtgggacaaga

SEQ ID NO: 22699 - DNA, 201 bp, Homo sapiens
gtttgctgaggataatggcttccagcttcatccatatccctgcaaaggatttgatctcattcctttttatggctgcataatattccatggcatatatgtaycatattttctttatctagtccctcattggtgggcatttgggttgattccatgtctttgctgttgtgaattgtgctgcaatgaacaaacacatgcacatat

SEQ ID NO: 22700 - DNA, 201 bp, Homo sapiens
gtttactccctgagctccataagccccactgtgatgagagacatgatagtgctgtgggcatctgagcatcaatgtcagttcacacccagtgtcaataatchccccagttctgcctgtttcctttccccagtgtacaatctcctgagtaaatggctatatggtcctttgccgaaggactgagggaattgtcccagcatatac

SEQ ID NO: 22701 - DNA, 201 bp, Homo sapiens
ctgtgttagtttgctgaggataatggcttccagcttcatccatatccctgcaaaggatttgatctcattcctttttatggctgcataatattccatggcayatatgtatcatattttctttatctagtccctcattggtgggcatttgggttgattccatgtctttgctgttgtgaattgtgctgcaatgaacaaacacat

SEQ ID NO: 22702 - DNA, 201 bp, Homo sapiens
aattcaaactattatttcaggatttttaagttaaaggcttttaatctaattatttttccttaacattttaatcttgtcctttaatttaatttagtttaatkttaagttccagggtacatatgcaggatgtgcaggtttgttacacaggtaaacgggttccacggcagtttgctgcaccaatcaacccataacctaggtatt

SEQ ID NO: 22703 - DNA, 201 bp, Homo sapiens
cacctctggaagggagcagtattaaaggatttgcatatatgttaaaagcaaaattcaaactattatttcaggatttttaagttaaaggcttttaatctaaytatttttccttaacattttaatcttgtcctttaatttaatttagtttaattttaagttccagggtacatatgcaggatgtgcaggtttgttacacaggta

SEQ ID NO: 22704 - DNA, 201 bp, Homo sapiens
aagtccaagccacactcaagagagggaattaagctgcacctctggaagggagcagtattaaaggatttgcatatatgttaaaagcaaaattcaaactattrtttcaggatttttaagttaaaggcttttaatctaattatttttccttaacattttaatcttgtcctttaatttaatttagtttaattttaagttccaggg

SEQ ID NO: 22705 - DNA, 201 bp, Homo sapiens
acctcctcacattatgcctacacgaacacagacacatgcaggtgcctttgcagaaacaaagtcagggttcttcaagtcacaaagggaagggcaggaacaamtcttgcctctcagtcccacacaaggcagctgtctcacactatagaaaaaaatattcatgaacaaattcatatctgtcacagtgaggggtcacactttaaa

SEQ ID NO: 22706 - DNA, 201 bp, Homo sapiens
ttcgcatgacaattgaagatgagatttgggtgggaacacagaaccaggccatatcagaagtgcatcattaagtccaagccacactcaagagagggaattargctgcacctctggaagggagcagtattaaaggatttgcatatatgttaaaagcaaaattcaaactattatttcaggatttttaagttaaaggcttttaat

SEQ ID NO: 22707 - DNA, 201 bp, Homo sapiens
attcgcatgacaattgaagatgagatttgggtgggaacacagaaccaggccatatcagaagtgcatcattaagtccaagccacactcaagagagggaattmagctgcacctctggaagggagcagtattaaaggatttgcatatatgttaaaagcaaaattcaaactattatttcaggatttttaagttaaaggcttttaa

SEQ ID NO: 22708 - DNA, 201 bp, Homo sapiens
gaggtttccctttggctttcagcacaatgaaagtccttactccacagactagggacccagggtgggggtaactccacttagcagtgcatcagtgtcaattrtgcactcagggtataggaagataaccagggctgggtctatggatccagtagttccattgtgggccataatgtgtccaggtttactccctgagctccataa

SEQ ID NO: 22709 - DNA, 201 bp, Homo sapiens
tgtgcagaaaaacatatgtagttagaaagctgggtcatggttcaaggtaagagggacccttgtcttttccgtggtagatagtggggctttctgccatcttrgttctgatggaccaagtgcagaagataaactttcctgctttcagcttagtgactggtaatagaagctggagttaagagaatcagtggcagcctctctctc

SEQ ID NO: 22710 - DNA, 201 bp, Homo sapiens
cagcttagtgactggtaatagaagctggagttaagagaatcagtggcagcctctctctccatgccccagcccagtaaatctaagccaggacttggggctchggcactttcttctcactgtgcgtcctccttctctggctcaaaagagaaccacatgtaacagaaaccaagggctacaattctcatagaacccagaaaactg

SEQ ID NO: 22711 - DNA, 201 bp, Homo sapiens
cattaatttaactttgatatctgttccatttctgtgactctgttaagaaattagagactttgaactttctattaattttactttcttggaaatgtccctcytgggcccttctggctgctcccatctggactggaggcttctacctgtgggacagagtcaccttcctaggatctccctccaccaccatctggggcggtgctt

SEQ ID NO: 22712 - DNA, 201 bp, Homo sapiens
atgaacctccgccccccgggccgcctcccacttgagctgggtgatctgagccgccgtgtctgcggctgtcaaggagcacaggtcctcgttcaggacgatgdaatccttgccatcgtaagcaagctggtgatacccgcggagtaggcgcccgtccgaccccacgtcgcagacagacatcctctagatgggtgtgagaccctg

SEQ ID NO: 22713 - DNA, 201 bp, Homo sapiens; identical to SEQ ID NO: 4301

SEQ ID NO: 22714 - DNA, 201 bp, Homo sapiens
gtattgtctttagaccatactatatagggcaggggagttacaatagccctgagaaaaaactataaataaatgtgttgtggatcccacatggatgtgaatcrctccatatcccctttctaattggagtggaaagaaatgcactcaccaaatccatagctgcacgctgtgtgcccgaggctttattattctgctctgcagtga

SEQ ID NO: 22715 - DNA, 201 bp, Homo sapiens; identical to SEQ ID NO: 4302

SEQ ID NO: 22716 - DNA, 201 bp, Homo sapiens
caccgcagtcaacatgaagttgtcagtgaaatgagctgatttaatatcctatagaatatccagtatgtctagtattgtctttagaccatactatataggghaggggagttacaatagccctgagaaaaaactataaataaatgtgttgtggatcccacatggatgtgaatcgctccatatcccctttctaattggagtgga

SEQ ID NO: 22717 - DNA, 201 bp, Homo sapiens
cctgaggtctgtcctcagcagggaccttcccctgtgacttgtgactgctgggatcaggtccccatcatcataatcatcaaggtgataaatctgtccttcaktgtcacaggtgctttacaaaagagtaagtgctggcacacagggcccaggctgggtaggcccatgagtgtggatggtgcttcccagtaaccaggcaggaca

SEQ ID NO: 22718 - DNA, 201 bp, Homo sapiens
acaaaccccctagcctttgatcccagagaagtttcctgaaagtgtaactgctgatctaggacaggatcaggaaacatgaggaaagcaggtgtgggtcctgraccaactgccctcctgaggtctgtcctcagcagggaccttcccctgtgacttgtgactgctgggatcaggtccccatcatcataatcatcaaggtgataa

SEQ ID NO: 22719 - DNA, 201 bp, Homo sapiens
gcatgggccaccatgcctggataattttgtatttttagtagagacggggtttctccgtgttggtcaggctagtctccaactcccaacctcaggtgatccabccacctcagccttccaaagtgctgggattacaggcgtgagccactgcacctggccgagtggccactctggaagctttgtaaggtttatcttcaccttctg

SEQ ID NO: 22720 - DNA, 201 bp, Homo sapiens
gagtcagggccatacggccctaaacaaaccccctagcctttgatcccagagaagtttcctgaaagtgtaactgctgatctaggacaggatcaggaaacatraggaaagcaggtgtgggtcctggaccaactgccctcctgaggtctgtcctcagcagggaccttcccctgtgacttgtgactgctgggatcaggtccccat

SEQ ID NO: 22721 - DNA, 201 bp, Homo sapiens
gtcctatgagaggccagaaaggagtcagggccatacggccctaaacaaaccccctagcctttgatcccagagaagtttcctgaaagtgtaactgctgatcyaggacaggatcaggaaacatgaggaaagcaggtgtgggtcctggaccaactgccctcctgaggtctgtcctcagcagggaccttcccctgtgacttgtga

SEQ ID NO: 22722 - DNA, 201 bp, Homo sapiens
cagagtagctcactctatctgtgggaagaaaatgtcctatgagaggccagaaaggagtcagggccatacggccctaaacaaaccccctagcctttgatccyagagaagtttcctgaaagtgtaactgctgatctaggacaggatcaggaaacatgaggaaagcaggtgtgggtcctggaccaactgccctcctgaggtctg

SEQ ID NO: 22723 - DNA, 201 bp, Homo sapiens
cagaattgcaagtgcttaatgcagccaaagtgcccttcgccagtgctcatgcactccctttattattaatttttttattttttatttatttacagacaggkcgtcactctgttaccctggctaaagtgcagtggcacgctcatgactcactgaagcctcgacctccttggctcatgtgatcaatgctcctccctcagcctc

SEQ ID NO: 22724 - DNA, 201 bp, Homo sapiens
tcggcgtgggtctccgattgtgctacagtgggtagcacaatcttggtagcccctgaatggtcacgaatctaatttgtaaaagagatgatttttggccccaytatatataaatatgtctaaacgcattgcaattagactcacaaagtgaagttttactttcccagactgtgtatctgtgactctggtctgttgtatttttac

SEQ ID NO: 22725 - DNA, 201 bp, Homo sapiens
ccagcgtctcacctttacaagccgtgagagacacatcagaaccctgcgcatggtcgctgcctggggtagaacaaaaacaggacttggtcagagcccagagragatgcggctagaggaggaatctggggttgggtgagctcccccatgggctcccgaccacaatatcccaaggatctcagggatcagcccacttcatactta

SEQ ID NO: 22726 - DNA, 201 bp, Homo sapiens
cccccagcgtctcacctttacaagccgtgagagacacatcagaaccctgcgcatggtcgctgcctggggtagaacaaaaacaggacttggtcagagcccasaggagatgcggctagaggaggaatctggggttgggtgagctcccccatgggctcccgaccacaatatcccaaggatctcagggatcagcccacttcatac

SEQ ID NO: 22727 - DNA, 201 bp, Homo sapiens
agctgcatccactattgcccccaacaccccccacacatcaggtcccccagcgtctcacctttacaagccgtgagagacacatcagaaccctgcgcatggtygctgcctggggtagaacaaaaacaggacttggtcagagcccagaggagatgcggctagaggaggaatctggggttgggtgagctcccccatgggctcccg

SEQ ID NO: 22728 - DNA, 201 bp, Homo sapiens
catggtggacatgggggtggggtggtctccccacctcctcacattatgcctacacgaacacagacacatgcaggtgcctttgcagaaacaaagtcagggtwcttcaagtcacaaagggaagggcaggaacaactcttgcctctcagtcccacacaaggcagctgtctcacactatagaaaaaaatattcatgaacaaattc

SEQ ID NO: 22729 - DNA, 201 bp, Homo sapiens
gtctggagtgtttcctgtaagcattcttctagtagttttatagttttgggacttacatttaaatctttaatccattttgagttgatttctgtatatggtgrgagacggttctagtggtattcttctgcatctggtagcattttcccagctccatttattctccattgttgcttttgttctttctccattgtatattctcag

SEQ ID NO: 22730 - DNA, 201 bp, Homo sapiens; identical to SEQ ID NO: 4310

SEQ ID NO: 22731 - DNA, 201 bp, Homo sapiens
ttttacaaattggaataagaggacactggtgtgcagatgaaaatgattttgtagtccaaatcctccaaaaagcaagtgccatcatgggattaaagttacarcattttattaggggacatacctgtcagacgatattgtgagggagtcaggttaccctgggaaaggcaacaggccgagatgcaagtgtgacccccagtgatg

SEQ ID NO: 22732 - DNA, 201 bp, Homo sapiens
cctgggtctggtcctccccatcccgctgccaggtcagtgtgatctccgcagggtagaagctcagggcccagcacctcagggtggcttcatggtcagagacrgcgtggtgagtcatatgcgttttgggggcgtctgtcaggaagagtcagatcattcaggcattttgcatctgtcatgggacactcctccagcacacatgtg

SEQ ID NO: 22733 - DNA, 201 bp, Homo sapiens; identical to SEQ ID NO: 4319

SEQ ID NO: 22734 - DNA, 201 bp, Homo sapiens; identical to SEQ ID NO: 4320

SEQ ID NO: 22735 - DNA, 201 bp, Homo sapiens
cgggtaaagggtctccaggttccgctgcctcggcgtggatctcggacccagagactcggggagacccgggcggtccgtgggggatgtagaggggtagtgabctgcgcccccggccggtgtcactcacaggcctcactctggttgtagtagccgctcagggtccgcaggttcactcggtaaaactgtgctttggccttggcg

SEQ ID NO: 22736 - DNA, 201 bp, Homo sapiens
cctgggcctctcccgggtaaagggtctccaggttccgctgcctcggcgtggatctcggacccagagactcggggagacccgggcggtccgtgggggatgtrgaggggtagtgatctgcgcccccggccggtgtcactcacaggcctcactctggttgtagtagccgctcagggtccgcaggttcactcggtaaaactgtgc

SEQ ID NO: 22737 - DNA, 201 bp, Homo sapiens
ttttcaaagcccacggtagaggaaacccctcatgctgaatccctctcacactgcaaatctctatgctcagaaagaacacagacctttcaaggactcacctwattaggacagtcaaagcaggataaacccagcctaaagtcaactaattgaggcccttagttatatctgctaaatcccttcacagcagcatctacactagag

SEQ ID NO: 22738 - DNA, 201 bp, Homo sapiens
ggccagccccgcccaccgagccccgccctcgccaggaccaacctgcggggattttggctgaaaatgaaaccgggtaacggctcctgggcctctcccgggtvaagggtctccaggttccgctgcctcggcgtggatctcggacccagagactcggggagacccgggcggtccgtgggggatgtagaggggtagtgatctgcg

SEQ ID NO: 22739 - DNA, 201 bp, Homo sapiens
tacttcttggtttttggacccacgtattcttccttctgtaaacacagcactatagagacatctttgattcaatacatgcaccacatcctgaaagatggcasccattcctcagagggtttcatccaagctggcactaagttgtgtctgtagagacctgtccatgactctgtgtggctggcagcccctgggaggtgcaggtgg

SEQ ID NO: 22740 - DNA, 201 bp, Homo sapiens
cactgtgactttcccactggtgcttggttcagctccatcctgcatctttccctaccaatggcatcaccagcaccagggggtctgagagatggtggctgctygcaccatggcctggatctgctgcagggtccttttctgtgtgggccctacttgaagctggcctcctcctatgtcacctagagtgtgggccaaagcaacata

SEQ ID NO: 22741 - DNA, 201 bp, Homo sapiens
ctcatgatggatgctgttgggcctgtctaatctatgactctgtgggtcacacaggcactcgaaccacatagttgcttggtgtcccgtggtcaagcattctrtctaatcaggacaagggacactaaaagttgcttctaataggtggcatatgtctctgctgtgaatgacatgaccttactccagaatcccaggcctttcact

SEQ ID NO: 22742 - DNA, 201 bp, Homo sapiens
atacatccaattcaaagaaaccccatagcacagctgcatccactattgcccccaacaccccccacacatcaggtcccccagcgtctcacctttacaagccrtgagagacacatcagaaccctgcgcatggtcgctgcctggggtagaacaaaaacaggacttggtcagagcccagaggagatgcggctagaggaggaatct

SEQ ID NO: 22743 - DNA, 201 bp, Homo sapiens
ccattttcacctcatgatggatgctgttgggcctgtctaatctatgactctgtgggtcacacaggcactcgaaccacatagttgcttggtgtcccgtggtbaagcattctatctaatcaggacaagggacactaaaagttgcttctaataggtggcatatgtctctgctgtgaatgacatgaccttactccagaatcccag

SEQ ID NO: 22744 - DNA, 201 bp, Homo sapiens
cagcccatcacatgttcaatacatccaattcaaagaaaccccatagcacagctgcatccactattgcccccaacaccccccacacatcaggtcccccagcktctcacctttacaagccgtgagagacacatcagaaccctgcgcatggtcgctgcctggggtagaacaaaaacaggacttggtcagagcccagaggagatg

SEQ ID NO: 22745 - DNA, 201 bp, Homo sapiens
acagcccatcacatgttcaatacatccaattcaaagaaaccccatagcacagctgcatccactattgcccccaacaccccccacacatcaggtcccccagygtctcacctttacaagccgtgagagacacatcagaaccctgcgcatggtcgctgcctggggtagaacaaaaacaggacttggtcagagcccagaggagat

SEQ ID NO: 22746 - DNA, 201 bp, Homo sapiens
taaacaaaaggattttacaaattggaataagaggacactggtgtgcagatgaaaatgattttgtagtccaaatcctccaaaaagcaagtgccatcatgggrttaaagttacaacattttattaggggacatacctgtcagacgatattgtgagggagtcaggttaccctgggaaaggcaacaggccgagatgcaagtgtga

SEQ ID NO: 22747 - DNA, 201 bp, Homo sapiens
ggtggaccattttcacctcatgatggatgctgttgggcctgtctaatctatgactctgtgggtcacacaggcactcgaaccacatagttgcttggtgtcchgtggtcaagcattctatctaatcaggacaagggacactaaaagttgcttctaataggtggcatatgtctctgctgtgaatgacatgaccttactccagaa

SEQ ID NO: 22748 - DNA, 201 bp, Homo sapiens
catgaacaaattcatatccgtcacagtgagggatgacactttaaacagcccatcacatgttcaatacatccaattcaaagaaaccccatagcacagctgcrtccactattgcccccaacaccccccacacatcaggtcccccagcgtctcacctttacaagccgtgagagacacatcagaaccctgcgcatggtcgctgcc

SEQ ID NO: 22749 - DNA, 201 bp, Homo sapiens
aatttaagtcaattctttcaactcaatgttttcagaacacatcatcaacatcaagtattacacatttattttaaaagttccattttaaaagggaatggatgatatgttgtttggactttagccagcactgttgtaaaacacagaacctgtaaactaccctgggctgctgcccattcacatcccccaaaaggagactccatc

SEQ ID NO: 22750 - DNA, 201 bp, Homo sapiens
cccacacaaggcagctgtctcacactataaaataaaatattcatgaacaaattcatatccgtcacagtgagggatgacactttaaacagcccatcacatgytcaatacatccaattcaaagaaaccccatagcacagctgcatccactattgcccccaacaccccccacacatcaggtcccccagcgtctcacctttacaa

SEQ ID NO: 22751 - DNA, 201 bp, Homo sapiens
tttgtctgtttggttgttcagtgccacttcagacttgggtattttctctgggtgtaaacatgggattcaagctcaacccaggtggaccattttcacctcaygatggatgctgttgggcctgtctaatctatgactctgtgggtcacacaggcactcgaaccacatagttgcttggtgtcccgtggtcaagcattctatcta

SEQ ID NO: 22752 - DNA, 201 bp, Homo sapiens
aggcgtgaacaaatcttgcctctcagtcccacacaaggcagctgtctcacactataaaataaaatattcatgaacaaattcatatccgtcacagtgagggrtgacactttaaacagcccatcacatgttcaatacatccaattcaaagaaaccccatagcacagctgcatccactattgcccccaacaccccccacacatc

SEQ ID NO: 22753 - DNA, 201 bp, Homo sapiens
tgtgtggttttgttccaatgtaagtagttcttgttaaggatgcttgcaatgaactttggtattcttttctctttcatttttataaaaaccaagcatattttactttgaaaaaatctgtttaaggaattaggaatttaagtcaattctttcaactcaatgttttcagaacacatcatcaacatcaagtattacacatttatt

SEQ ID NO: 22754 - DNA, 201 bp, Homo sapiens
caggaacacaggcacattcaggtgcctttgcagaaagagagtcagggtttttgaagtcacaaagggaaggcgtgaacaaatcttgcctctcagtcccacasaaggcagctgtctcacactataaaataaaatattcatgaacaaattcatatccgtcacagtgagggatgacactttaaacagcccatcacatgttcaata

SEQ ID NO: 22755 - DNA, 201 bp, Homo sapiens
ataaagttgagacagagatggagacatctcagcctcacctctatggagcaggaatgattaattattggagacggaacacaggtcagcatgagggaagaggrtcatggtggacatgggggtgggttggtctccccacctcctcatattatgcctacaggaacacaggcacattcaggtgcctttgcagaaagagagtcaggg

SEQ ID NO: 22756 - DNA, 201 bp, Homo sapiens
aagtaaatttatactcagattctaattttaatagggaagtaagaagttacagctcagtgcacataaagttgagacagagatggagacatctcagcctcacstctatggagcaggaatgattaattattggagacggaacacaggtcagcatgagggaagagggtcatggtggacatgggggtgggttggtctccccacctc

SEQ ID NO: 22757 - DNA, 201 bp, Homo sapiens; identical to SEQ ID NO: 4327

SEQ ID NO: 22758 - DNA, 201 bp, Homo sapiens; identical to SEQ ID NO: 4328

SEQ ID NO: 22759 - DNA, 201 bp, Homo sapiens
tgatcaatgatgtgcatttccaattctgtaaaagtttaattcagtggtatgtgtggtagaatgtaacatcaaatcctttgcaagatggaattaccttgcacatcagattgaagattgtatacatgaaaatctacagagatgccagtgagccaaggatcaaatgacctatttgtagccaaagccattttcatggcctcgtgg

SEQ ID NO: 22760 - DNA, 201 bp, Homo sapiens; identical to SEQ ID NO: 4330

SEQ ID NO: 22761 - DNA, 201 bp, Homo sapiens
ttttgatcaatgatgtgcatttccaattctgtaaaagtttaattcagtggtatgtgtggtagaatgtaacatcaaatcctttgcaagatggaattaccttgcacatcagattgaagattgtatacatgaaaatctacagagatgccagtgagccaaggatcaaatgacctatttgtagccaaagccattttcatggcctcg

SEQ ID NO: 22762 - DNA, 201 bp, Homo sapiens
aatagcatgccatcaggtgcttctgaagtggttttgtttgtttctttgttttcgcagtcctattgtgttttctattcatattgctattccgtcactggttrttcctttctactcttttcttgtttcatttattttgatcaatgatgtgcatttccaattctgtaaaagtttaattcagtggtatgtgtggtagaatgtaac

SEQ ID NO: 22763 - DNA, 201 bp, Homo sapiens
gaatggggagataaccaggactgggtttatgaacccagtggtcccacagtgggccataatgtgtccaggtttatttcctggcctccttaagccccactgtrgattctgaatctgaagcttggctgaagtctaggaattgagactgggatcatgactttgtatttgatcaaacaccctcagtctcctgctcctcaattcttg

SEQ ID NO: 22764 - DNA, 201 bp, Homo sapiens
ccaggtttatttcctggcctccttaagccccactgtagattctgaatctgaagcttggctgaagtctaggaattgagactgggatcatgactttgtatttratcaaacaccctcagtctcctgctcctcaattcttgcattcccatcatagatatgaagcagtgccctcgctggctgcccatctgttctgacgctgggaca

SEQ ID NO: 22765 - DNA, 201 bp, Homo sapiens
caggtttatttcctggcctccttaagccccactgtagattctgaatctgaagcttggctgaagtctaggaattgagactgggatcatgactttgtatttgrtcaaacaccctcagtctcctgctcctcaattcttgcattcccatcatagatatgaagcagtgccctcgctggctgcccatctgttctgacgctgggacac

SEQ ID NO: 22766 - DNA, 201 bp, Homo sapiens
agtatccactgctaagtgttgtgtatattttataggaacacttagtaatttttaaacctgattaacattaaaaaattagtttttaggcagacccacatgargtattaaaggccaactgccaaggacaccctgctaggctctgtagatggatgtattaaaatccataaaacaatgtatttaaacctaagaattctgctgctt

SEQ ID NO: 22767 - DNA, 201 bp, Homo sapiens
acacctccatgctagcaacattactgaaatgcagggaggaacaagtgattcaattgggaggaaaaaaagcaaagtgatgacatttactcctagacaaaachttttaggaaaatgtatcttaaaagtaggagaaaaacatataatacctgcaatcccctgcaaaagaagcctctttagcttactacttgttcatcgtctttc

SEQ ID NO: 22768 - DNA, 201 bp, Homo sapiens
tgggcctcaattgctaatgagttggacattcagaggtgtcggcagctggatctgccttggtaggggggagtcagtgctgttggccccatacgtagcctcakgcctgccactgtggttgctccattcatgaactcatcctaccaaaccagggctgacccatggtgaaggctggctaacttccatttgtctgtttggttgttc

SEQ ID NO: 22769 - DNA, 201 bp, Homo sapiens
caacctctcatggcaagaatttgaaaaagtaaatttatactcagattctaattttaatagggaagtaagaagttacagctcagtgcacataaagttgagayagagatggagacatctcagcctcacctctatggagcaggaatgattaattattggagacggaacacaggtcagcatgagggaagagggtcatggtggaca

SEQ ID NO: 22770 - DNA, 201 bp, Homo sapiens
gtctctcaaattttaggaatcttctcctttaattaacccatcaacctctcatggcaagaatttgaaaaagtaaatttatactcagattctaattttaatarggaagtaagaagttacagctcagtgcacataaagttgagacagagatggagacatctcagcctcacctctatggagcaggaatgattaattattggagac

SEQ ID NO: 22771 - DNA, 201 bp, Homo sapiens
ccttgccaggggtcctggggctgccggttgttctgggtgctcagtgtccagagaggaggatggggaggaggctttgtgcagaacaggaaccgtggagctgratgcacactcagtaatgagacagccctgccaggggtcctggggctgccggttgttctgggtgctcagtgtccagagaggaggatggggaggaggctttgt

SEQ ID NO: 22772 - DNA, 201 bp, Homo sapiens
catgcaacaaatcagcataagaaacatgtggactctggaaggttctcatgtcttccatttattttgtctctcaaattttaggaatcttctcctttaattarcccatcaacctctcatggcaagaatttgaaaaagtaaatttatactcagattctaattttaatagggaagtaagaagttacagctcagtgcacataaagt

SEQ ID NO: 22773 - DNA, 201 bp, Homo sapiens
aaacctgcttccatcttttgatccctggacacacatgttcttcctattgagaacacagcactctagagacatctctgattcaaacaatgcaccgtgtcctraaagatggcacccacctctcagagtgcttcctccaggctggcactgagttttgcctgtagaagacctgtccagcattccttgtggctggcagcctctgga

SEQ ID NO: 22774 - DNA, 201 bp, Homo sapiens
ccagctgagcagtgaccacataaagcgcacggtggcctgagcacccactgggcacagccccatctactctcctctcatgcaacaaatcagcataagaaacwtgtggactctggaaggttctcatgtcttccatttattttgtctctcaaattttaggaatcttctcctttaattaacccatcaacctctcatggcaagaat

SEQ ID NO: 22775 - DNA, 201 bp, Homo sapiens
tcatttgctgtgctgaagctatttagtttaatatagtcccacttgtctattttatttttgttgcctgtgcttttgaggtcttagccataaagtctttgccbagacccatgtctggagtgtttcctgtaagcattcttctagtagttttatagttttgggacttacatttaaatctttaatccattttgagttgatttctgt

SEQ ID NO: 22776 - DNA, 201 bp, Homo sapiens
ccctgcacagcccagtgttggaagataaaacgtgcaaaataccccattgggtgaatctaagggattggacgtggagccaaacctgcttccatcttttgatycctggacacacatgttcttcctattgagaacacagcactctagagacatctctgattcaaacaatgcaccgtgtcctaaaagatggcacccacctctcag

SEQ ID NO: 22777 - DNA, 201 bp, Homo sapiens
gcgatgagctgtgacatccttctccccaccttcaatctcagccccagcaggcacctcctgggcgcagaagcagtgcagcggcgccacctggcggtctgcamtcttcctttcccagatcaagcacagccctgaaatccacctgtccctcctctgtgcctgtgatttcttcaggggacaccagcgtgggtcaactttcttgta

SEQ ID NO: 22778 - DNA, 201 bp, Homo sapiens
tgtcttttgtctccttttaagggtaccctccttggaaaccaggacctcgtaccctgcacagcccagtgttggaagataaaacgtgcaaaataccccattgrgtgaatctaagggattggacgtggagccaaacctgcttccatcttttgatccctggacacacatgttcttcctattgagaacacagcactctagagacat

SEQ ID NO: 22779 - DNA, 201 bp, Homo sapiens
cacacggggagaaaacccgctaagccccgtagggctggatcatacagccaaggacaacggagcagcaaagatgacccagctgagcagtgaccacataaagygcacggtggcctgagcacccactgggcacagccccatctactctcctctcatgcaacaaatcagcataagaaacatgtggactctggaaggttctcatgt

SEQ ID NO: 22780 - DNA, 201 bp, Homo sapiens
tctttgtcttgtgcttttatttattacaatctctcatctccgcacacggggagaaaacccgctaagccccgtagggctggatcatacagccaaggacaacrgagcagcaaagatgacccagctgagcagtgaccacataaagcgcacggtggcctgagcacccactgggcacagccccatctactctcctctcatgcaaca

SEQ ID NO: 22781 - DNA, 201 bp, Homo sapiens
gggcccagctgttttctctttatctctttgtcttgtgcttttatttattacaatctctcatctccgcacacggggagaaaacccgctaagccccgtagggmtggatcatacagccaaggacaacggagcagcaaagatgacccagctgagcagtgaccacataaagcgcacggtggcctgagcacccactgggcacagccc

SEQ ID NO: 22782 - DNA, 201 bp, Homo sapiens
gtggtcccccgggcccagctgttttctctttatctctttgtcttgtgcttttatttattacaatctctcatctccgcacacggggagaaaacccgctaagycccgtagggctggatcatacagccaaggacaacggagcagcaaagatgacccagctgagcagtgaccacataaagcgcacggtggcctgagcacccactg

SEQ ID NO: 22783 - DNA, 201 bp, Homo sapiens
ttgagaggaggggagggcactgggtttttcccaggtcttgtcctttggtcctggggctcttttcctccttgcatggtggctggtgggcacagggcaggggytgatgttgatggagtcacgggaggggactggcaggggctgggaaaagtgccatgggagggagaaaaaagtgcagacatcatcttccctcggagaaagggt

SEQ ID NO: 22784 - DNA, 201 bp, Homo sapiens
ccgcctcccacttgcgctgggtaatctgagccgccatggccgccgcagtccaagagctcaggtcctggtttagggcgatgtaatctttttacagagaatcstttttacagagaatggggagataaccaggacaggatttatggacccagtgattccaccgtggggcataatttgtccaggtttattccctggcctctgtaa

SEQ ID NO: 22785 - DNA, 201 bp, Homo sapiens
agccaaggatcaaatgacctatttgtagccaaggctgtttttcatggcatcctggtcctctcacatggctccttaaaattggctgtggcttgttttttgtrgttgtttgtttgtttgttttgagatggagtatggctctgtcacccaggctggagtgcgatggcaggatctcagctcactgcaacttctgccttccaggtt

SEQ ID NO: 22786 - DNA, 201 bp, Homo sapiens
tggaatgtggtgttgccaggacccagagaagctcaccaaatagtgtgcttccttccttctgttgaggatgcaagatgcaagtttgtcttttactttggagrggacagccctgcatgcccctaaccactggacccataacacttcactgcagtggccactcttgaagctctgtaaggttaatcttcaccttctgtagtgcac

SEQ ID NO: 22787 - DNA, 201 bp, Homo sapiens
ccactggacccataacacttcactgcagtggccactcttgaagctctgtaaggttaatcttcaccttctgtagtgcacacgttttgccaaagaattcagcrtactttcctcctcttactcatccatcccaatctatgtgatattgccaatgaaatgaagagatttagtattctgtgagatgtctgatttgtccagatctct

SEQ ID NO: 22788 - DNA, 201 bp, Homo sapiens
ccatctgttctgacgctgggacaccaccttttactaacctttcccaaaactccatgaaggttgagcccctttggctgctactctgggttctcacagtaacygtgccctctatcttttgcaggtcactgcaaaggagggttcctaaagcattcactcctgatcctgagggaggtgggtgcactcactccaggtctcaggtcc

SEQ ID NO: 22789 - DNA, 201 bp, Homo sapiens
cctgaagatgaggatctattacctgggcctggagaggaggagaatcctcttttcaccaggtggtctctgggcacaaactatcaaaacttctctcgtgacarccataatgtgtagttcagtgggctgtcttttgtctccttttaagggtaccctccttggaaaccaggacctcgtaccctgcacagcccagtgttggaagat

SEQ ID NO: 22790 - DNA, 201 bp, Homo sapiens
gaagatgaggccacccgctatgtggctccaagtgctcgggtggaggagatgaagggatcagtacagtagtcgggggaaattctctcaatcccaccctgcaytaccctcacctctgcagctttttgcctatttccaactctcagctccttccacccccaccccagcccagccctcagggctccctctctccagccctccctc

SEQ ID NO: 22791 - DNA, 201 bp, Homo sapiens
gagcttttgctctagttcaggaggtgtgtagggagcctcactagtccaacagagcttggtaccagtgtcatatgccaggaaccaaggttataagggatacmatgtccccagacctaccagagaaggcaaactcatacagcttgcaggaccagacaaggacaagaaacaagttcaaaagagggaaagggaaactacagacgt

SEQ ID NO: 22792 - DNA, 201 bp, Homo sapiens
cttcttctgccttctcaacatagggcttcaacatgtggattttggtggcgtaggaacacaattcctcttgtaacagtctggatcgtctttgacaatggatrttctaaaaaataaaagagagtaatagacagtacaaccctttggctgaaatctttctcttggttttctaaaattttggtcttgcaatagaaaaaacaagaa

SEQ ID NO: 22793 - DNA, 201 bp, Homo sapiens
cctggcaccccagggctcataaacatgctgctcccaaaactccaaggcaagtatggaagggcagaacagcttctgggacagtgggaagatgaggccacccsctatgtggctccaagtgctcgggtggaggagatgaagggatcagtacagtagtcgggggaaattctctcaatcccaccctgcattaccctcacctctgca

SEQ ID NO: 22794 - DNA, 201 bp, Homo sapiens
gaggagcactgagctgcaggtggagggcagaaccacagtgtttagggcctgcctttgtgtgcaggtgtctctacaggtgaggtgggactggggactgaggragagaaggactgtgcgtgtgacccagcccagtcctggaaggacatggagccagggccagagcctctctttggggagtcctcctgctgtcagagctggcca

SEQ ID NO: 22795 - DNA, 201 bp, Homo sapiens
tggattttggtggcgtaggaacacaattcctcttgtaacagtctggatcgtctttgacaatggatgttctaaaaaataaaagagagtaatagacagtacawccctttggctgaaatctttctcttggttttctaaaattttggtcttgcaatagaaaaaacaagaaagagaaccaaagtttagttcttcccggaaggtgag

SEQ ID NO: 22796 - DNA, 201 bp, Homo sapiens
tgatcaaaaccggggccatccactcccttctgagccacctctgcctggggggcccgtggctgtgtcctccagtcacaacagaacactccttcagaacactygcaggaagacaacatcttgtcattggctcacacatgcacggtgcatgcacagagctttggttctagttcaggaggtgtgtggggaggaggctcactagtc

SEQ ID NO: 22797 - DNA, 201 bp, Homo sapiens
ccaccgacgccacaaggtagagggcgaggacagcgaggtcggccggattccgcacccctgcctccaaccaccgcccatgggcggggaggagagactaccgrccgcaagcagaacgcagaacgagaagagcggtcccgttagccatgaatgtgtccctcatctgtaccgcctccggccccgcccgggagaacgcgacgtcac

SEQ ID NO: 22798 - DNA, 201 bp, Homo sapiens
aacttagtggctgaaaacagcacccatttatttgtctacatttccttcatcagaaatccaggcctaatgtgatagactctttgttcagagtttcgcaaagytgtatcctcatcttaagattggggttctcccccaagcttgtgtagagtttgttggcagaattcggtttctggcaattgtaggattaaggtccctgtttcc

SEQ ID NO: 22799 - DNA, 201 bp, Homo sapiens
tgatctgtcactggttgggaacagcccattggaagcaggacctcagcaccaatgctactgaggatgtcagagcacaggagcagggccttgggagattaccsagcattactcaaaccttctgccctgacgggtctgggtccttggaaatcaagctgtctcaggctgaattgctggatgattctgctcacacttacaatgagg

SEQ ID NO: 22800 - DNA, 201 bp, Homo sapiens
tcctgctttcgtgtcactggtgtgatctgtcactggttgggaacagcccattggaagcaggacctcagcaccaatgctactgaggatgtcagagcacaggwgcagggccttgggagattacccagcattactcaaaccttctgccctgacgggtctgggtccttggaaatcaagctgtctcaggctgaattgctggatgat

SEQ ID NO: 22801 - DNA, 201 bp, Homo sapiens
ctaaacccctccctgtggtgctgtgcttcagtggtcatgctccttgtccactttcatgctcctcctgtactcctggttcctctttgaatttcgtagtagawaatggtagaagaaatagtgaaagtcttaaagtctttgatcttaagtgcagaaaagaaaatggtgacatatgctacctaaaagggaagggccccctatcct

SEQ ID NO: 22802 - DNA, 201 bp, Homo sapiens; identical to SEQ ID NO: 4284

SEQ ID NO: 22803 - DNA, 201 bp, Homo sapiens
ccagaggcctaaacccctccctgtggtgctgtgcttcagtggtcatgctccttgtccactttcatgctcctcctgtactcctggttcctctttgaatttcrtagtagataatggtagaagaaatagtgaaagtcttaaagtctttgatcttaagtgcagaaaagaaaatggtgacatatgctacctaaaagggaagggccc

SEQ ID NO: 22804 - DNA, 201 bp, Homo sapiens
gcttcttgtagaaggctggatattatccagagctacccgcagtcatccagaggcctaaacccctccctgtggtgctgtgcttcagtggtcatgctccttgyccactttcatgctcctcctgtactcctggttcctctttgaatttcgtagtagataatggtagaagaaatagtgaaagtcttaaagtctttgatcttaagt

SEQ ID NO: 22805 - DNA, 201 bp, Homo sapiens
cttagcagaccatgaaagggagtctccctttcttggaggagtcggggaacactctgctccaccagcttcttgtagaaggctggatattatccagagctacycgcagtcatccagaggcctaaacccctccctgtggtgctgtgcttcagtggtcatgctccttgtccactttcatgctcctcctgtactcctggttcctct

SEQ ID NO: 22806 - DNA, 201 bp, Homo sapiens
ccgcttgagggatccttggtcaagtggcaatgccaatgtctgggaaggcacctgttacttagcagaccatgaaagggagtctccctttcttggaggagtcrgggaacactctgctccaccagcttcttgtagaaggctggatattatccagagctacccgcagtcatccagaggcctaaacccctccctgtggtgctgtgc

SEQ ID NO: 22807 - DNA, 201 bp, Homo sapiens
gatcatgaaaaattatcaatcattattataaacattattaatcattagcttttaatattactctttgttgcattactaagataacctaggaataactggcrggcatagggtcaggtgctgaagggacattgtgagaagtgacctagaaggcaagagatgagccttctgtcacgcccgcataagggccgcttgagggatcct

SEQ ID NO: 22808 - DNA, 201 bp, Homo sapiens
agtgtctttagagtactgatgagaagactcttggctgagtggatcctggatatcttaagaacggtggctagctgccagagacacatacctgtgatgcgagkgttatctttttccattttgtgttgctataaagaaatgtctgagactgactaatttatataaacgaggttcatgtggctcaagattctgatgtctggaaat

SEQ ID NO: 22809 - DNA, 201 bp, Homo sapiens
ccctaaccactggacccataacacttcactgcagtggccactcttgaagctctgtaaggttaatcttcaccttctgtagtgcacacgttttgccaaagaaytcagcgtactttcctcctcttactcatccatcccaatctatgtgatattgccaatgaaatgaagagatttagtattctgtgagatgtctgatttgtccag

SEQ ID NO: 22810 - DNA, 201 bp, Homo sapiens
tgcatcaaggccaattatgcatgtggagaatggggagataaccaggactgggtttatgaacccagtggtcccacagtgggccataatgtgtccaggtttayttcctggcctccttaagccccactgtagattctgaatctgaagcttggctgaagtctaggaattgagactgggatcatgactttgtatttgatcaaacac

SEQ ID NO: 22811 - DNA, 201 bp, Homo sapiens
cctccacctcacagcagcgaccacagctccagtgatcacagctccaaagagaaccaggccagcaatgatgcccacgatggggatggtgggctgggaagacrgctctgggaaaagaggggaaggtgaggggccctgaccctgctaaaggtcagagaggctcctgctttccctaaaagacatgacacccccgtctccctcctt

SEQ ID NO: 22812 - DNA, 201 bp, Homo sapiens
tagagaataatggaaatgtaagagggcttcattagttatccattgctgtgtaacaaactactcccaaatttagtgacttgggatcactaaatgagggatcdtgttcccgtcattccctcagagattttatcccttaattgcgtcttcccgtcattgcctcagagattttatcccttaattgtgtcagagagcagtgtggaa

SEQ ID NO: 22813 - DNA, 201 bp, Homo sapiens
gaatcaactgcattggaaccctgaaaaatcatcaaaggtttattgcaacctagcaagtccagaaaaatcaactggaactcaggagcagagctttgtggcamcatatcttacccttggcccattcctccctgttcaagtcagtagtgatcttgaagacagcagcctggttccttagtgtgggctccaatgccagtgggagcc

SEQ ID NO: 22814 - DNA, 201 bp, Homo sapiens
atcaaaataggagaaaataaaacagatgtagttaacctctagagaataatggaaatgtaagagggcttcattagttatccattgctgtgtaacaaactackcccaaatttagtgacttgggatcactaaatgagggatcgtgttcccgtcattccctcagagattttatcccttaattgcgtcttcccgtcattgcctcag

SEQ ID NO: 22815 - DNA, 201 bp, Homo sapiens
aataatggggggaaggtgaatgaccaggagcttgttgttgaggccatcatagaatcagcctagcaagggctggatcttctttttgtgttcacttgggacayagttgcaaattgaagttcaagtaaagtaatcattgtgaacggtaataaaatacatccttttcagccacgaaaattctccttaccttttaaaactaagtta

SEQ ID NO: 22816 - DNA, 201 bp, Homo sapiens
ttatttcctggcagtacataaccaattaccacaaacttagtggctgaaaacagcacccatttatttgtctacatttccttcatcagaaatccaggcctaaygtgatagactctttgttcagagtttcgcaaagctgtatcctcatcttaagattggggttctcccccaagcttgtgtagagtttgttggcagaattcggtt

SEQ ID NO: 22817 - DNA, 201 bp, Homo sapiens
ctccggatcccgcactcacccgcccaggtctcggtcagggccagggcccccaagagcagcaggaggagggttcgggacgccatgaccccatcctcggcgtmtggggagaatctgagtcccaatgggttcgcggggacttctggaacagggaccccagcgacgccgattggcttcgctagaaacccgacaccaaatgggggt

SEQ ID NO: 22818 - DNA, 201 bp, Homo sapiens
tcagattgtttcatttcttcacttaaaagcctctaatggctccatcttactctcaagaagcctctagaatggaaggcacaagcacaggggctttgggttgytttgatcaaagttgtatctacagaatataaaagtatatctgccacatagtaggcactaagttaatttttgttgaatgaatgaatgaaatataattgtgtt

SEQ ID NO: 22819 - DNA, 201 bp, Homo sapiens
tgtcactactgaattgtgtccctagctctgtcccttgcctgctgcccatgactgttctccccacaaaggtcagcaatcctgctaatgtgagtcagattgtktcatttcttcacttaaaagcctctaatggctccatcttactctcaagaagcctctagaatggaaggcacaagcacaggggctttgggttgttttgatcaa

SEQ ID NO: 22820 - DNA, 201 bp, Homo sapiens
ctccagcccttctctctgtccctgtcatccttcaggccctcctctccccttagtctctactactctgtcactactgaattgtgtccctagctctgtccctygcctgctgcccatgactgttctccccacaaaggtcagcaatcctgctaatgtgagtcagattgtttcatttcttcacttaaaagcctctaatggctccat

SEQ ID NO: 22821 - DNA, 201 bp, Homo sapiens
atgatcaaaaccggggccatccactcccttctgagccacctctgcctggggggcccgtggctgtgtcctccagtcacaacagaacactccttcagaacacycgcaggaagacaacatcttgtcattggctcacacatgcacggtgcatgcacagagctttggttctagttcaggaggtgtgtggggaggaggctcactagt

SEQ ID NO: 22822 - DNA, 201 bp, Homo sapiens
tgggagatgagggaggaggagcaggggtggctctcacctgggctctgtccgtggaggtgaggacaatgaggtggttgggtctcagtgctgtgtggaacttkcttttgacctccttatgagtggatggtctgtctgagatagaacgggtcttagaggatttactcattaccctgagagagggggcgtgttcattccaggttt

SEQ ID NO: 22823 - DNA, 201 bp, Homo sapiens
aaaacaagaaagagaaccaaagtttagttcttcccggaaggtgaggcctcctccctaagtctgtgtaatcccagacactaagacatggtgctgtgcagttvtccaaagtcctactcactccagtgattctgtttctgtctttttaactgagcagaagagtctctttcaggagagcaacttcttctgatgctttatgggctt

SEQ ID NO: 22824 - DNA, 201 bp, Homo sapiens
aacttatggaatgaaaaagatcttaataaaaaggaaaatatttgccaaatttttatcatgctcataatttttgtacctttttaaatgccccatattgtgtkgtttattttttaaattttttaaaattggtacataatatttgtacatatttatgggatacatgtgacattttgatacatgcatagaatgtgtgtatcagtc

SEQ ID NO: 22825 - DNA, 201 bp, Homo sapiens
ccacgcccagccaaatccactcttatagctattttgaaatatacatttttgttaactttagtcagtctgctgtgctatcaaacattagaacttattttctbtatataattggacatttgcatccattaacctgcatctctatattttcccacccctacattcttcccagtttctgggaactgtcattctactctctctacc

SEQ ID NO: 22826 - DNA, 201 bp, Homo sapiens
gtgatatggcaagggaggtaggttaccctgggaaaggcaacaagatgcaaaggtgatccccagtgatggacagaaggagacaaggtttactggatgtgccrtagaccacaggcaatctaaggagagttaagcaaggccatggaggagtccttgagctacagttggccatcagaggagtccctggtctcccaggaatgtcct

SEQ ID NO: 22827 - DNA, 201 bp, Homo sapiens
tgatgagctgagtcctggtggactcggcgcagacaatggtgctgaggctgtgggagatgagggaggaggagcaggggtggctctcacctgggctctgtccrtggaggtgaggacaatgaggtggttgggtctcagtgctgtgtggaactttcttttgacctccttatgagtggatggtctgtctgagatagaacgggtctt

SEQ ID NO: 22828 - DNA, 201 bp, Homo sapiens
ggatggaagtagctaaatgtagtcaacttgttacttagtggctagttagtcacctaaagaaatagtgccccactggggcacatcatgggcctcaattgctratgagttggacattcagaggtgtcggcagctggatctgccttggtaggggggagtcagtgctgttggccccatacgtagcctcatgcctgccactgtggt

SEQ ID NO: 22829 - DNA, 201 bp, Homo sapiens
aaatacaatgaggaaagagccctgggaagagggcaagagcttgaaagatctgaaaatttgtctcttgataccacaaggaccctggtatgcagggactgccrtaggtgacatccaagtccctgtgatcacaggtcatggtgggacaaggttctactgaagggccaagtgtgggtggaggattactcaggtgccgaggcaaga

SEQ ID NO: 22830 - DNA, 201 bp, Homo sapiens
aaaaagattttacacattggaataagtaagagatcactagtgggcagatgaaaatgattttatagtccaaatgctccaaaaagcaagttccatcatgggabtaaagttatagcattttattaggggacacacctgtcaggtgatatggcaagggaggtaggttaccctgggaaaggcaacaagatgcaaaggtgatcccca

SEQ ID NO: 22831 - DNA, 201 bp, Homo sapiens
gattaaacaataaacattgaggaactcaaaagcataatacaaataccagcaaaatggagccaatgcaggtagaagttgaataaacaaaaagattttacacvttggaataagtaagagatcactagtgggcagatgaaaatgattttatagtccaaatgctccaaaaagcaagttccatcatgggattaaagttatagcatt

SEQ ID NO: 22832 - DNA, 201 bp, Homo sapiens
gcagaaaagatggaaaatacaatgaggaaagagccctgggaagagggcaagagcttgaaagatctgaaaatttgtctcttgataccacaaggaccctggtrtgcagggactgccataggtgacatccaagtccctgtgatcacaggtcatggtgggacaaggttctactgaagggccaagtgtgggtggaggattactcag

SEQ ID NO: 22833 - DNA, 201 bp, Homo sapiens
tggaaatgtaagagggcttcattagttatccattgctgtgtaacaaactacccccaaatttagtgattaaacaataaacattgaggaactcaaaagcatamtacaaataccagcaaaatggagccaatgcaggtagaagttgaataaacaaaaagattttacacattggaataagtaagagatcactagtgggcagatgaa

SEQ ID NO: 22834 - DNA, 201 bp, Homo sapiens
tgcagaaaagatggaaaatacaatgaggaaagagccctgggaagagggcaagagcttgaaagatctgaaaatttgtctcttgataccacaaggaccctggwatgcagggactgccataggtgacatccaagtccctgtgatcacaggtcatggtgggacaaggttctactgaagggccaagtgtgggtggaggattactca

SEQ ID NO: 22835 - DNA, 201 bp, Homo sapiens
cctcttggcaaatttcagaatctggttcctttaaaaagattgcagaaaagatggaaaatacaatgaggaaagagccctgggaagagggcaagagcttgaamgatctgaaaatttgtctcttgataccacaaggaccctggtatgcagggactgccataggtgacatccaagtccctgtgatcacaggtcatggtgggacaa

SEQ ID NO: 22836 - DNA, 201 bp, Homo sapiens
aactatgggaccctgcctcttggcaaatttcagaatctggttcctttaaaaagattgcagaaaagatggaaaatacaatgaggaaagagccctgggaagasggcaagagcttgaaagatctgaaaatttgtctcttgataccacaaggaccctggtatgcagggactgccataggtgacatccaagtccctgtgatcacag

SEQ ID NO: 22837 - DNA, 201 bp, Homo sapiens
agatgagccttctgtcacgcccgcataagggccgcttgagggatccttggtcaagtggcaatgccaatgtctgggaaggcacctgttacttagcagaccaygaaagggagtctccctttcttggaggagtcggggaacactctgctccaccagcttcttgtagaaggctggatattatccagagctacccgcagtcatcca

SEQ ID NO: 22838 - DNA, 201 bp, Homo sapiens
tattggagccagcactaggattactacaactcagggcaggaagaagagtaggagtgcagaagaggagttccaacagaaagttacctatgatgagaaactaygggaccctgcctcttggcaaatttcagaatctggttcctttaaaaagattgcagaaaagatggaaaatacaatgaggaaagagccctgggaagagggcaa

SEQ ID NO: 22839 - DNA, 201 bp, Homo sapiens
cctgagtgcatgagatagaatagagaccagtttgctttttgtttattaactatagtgggtagcataaccttggtaacccctgaatgatcaggaatctaatmggtaaaaaatgtgactttggcctgttggtatataaatgcatctaaaagcattacaacaggactcacaaagctcttaagtttcactttcccagacagtgta

SEQ ID NO: 22840 - DNA, 201 bp, Homo sapiens
ttcatcccggaatccctgtccctgaactggactccctgcctcccactccttgcctgtcctcctgtactcttctagaagaaaaatcaccccagggagcttgktgccagagagtgagctcgccctgggattgtaggtgtaaagacagggttttttttcccccttaaatctggaaaagttgtgcctgagtgcatgagatagaat

SEQ ID NO: 22841 - DNA, 201 bp, Homo sapiens
ttggtcaggctggtctcgaactcctgatctcgtgatccacaggcctcgacttcccaaagtgctaggatcacagaagtgagccaccgtgcccggccagctghggctttgttttactacgagtagttatcgcaaaggatgcttgtgatgaactttggcattttcttttctctttcatttccaaataatcaatcaggaatggca

SEQ ID NO: 22842 - DNA, 201 bp, Homo sapiens
gtgggagggtgctgttcattcactgttgctgctgaagttttactttttattattatacgacaattttgttaattcccattgatgtatatgtgattgtttcyagtttttgccataaacattggtgtacatgtctcctggacacatagccaagaatgtccccagggggtatgatcaggaggcagatggtgggattatatgatg

SEQ ID NO: 22843 - DNA, 201 bp, Homo sapiens
aaaaggaaaatatttgccaaatttttatcatgctcataatttttgtacctttttaaatgccccatattgtgttgtttattttttaaattttttaaaattgrtacataatatttgtacatatttatgggatacatgtgacattttgatacatgcatagaatgtgtgtatcagtcaagatatttagggtatccatgacctcaa

SEQ ID NO: 22844 - DNA, 201 bp, Homo sapiens
cacgaatctaatttgtaaaagagatgatttttggccccattatatataaatatgtctaaacgcattgcaattagactcacaaagtgaagttttactttccyagactgtgtatctgtgactctggtctgttgtatttttacagtatctttatttcatagctctgagtttgtgtgtgcgagtccaggacatctcaatacaaag

SEQ ID NO: 22845 - DNA, 201 bp, Homo sapiens
tgcgttactatatgttgcaaccgggagccagtacagactttattcacctcacagttgcaagtgttcaatgcagtcacaatgcccctcagcagtgctcatgygctgcctgtttttaggaagtattcacgtctaagtggtgtgtatatcttataggaacacttagtatttttaaaacctgattaattaaaaaaaattagtttc

SEQ ID NO: 22846 - DNA, 201 bp, Homo sapiens
gatcaatcccccggggatttgggcctgaactgaaaatggaatcgggtataggcacctggggttcttgtgtcgagggtctccacgagtcccgcagcctcggsgtgggtctccgattgtgctacagtgggtagcacaatcttggtagcccctgaatggtcacgaatctaatttgtaaaagagatgatttttggccccattata

SEQ ID NO: 22847 - DNA, 201 bp, Homo sapiens
tatctgtgactcccgcttgttttttacatttaccttcattccacagccctgagttactgggtgagtccaagacatctcctcaatataaagtagcacactgygttactatatgttgcaaccgggagccagtacagactttattcacctcacagttgcaagtgttcaatgcagtcacaatgcccctcagcagtgctcatgtgc

SEQ ID NO: 22848 - DNA, 201 bp, Homo sapiens
ctcctctgccccgatcaatcccccggggatttgggcctgaactgaaaatggaatcgggtataggcacctggggttcttgtgtcgagggtctccacgagtcycgcagcctcggcgtgggtctccgattgtgctacagtgggtagcacaatcttggtagcccctgaatggtcacgaatctaatttgtaaaagagatgattttt

SEQ ID NO: 22849 - DNA, 201 bp, Homo sapiens
atcggtaaaaaatgtaactttggccccttgatatataaatgtgtctgaaagcattacaacaggactcacaaagctactaagtttgactttcgcagacaatrtatctgtgactcccgcttgttttttacatttaccttcattccacagccctgagttactgggtgagtccaagacatctcctcaatataaagtagcacactg

SEQ ID NO: 22850 - DNA, 201 bp, Homo sapiens
tcattcttaaggcctttgctgagccactccgcccaccttcccggcaggtaggttttgagcagctctgcatgttcctcctccaaaacatctgagccgccttdtccgctgcggtccaagagagcagttcctggtttaggacgaggtaactggcgccatcgtagggtatgttcatccccgcgcgaagaggctccggtccgggtc

SEQ ID NO: 22851 - DNA, 201 bp, Homo sapiens
cattgcagcctctccttctcattcttaaggcctttgctgagccactccgcccaccttcccggcaggtaggttttgagcagctctgcatgttcctcctccaraacatctgagccgccttttccgctgcggtccaagagagcagttcctggtttaggacgaggtaactggcgccatcgtagggtatgttcatccccgcgcgaa

SEQ ID NO: 22852 - DNA, 201 bp, Homo sapiens
atgcctgcaatcccagcactttgggaggctgaggcaggcagatcatgaggtcaggagatagagactttcctggctaacatggtgaaaccccgtctctactraaaatacaaaaaaattagctgggcgtggtggcaggtgcctgtagtcccagctacttgggaagctgaatcaggagaatggcatgaacccaggaggcagagc

SEQ ID NO: 22853 - DNA, 201 bp, Homo sapiens
gagaaagggaaggaagaggccaggtgtggtggctcatgcctgcaatcccagcactttgggaggctgaggcaggcagatcatgaggtcaggagatagagacyttcctggctaacatggtgaaaccccgtctctactaaaaatacaaaaaaattagctgggcgtggtggcaggtgcctgtagtcccagctacttgggaagctg

SEQ ID NO: 22854 - DNA, 201 bp, Homo sapiens
ctcaggacaagagggagagggatattttagcgttggtcccattttcctccccttcttttggaaggtggctcagggatatctgcaggagatcagggaggcgmcccgtggcctctggtacctgcgcattgcagcctctccttctcattcttaaggcctttgctgagccactccgcccaccttcccggcaggtaggttttgagc

SEQ ID NO: 22855 - DNA, 201 bp, Homo sapiens
cccaccaccacgcccggctaatttttttttttttttttgtatttttagtagagacggggtttcaccatgttagccaggatggtctcgatctcctgacctcrtgatccaccctcctcggcctcccaaagtgctgggatcacaggcatgagccaccacgcccagccaaatccactcttatagctattttgaaatatacatttt

SEQ ID NO: 22856 - DNA, 201 bp, Homo sapiens
aaggaaggagaaagggaaggaagaggccaggtgtggtggctcatgcctgcaatcccagcactttgggaggctgaggcaggcagatcatgaggtcaggagayagagactttcctggctaacatggtgaaaccccgtctctactaaaaatacaaaaaaattagctgggcgtggtggcaggtgcctgtagtcccagctacttgg

SEQ ID NO: 22857 - DNA, 201 bp, Homo sapiens
tgagtggggctgcaagaataactccactaggtagcatcctctcttttacctgatggatcaggacgatgctgttacgacgatacatacaattcttctgaagrggagaggatgctggaataaagactacacttcacctcaaatttattttttcatatgttatgccatagtaccaggaatagggatgtaaataaaagtgccaga

SEQ ID NO: 22858 - DNA, 201 bp, Homo sapiens
aggggaaggggaaggaaagggagcaagaaggagggaaggtgataggttgaatggaaatagagaagaaagagagggagggagggttagaaggaaggagaaasggaaggaagaggccaggtgtggtggctcatgcctgcaatcccagcactttgggaggctgaggcaggcagatcatgaggtcaggagatagagactttcctg

SEQ ID NO: 22859 - DNA, 201 bp, Homo sapiens
ctcgctgtcaacatgagtggggctgcaagaataactccactaggtagcatcctctcttttacctgatggatcaggacgatgctgttacgacgatacatacrattcttctgaaggggagaggatgctggaataaagactacacttcacctcaaatttattttttcatatgttatgccatagtaccaggaatagggatgtaaa

SEQ ID NO: 22860 - DNA, 201 bp, Homo sapiens
agaaggaaggggaaggggaaggaaagggagcaagaaggagggaaggtgataggttgaatggaaatagagaagaaagagagggagggagggttagaaggaargagaaagggaaggaagaggccaggtgtggtggctcatgcctgcaatcccagcactttgggaggctgaggcaggcagatcatgaggtcaggagatagagac

SEQ ID NO: 22861 - DNA, 201 bp, Homo sapiens
ttgctcaatttctgtggattcacttcacaaattttattataaggtagttctagctagaagaaaaaatagagaattataagaaatctttgtgaagctgccayccaggtttgtcaatttgtgacattttaatattattggctgtatgtagtatacatagaaaataacagaaacacgtgtagatagccctgattttccacagtt

SEQ ID NO: 22862 - DNA, 201 bp, Homo sapiens
attgggctatgctcaaccaggggtagatgtcaatgcttcaagggctatacaaggaccagaaaagaagaggttgcaccaatttggactgccgagtcacactwctttacacaagaaaacacactttacagcctcaaacggccaacaatgcagagggacatgtcctcctcaggggaaaatttgatagaaaattgaaatggtcaa

SEQ ID NO: 22863 - DNA, 201 bp, Homo sapiens
atttttctcttcaggaaagataaccctaggcttatgggtccaattttccaaccacatatgaatctaaactagactctgctttataaattgatgagtttctmttggagccagcactaggattactacaactcagggcaggaagaagagtaggagtgcagaagaggagttccaacagaaagttacctatgatgagaaactatg

SEQ ID NO: 22864 - DNA, 201 bp, Homo sapiens
tcaccggtttcctattgatgtacatgtggccgattccagtttttgccataaatattagtgtgcatgtctcctgtgcacataggcaagaaagccccaaagcycccagagtggatgattaggaatgggttggttgcatgatacattgtatggactttaaccatactagataatgataatatgatttccaaagtaattgtggct

SEQ ID NO: 22865 - DNA, 201 bp, Homo sapiens
acaacatcatctcacactgacatcagtgccactggagcttttctcaccagggctgcttgtgtgtcctccctccctccctccctccccccacaccaactctmctgcacactgcagcacacaaccatatttttctcttcaggaaagataaccctaggcttatgggtccaattttccaaccacatatgaatctaaactagactc

SEQ ID NO: 22866 - DNA, 201 bp, Homo sapiens
atgatacacattatgtgtaggagttatctgtggtgtgggaggctgtcattcattcatttttacgctgaaggcttacatatcgttttaccacaatttcaccrgtttcctattgatgtacatgtggccgattccagtttttgccataaatattagtgtgcatgtctcctgtgcacataggcaagaaagccccaaagcccccag

SEQ ID NO: 22867 - DNA, 201 bp, Homo sapiens
ctacagaacaacatcatctcacactgacatcagtgccactggagcttttctcaccagggctgcttgtgtgtcctccctccctccctccctccccccacacyaactctcctgcacactgcagcacacaaccatatttttctcttcaggaaagataaccctaggcttatgggtccaattttccaaccacatatgaatctaaac

SEQ ID NO: 22868 - DNA, 201 bp, Homo sapiens
tagaggcaatatctttattaatgtagcctcaggacaaatgctttatttttgtggcagctacagaacaacatcatctcacactgacatcagtgccactggakcttttctcaccagggctgcttgtgtgtcctccctccctccctccctccccccacaccaactctcctgcacactgcagcacacaaccatatttttctcttc

SEQ ID NO: 22869 - DNA, 201 bp, Homo sapiens
ttctagaggcaatatctttattaatgtagcctcaggacaaatgctttatttttgtggcagctacagaacaacatcatctcacactgacatcagtgccactrgagcttttctcaccagggctgcttgtgtgtcctccctccctccctccctccccccacaccaactctcctgcacactgcagcacacaaccatatttttctc

SEQ ID NO: 22870 - DNA, 201 bp, Homo sapiens
gggcctctcccgggtaaagggtctccaggttccgctgcctcggcgtggatctcggacccagagactcggggagacccgggcggtccgtgggggatgtagasgggtagtgatctgcgcccccggccggtgtcactcacaggcctcactctggttgtagtagccgctcagggtccgcaggttcactcggtaaaactgtgcttt

SEQ ID NO: 22871 - DNA, 201 bp, Homo sapiens
attctagaggcaatatctttattaatgtagcctcaggacaaatgctttatttttgtggcagctacagaacaacatcatctcacactgacatcagtgccacyggagcttttctcaccagggctgcttgtgtgtcctccctccctccctccctccccccacaccaactctcctgcacactgcagcacacaaccatatttttct

SEQ ID NO: 22872 - DNA, 201 bp, Homo sapiens; identical to SEQ ID NO: 4333

SEQ ID NO: 22873 - DNA, 201 bp, Homo sapiens
tgtcttggctgcagaattatagcaggcatttttatttagattctgtcaataactttctgttgtttacttgtttctcatataccgtggcattgtacttttgrcatacagattcagaaaatgcttacttatagcacaatcacatagggttattttatatgttaggaaattttcataataaaaaggaaaaaatggaggaaggga

SEQ ID NO: 22874 - DNA, 201 bp, Homo sapiens
agccgcgggttggacaagcttgcatctagaacatatgcaccacaaggcccgaaatttttctgtttttactttaatgatgctttctaaatgcaaaaacagtyatatacctagcagaaacaaatgtcagttgaaggaatgatcatagagaaccactctattctagaggcaatatctttattaatgtagcctcaggacaaatgc

SEQ ID NO: 22875 - DNA, 201 bp, Homo sapiens
acagataagcaaaaaagtcctcacattcaaaattgtcctgggccacatgcagcccacgagccgcgggttggacaagcttgcatctagaacatatgcaccayaaggcccgaaatttttctgtttttactttaatgatgctttctaaatgcaaaaacagttatatacctagcagaaacaaatgtcagttgaaggaatgatcat

SEQ ID NO: 22876 - DNA, 201 bp, Homo sapiens
acagcaagtatagctaatgttattaaaatgcaagggattaaaagatatgtagataatatccatggaataatggaaacttaagaaagccttaatagttatcwagtgctgtgtcacaaactacctcaaaatttagtagcttaatagaacaaatatctgttaactcaaagagatactacacacacaagtaaaatagattctgtg

SEQ ID NO: 22877 - DNA, 201 bp, Homo sapiens
tctgctccatgtccatggctcagccaaataagttggtagtcaacaaattgatcttatcttttggggtcattctccagcaagtgcagaacagtaaaaaaatktagtcacctgaggtgcatatcttggcttcctggccagttttcccaaggcctccactgccaccctgcaccctgggtgccctccacactctccaagtgtcca

SEQ ID NO: 22878 - DNA, 201 bp, Homo sapiens
tgcaccacagataagcaaaaaagtcctcacattcaaaattgtcctgggccacatgcagcccacgagccgcgggttggacaagcttgcatctagaacatatrcaccacaaggcccgaaatttttctgtttttactttaatgatgctttctaaatgcaaaaacagttatatacctagcagaaacaaatgtcagttgaaggaat

SEQ ID NO: 22879 - DNA, 201 bp, Homo sapiens
cgcgctgcagcatctccttcccgttctccaggtatctgtggagccactccacgcacgtgccctccaggtaggctctcctttgttcagccacattggccgcytcacacttgcgcttggagatctgagccgcagtgtccgctgcggtccaggagcgcaggtcctcgttcagggcgaggtaatccttgccatcgtaggcatact

SEQ ID NO: 22880 - DNA, 201 bp, Homo sapiens
ggggtttcaccatgttagccaggatggtctcgatctcctgacctcatgatccaccctcctcggcctcccaaagtgctgggatcacaggcatgagccaccaygcccagccaaatccactcttatagctattttgaaatatacatttttgttaactttagtcagtctgctgtgctatcaaacattagaacttattttctctat

SEQ ID NO: 22881 - DNA, 201 bp, Homo sapiens
tgcactcactccgggactcaggtgcaccacagataagcaaaaaagtcctcacattcaaaattgtcctgggccacatgcagcccacgagccgcgggttggayaagcttgcatctagaacatatgcaccacaaggcccgaaatttttctgtttttactttaatgatgctttctaaatgcaaaaacagttatatacctagcaga

SEQ ID NO: 22882 - DNA, 201 bp, Homo sapiens
ggtataggatttagaaacccaggaggactcttctgcctcaggacaagagggagagggatattttagcgttggtcccattttcctccccttcttttggaagrtggctcagggatatctgcaggagatcagggaggcgacccgtggcctctggtacctgcgcattgcagcctctccttctcattcttaaggcctttgctgagc

SEQ ID NO: 22883 - DNA, 201 bp, Homo sapiens
tcatgctgcacatggcaggtgtatctctgctcctctccagaaggcaccaccacagccgcccacttctggaaggttccatcccctgcaggcctggtctccaygagctccgtgtgtgggtctggtcctccccatcccgctgccaggtcagtgtgatctccgcagggtagaagcccagggcccagcacctcagggtggcctcat

SEQ ID NO: 22884 - DNA, 201 bp, Homo sapiens
agggaggtgggtgcactcactccgggactcaggtgcaccacagataagcaaaaaagtcctcacattcaaaattgtcctgggccacatgcagcccacgagcygcgggttggacaagcttgcatctagaacatatgcaccacaaggcccgaaatttttctgtttttactttaatgatgctttctaaatgcaaaaacagttata

SEQ ID NO: 22885 - DNA, 201 bp, Homo sapiens
tccctccttaccccatctcagggtgaggggctctggcagaccctcatgctgcacatggcaggtgtatctctgctcctctccagaaggcaccaccacagccrcccacttctggaaggttccatcccctgcaggcctggtctccacgagctccgtgtgtgggtctggtcctccccatcccgctgccaggtcagtgtgatctcc

SEQ ID NO: 22886 - DNA, 201 bp, Homo sapiens
ctaaagcattcactcctgaccctgagggaggtgggtgcactcactccgggactcaggtgcaccacagataagcaaaaaagtcctcacattcaaaattgtcytgggccacatgcagcccacgagccgcgggttggacaagcttgcatctagaacatatgcaccacaaggcccgaaatttttctgtttttactttaatgatgc

SEQ ID NO: 22887 - DNA, 201 bp, Homo sapiens
gaccctgaccctgctaaagctctccagagaggctccggctttccctaagggacatgacacccccatctccctccttaccccatctcagggtgaggggctckggcagaccctcatgctgcacatggcaggtgtatctctgctcctctccagaaggcaccaccacagccgcccacttctggaaggttccatcccctgcaggcc

SEQ ID NO: 22888 - DNA, 201 bp, Homo sapiens
gagggttcctaaagcattcactcctgaccctgagggaggtgggtgcactcactccgggactcaggtgcaccacagataagcaaaaaagtcctcacattcaraattgtcctgggccacatgcagcccacgagccgcgggttggacaagcttgcatctagaacatatgcaccacaaggcccgaaatttttctgtttttacttt

SEQ ID NO: 22889 - DNA, 201 bp, Homo sapiens
cccacgatggggatggtgggctgggaagatggctctgggaaaaggggggaaggtgagggaccctgaccctgctaaagctctccagagaggctccggctttycctaagggacatgacacccccatctccctccttaccccatctcagggtgaggggctctggcagaccctcatgctgcacatggcaggtgtatctctgctcc

SEQ ID NO: 22890 - DNA, 201 bp, Homo sapiens
tgtaaatacctttaataacaatgttcttcaataagttaacacagttgagaacatagagtaactagatcaaatagttccaagacttcagtgccataagaatsatgccttgaaaataagtctttgttttgtctaagatgtctcaaatttagtggaagtatgccccaagtgccaattttcttattgacatatcatcttcagaaa

SEQ ID NO: 22891 - DNA, 201 bp, Homo sapiens
aagagctggaatcagacccccacacacattgagtatgaggcagagaacaaggcctgagaggaaaattcctggtgcccaaggctgctggggggtcaaagggkaccgcgtatcagtattccagggattgtcttcccctcctttcccgcagagacttcatccgttaattgtcccagagtgcagggcgggccctcagtcactctc

SEQ ID NO: 22892 - DNA, 201 bp, Homo sapiens
aacgatgcccacgatggggatggtgggctgggaagatggctctgggaaaaggggggaaggtgagggaccctgaccctgctaaagctctccagagaggctcyggctttccctaagggacatgacacccccatctccctccttaccccatctcagggtgaggggctctggcagaccctcatgctgcacatggcaggtgtatct

SEQ ID NO: 22893 - DNA, 201 bp, Homo sapiens
ttagaacttattttctctatataattggacatttgcatccattaacctgcatctctatattttcccacccctacattcttcccagtttctgggaactgtcwttctactctctctacctccctaagattaacctttttggctcgcacatattagtgacaacatgtggtatttgtctttccttgcttggcttatttcacctaa

SEQ ID NO: 22894 - DNA, 201 bp, Homo sapiens
cttaaaggcattcttaagccacaaacaatagcatgagcgatctgtgtcttaagggtgtgttcctgctgcagttaactagcccaacctattcctttaattcrgcccatccctttgcttcctataagggatacttttagttaatttaatacctatagaaacaacactaatgaccggtttgctgttaataaatatgtgggtaaa

SEQ ID NO: 22895 - DNA, 201 bp, Homo sapiens
caagaatgagggaaaggaacacctggcctgcccagggcggaaaaccgcttaaaggcattcttaagccacaaacaatagcatgagcgatctgtgtcttaagrgtgtgttcctgctgcagttaactagcccaacctattcctttaattcggcccatccctttgcttcctataagggatacttttagttaatttaatacctata

SEQ ID NO: 22896 - DNA, 201 bp, Homo sapiens
aaatctggccataaactggccccaagactggccataaacaaaatctctgcagcaccgtaacatgttcataatggccctaatgtccaagctggaaggttgcrggtttacaagaatgagggaaaggaacacctggcctgcccagggcggaaaaccgcttaaaggcattcttaagccacaaacaatagcatgagcgatctgtgt

SEQ ID NO: 22897 - DNA, 201 bp, Homo sapiens
atctgtgaatagagttttatgttttcctttttatctggatgcctttaacttttaattatttgccttattgcaccagctgcaatctccagtacaatgttaartagaagtgttggattggacatccttgcattgatctccatcttaggagaaaagcattcagtctttcttcagcaagcatgattttagttgtgggttttttat

SEQ ID NO: 22898 - DNA, 201 bp, Homo sapiens
acatatatgtatatatgtgtatatgtatgtgtatatatacacacacacatatatatatgtatgtgtgtatatatatatatccccaaaacaaatatcagttkgttttgctggtttttaagcttcctgtacagcaagttcctactgcctttattttcccatgatgcacattatgtgtaggagttatctgtggtgtgggagact

SEQ ID NO: 22899 - DNA, 201 bp, Homo sapiens
atatgtatatatgtgtatatatacacatatatgtatatatgtgtatatgtatgtgtatatatacacacacacatatatatatgtatgtgtgtatatatatrtatccccaaaacaaatatcagtttgttttgctggtttttaagcttcctgtacagcaagttcctactgcctttattttcccatgatgcacattatgtgtag

SEQ ID NO: 22900 - DNA, 201 bp, Homo sapiens
tcggtgggggcccaggccctggtgctcaagatccaaaagctaaagaaacagatgaggaggcactgagagagcctgggaggagagagcctgggaggggacasccaagcttcccagcagtgcccacagcaccctccatgcctggaactaatgtgcaccacccccaggagccccaggatcagaaacaccccagcatctcccagg

SEQ ID NO: 22901 - DNA, 201 bp, Homo sapiens
tggtattttgatagggattgaattgaatctgtaaattgctttgggtagtatgaacattttaacaatattctcccaatttatgtgcatgaaatttatgtgthtcatttttaaaattaatatttaacaatattaattctcccaatttatgtgttttattttttttcttagagacaaggtctcactatgtttcccaggctagtc

SEQ ID NO: 22902 - DNA, 201 bp, Homo sapiens
atatgtatccatatatgtatatatgtgtatatatacacatatatgtatatatgtgtatatgtatgtgtatatatacacacacacatatatatatgtatgtrtgtatatatatatatccccaaaacaaatatcagtttgttttgctggtttttaagcttcctgtacagcaagttcctactgcctttattttcccatgatgca

SEQ ID NO: 22903 - DNA, 201 bp, Homo sapiens
ttacctgagctcttcttcctccacattacagcagcgaccacagctccagtgaccacagctacaagtagaaccaggccagcaacgatgcccacgatggggayggtgggctgggaagatggctctgggaaaaggggggaaggtgagggaccctgaccctgctaaagctctccagagaggctccggctttccctaagggacatg

SEQ ID NO: 22904 - DNA, 201 bp, Homo sapiens
tagtatgaacattttaacaatattctcccaatttatgtgcatgaaatttatgtgtctcatttttaaaattaatatttaacaatattaattctcccaatttrtgtgttttattttttttcttagagacaaggtctcactatgtttcccaggctagtcttgaactcccaggctcaaacaattctcctgtctcatcatcccaaa

SEQ ID NO: 22905 - DNA, 201 bp, Homo sapiens
gaaggtgagcgtccctgaccctcagcccccagcaccgaccctgctgaagttctccagagaggctcctgctttccctaagagacatgaccccccctccactmatctcctgcctaactccatctcagggtgaggggcttgggcaacccctcatgctgcacatggcacatgtatctctgttcctctccagaaggcaccaccaca

SEQ ID NO: 22906 - DNA, 201 bp, Homo sapiens
acactcctcaccccttccttacctgagctcttcttcctccacattacagcagcgaccacagctccagtgaccacagctacaagtagaaccaggccagcaaygatgcccacgatggggatggtgggctgggaagatggctctgggaaaaggggggaaggtgagggaccctgaccctgctaaagctctccagagaggctccgg

SEQ ID NO: 22907 - DNA, 201 bp, Homo sapiens
cttctacctggggcttggaactctcagtgagacaagaaatctcagaccacactcctcaccccttccttacctgagctcttcttcctccacattacagcagygaccacagctccagtgaccacagctacaagtagaaccaggccagcaacgatgcccacgatggggatggtgggctgggaagatggctctgggaaaaggggg

SEQ ID NO: 22908 - DNA, 201 bp, Homo sapiens
agaagggctgatggaattgtcccagcatgtaacagtcatggtgtcccaaggttctttctcttagggatatggatacttcctcagccactggattctgaatrtgaagcttgctcctcaattcttttttttttttttattgatcattcttgggtgtttctcacagagggggatttggcagggtcatgggacaatagtggaggg

SEQ ID NO: 22909 - DNA, 201 bp, Homo sapiens
ttgtaacaggtgctttacaaaagagtaagtgctggcacacagggcccaggctgggtaggcccatgagtgtggatggtgcttcccagtaaccaggcagggcmcttctacctggggcttggaactctcagtgagacaagaaatctcagaccacactcctcaccccttccttacctgagctcttcttcctccacattacagcag

SEQ ID NO: 22910 - DNA, 201 bp, Homo sapiens
atctttttacagagaatcctttttacagagaatggggagataaccaggacaggatttatggacccagtgattccaccgtggggcataatttgtccaggttwattccctggcctctgtaagccccactgtgatagggacataatggtgctgtgggaatctgggcagcaatgttagctcacacccaatgttaacacttatccc

SEQ ID NO: 22911 - DNA, 201 bp, Homo sapiens
ccaggagtattatgaataaagctgcaagagtatttgtatacaggtttttcatgaacataaagttttcccttgtttgaaataagtgcctaggagggcaattkctagtcatatggtaaattgcatgttcagtttgaagaaaactgcaatatccatttccagagtggctgtaccattttaaaatccattcctaccagcaatatg

SEQ ID NO: 22912 - DNA, 201 bp, Homo sapiens
aggtcctggtttagggcgatgtaatctttttacagagaatcctttttacagagaatggggagataaccaggacaggatttatggacccagtgattccaccrtggggcataatttgtccaggtttattccctggcctctgtaagccccactgtgatagggacataatggtgctgtgggaatctgggcagcaatgttagctca

SEQ ID NO: 22913 - DNA, 201 bp, Homo sapiens
gcccttctgaggtctgtcctcggggaccttcccctgtgacttgtgactgctgggatcaggtcccatcaccacagtcatcaaggtgataaatctgtccctcrttgtaacaggtgctttacaaaagagtaagtgctggcacacagggcccaggctgggtaggcccatgagtgtggatggtgcttcccagtaaccaggcagggc

SEQ ID NO: 22914 - DNA, 201 bp, Homo sapiens
ctctgtttaaggaattataatcaagtatctacgagggtgcccagcactggtgtaaaacacaagcctgtaaagctaccctgggctgctacccagtcaccccmtagaaggagaccgttgggagcaagtcccccaaaatctggccataaactggccccaagactggccataaacaaaatctctgcagcaccgtaacatgttcat

SEQ ID NO: 22915 - DNA, 201 bp, Homo sapiens
ccaggtaggctgtctgctgctccgcctcatgggccgcctcccacttgcgctgggtaatctgagccgccatggccgccgcagtccaagagctcaggtcctgstttagggcgatgtaatctttttacagagaatcctttttacagagaatggggagataaccaggacaggatttatggacccagtgattccaccgtggggcat

SEQ ID NO: 22916 - DNA, 201 bp, Homo sapiens
catttctataaaaaacaggtatattttaatttggaaaactctgtttaaggaattataatcaagtatctacgagggtgcccagcactggtgtaaaacacaarcctgtaaagctaccctgggctgctacccagtcaccccctagaaggagaccgttgggagcaagtcccccaaaatctggccataaactggccccaagactgg

SEQ ID NO: 22917 - DNA, 201 bp, Homo sapiens
aaagaactatgtatataccttaatttaaaattactctattgctcaaaaatgctaaggatcatctgaggcttcagctaatcttaatctttttgctggggcasggtcttgcctcaatgttgatgactgctggctgatcaggagggtggttgctaaaggctcttatggcaacttcttaaaataagacaatgaagtttgcggcat

SEQ ID NO: 22918 - DNA, 201 bp, Homo sapiens
gaaattcttttctttttcatttctataaaaaacaggtatattttaatttggaaaactctgtttaaggaattataatcaagtatctacgagggtgcccagcrctggtgtaaaacacaagcctgtaaagctaccctgggctgctacccagtcaccccctagaaggagaccgttgggagcaagtcccccaaaatctggccataa

SEQ ID NO: 22919 - DNA, 201 bp, Homo sapiens
tgcaatgaactttgaaattcttttctttttcatttctataaaaaacaggtatattttaatttggaaaactctgtttaaggaattataatcaagtatctacsagggtgcccagcactggtgtaaaacacaagcctgtaaagctaccctgggctgctacccagtcaccccctagaaggagaccgttgggagcaagtcccccaa

SEQ ID NO: 22920 - DNA, 201 bp, Homo sapiens
ttttccaaaacatgggtttttatctcaggaccttcttgtccccagatgatcaaaaccggggccatccactcccttctgagccacctctgcctggggggccygtggctgtgtcctccagtcacaacagaacactccttcagaacactcgcaggaagacaacatcttgtcattggctcacacatgcacggtgcatgcacagag

SEQ ID NO: 22921 - DNA, 201 bp, Homo sapiens
accctacaccatggcagaagccatcttccctcccagtgtgcagtgatgtcccagatagcgaattggttagccacttttcagtctcgggcagttttgttttycaaaacatgggtttttatctcaggaccttcttgtccccagatgatcaaaaccggggccatccactcccttctgagccacctctgcctggggggcccgtgg

SEQ ID NO: 22922 - DNA, 201 bp, Homo sapiens
tcttttcatgtttcatttattttgatcaatgatgtgcatttccaatctgtaaaagtttatttcagtttaatgtgtggtaaaatgtaacatcaaatctttgsaagatgaaattatcttgcacagcagattgaacattgtatcattgaaaatctagagagatgccagggagccaaggatcaaatgacctatttgtagccaatg

SEQ ID NO: 22923 - DNA, 201 bp, Homo sapiens
taaatagcgctgctattacatgcttctgaatttttttttctttttagcagtcctattctgttttccattcatatttgctattccatcactgggtattcctycctactcttttcatgtttcatttattttgatcaatgatgtgcatttccaatctgtaaaagtttatttcagtttaatgtgtggtaaaatgtaacatcaaat

SEQ ID NO: 22924 - DNA, 201 bp, Homo sapiens
ttgttaagttgtagttctgtatgtagtctggatattaattctttatcagatatgtgattggcaaatattttatcttattctatgcagtttcttttattttyacttttttttttttttttttttttttttttgagacagagtctctctctgatgccccagctggagtgcaatggtgcaatctcagctcattgcaacctctgc

SEQ ID NO: 22925 - DNA, 201 bp, Homo sapiens
gctgtgcagaaaaaaattgcctaatctgattgcttttcatttacaaaaatgagaatctcatacttcagttaacacatctagcttagcatgatgccaataaytttggcttgatgctgtagcccgaaatggttagctcgaattgagagacaagttattttcaaaaactggctatccgatgggcattctataacacacttaaca

SEQ ID NO: 22926 - DNA, 201 bp, Homo sapiens
tccaggtaggctgtctgctgctccgcctcatgggccgcctcccacttgcgctgggtaatctgagccgccatggccgccgcagtccaagagctcaggtcctsgtttagggcgatgtaatctttttacagagaatcctttttacagagaatggggagataaccaggacaggatttatggacccagtgattccaccgtggggca

SEQ ID NO: 22927 - DNA, 201 bp, Homo sapiens
cattgttcctgccttcagcccctggtaacctgtattctactttctgtttttgtgaatttgcttattctaggtgcctcatataagtgaaatatcatatttgycttttttttggcttattttatttagcgtgttttcaaggttccatccaatccaaatattcttcacttttaaggctgattaatattccatgtgtatatgcac

SEQ ID NO: 22928 - DNA, 201 bp, Homo sapiens
gccactccacgcacctgccctccaggtaggctgtctgctgctccgcctcatgggccgcctcccacttgcgctgggtaatctgagccgccatggccgccgcrgtccaagagctcaggtcctggtttagggcgatgtaatctttttacagagaatcctttttacagagaatggggagataaccaggacaggatttatggaccc

SEQ ID NO: 22929 - DNA, 201 bp, Homo sapiens
tggaaggcccttccggttttctatcctagtgaggatggttctggggtggaggtggcagaggagtgagaagtgattggatttggtgttgatatatatttttwaaattgtggtaaaacacacatactatacgatttaccttctaacaatttttttcagtgtacaattcattggcattaagcacatttacaattgatggtggtt

SEQ ID NO: 22930 - DNA, 201 bp, Homo sapiens
ctgttcactctgattgatgatagtttcttttgctgtgcagaaaaaaattgcctaatctgattgcttttcatttacaaaaatgagaatctcatacttcagtyaacacatctagcttagcatgatgccaataattttggcttgatgctgtagcccgaaatggttagctcgaattgagagacaagttattttcaaaaactggct

SEQ ID NO: 22931 - DNA, 201 bp, Homo sapiens
gaggcgcccgtggtccctggtacaggtgtgctgcagtgtctccttcctgttctccaggtatctgcggagccactccacgcacctgccctccaggtaggctstctgctgctccgcctcatgggccgcctcccacttgcgctgggtaatctgagccgccatggccgccgcagtccaagagctcaggtcctggtttagggcgat

SEQ ID NO: 22932 - DNA, 201 bp, Homo sapiens
cattcatgggctatctatccagagttgtttatagacatattctttcaagtttgtattcagggttgatgtcacatacacatttatacatgctgttttatgtytaagtgtttttatattttggttagccttttatcattgttaaacaaagttgtcattaggcataaacttgcatgttaactgaagcttttgtttttattttat

SEQ ID NO: 22933 - DNA, 201 bp, Homo sapiens
tcccattctgtagcatgtctgttcactctgattgatgatagtttcttttgctgtgcagaaaaaaattgcctaatctgattgcttttcatttacaaaaatgwgaatctcatacttcagttaacacatctagcttagcatgatgccaataattttggcttgatgctgtagcccgaaatggttagctcgaattgagagacaagt

SEQ ID NO: 22934 - DNA, 201 bp, Homo sapiens
agattacaggcgatcagggaggcgcccgtggtccctggtacaggtgtgctgcagtgtctccttcctgttctccaggtatctgcggagccactccacgcacstgccctccaggtaggctgtctgctgctccgcctcatgggccgcctcccacttgcgctgggtaatctgagccgccatggccgccgcagtccaagagctcag

SEQ ID NO: 22935 - DNA, 201 bp, Homo sapiens
gagttttaggttctacacccagagttacaaaccattatgtcagcattattctataagttagaagttatattagtccattctcacactgctatgaagaaatrcctgagactgggtaatttataaaggaaagaggtttaattgactcacagttctgcatggctgaggagcctgccccaggaaacttacagtcatgacagaagt

SEQ ID NO: 22936 - DNA, 201 bp, Homo sapiens
atctgtctcccatccttgtgggaggccagcccgggagattacaggcgatcagggaggcgcccgtggtccctggtacaggtgtgctgcagtgtctccttccygttctccaggtatctgcggagccactccacgcacctgccctccaggtaggctgtctgctgctccgcctcatgggccgcctcccacttgcgctgggtaatc

SEQ ID NO: 22937 - DNA, 201 bp, Homo sapiens
cgccatcagttcagactgattcggaggtggggaggtgggatagttcctgaccctgttgcaaggtttcttttgactttctggttttggggcacatagatggstggtgctcttcttggtcagggcggcctcagctccacccaggtaaggcagtggtggcagagagttaggggagcacctatgaaacagaccaaggcagggatg

SEQ ID NO: 22938 - DNA, 201 bp, Homo sapiens
tcccctcctccacacattatgcctacaggaacacagacacattcaggtgcctttgcagaaagtcagggttcttcaagtcacaaagggaaggtgtgaacaamtcttgcctctcagtcccacacaaggcagctgtctcacactatagaaaaaatattcatgaacaaattcatatctgtcccagtaatggatgacactttggca

SEQ ID NO: 22939 - DNA, 201 bp, Homo sapiens
tgttggtcccatctgtctcccatccttgtgggaggccagcccgggagattacaggcgatcagggaggcgcccgtggtccctggtacaggtgtgctgcagtrtctccttcctgttctccaggtatctgcggagccactccacgcacctgccctccaggtaggctgtctgctgctccgcctcatgggccgcctcccacttgcg

SEQ ID NO: 22940 - DNA, 201 bp, Homo sapiens
tgtcttgctcattgcctattgtttatttggatttcatttttactgttgagtttttacatttcttcatatattgtgaatgcaagtctttattgaatatgtgrtttgcaaatatcttctctcattctgtagcttgtctttttatgctcttcataggtctctcacagagcaacagttttaattttgataagatccagtttagta

SEQ ID NO: 22941 - DNA, 201 bp, Homo sapiens
atattcctgttttaatttgctagggctgccataacaaagtaccaaaggctgggtgacttaaataataaatatgtgttgtctcacagttccagaggccacargtgcaaggtcaaggtgctgcagggttgatctcttctgaggcctctttcctttgcttgtagatggccacttcttctgccttctcaacatagggcttcaaca

SEQ ID NO: 22942 - DNA, 201 bp, Homo sapiens
gatctggaaactgaggaggattcttctccctcaggaccagagggagggtgatattctagtgttggtcccatctgtctcccatccttgtgggaggccagccygggagattacaggcgatcagggaggcgcccgtggtccctggtacaggtgtgctgcagtgtctccttcctgttctccaggtatctgcggagccactccacg

SEQ ID NO: 22943 - DNA, 201 bp, Homo sapiens
cttttggagcactcaagttttaaattttaactaagcccaatttctctctctcttttttttttatttgtagatcatgcttttggtattttatctaagaatchtttgcctaactacccaaagtaataaaaattttctcctgtgttttcttttagaaattttatagttttaactcataaattttagctgtttaggtctctaatt

SEQ ID NO: 22944 - DNA, 201 bp, Homo sapiens
aattatgtaaaacttagcttaaaacaacaaatattcctcatctgccacagtttccaatggtcaggagtccaggagaggtttccctgagtgcttcttgctcsgggcctctcacaaggttgcagtccaattgtcagccaagggctgcatcatctgagggcttcactggggctgaggattcacatgaaacatggatcagtcaca

SEQ ID NO: 22945 - DNA, 201 bp, Homo sapiens
acatcttttgttgtggtattgaatgagatgtgatagaagtgatttggacaccactatgattctaaatagcgctgctattacatgcttctgaatttttttttctttttagcagtcctattctgttttccattcatatttgctattccatcactgggtattcctccctactcttttcatgtttcatttattttgatcaatgat

SEQ ID NO: 22946 - DNA, 201 bp, Homo sapiens
cagagtcactctctggtacaggatctggaaactgaggaggattcttctccctcaggaccagagggagggtgatattctagtgttggtcccatctgtctccyatccttgtgggaggccagcccgggagattacaggcgatcagggaggcgcccgtggtccctggtacaggtgtgctgcagtgtctccttcctgttctccagg

SEQ ID NO: 22947 - DNA, 201 bp, Homo sapiens
ggccaggaggaggctgagggtgagccatgcagggagagggtgattgctggccctggtgggggctccccatgtggtttgggtcatgaagttagagaagacaycaacgatgagggacagtgagtagatggtggaatcactggattggtattcccagggtgggggtcgaaggattgttggaattgatgtgctaaagggtggact

SEQ ID NO: 22948 - DNA, 201 bp, Homo sapiens
aactaagcccaatttctctctctcttttttttttatttgtagatcatgcttttggtattttatctaagaatcttttgcctaactacccaaagtaataaaavttttctcctgtgttttcttttagaaattttatagttttaactcataaattttagctgtttaggtctctaatttgtttgagctgatattttatatggtgtt

SEQ ID NO: 22949 - DNA, 201 bp, Homo sapiens
ccccaccgccgcgaagaggggctgcccaaaaggcaacagccataggagatgagcaggggtgcctgctgcgtcggagaactcatctccccaaccccaccgaygccacaaggtagagggcgaggacagcgaggtcggccggattccgcacccctgcctccaaccaccgcccatgggcggggaggagagactaccggccgcaag

SEQ ID NO: 22950 - DNA, 201 bp, Homo sapiens
agactgatcaacctgtcaaggctgggcctgtgagcctttctgtccagtttcatgagatgctggttctgctggttcatggataatagctggggtagcaaggrtctctctttttgtctcacagttttctgcatctctttttcatagtaagcacatgctaatatattttcaataaattcatgtgctcttttcctaagttggtat

SEQ ID NO: 22951 - DNA, 201 bp, Homo sapiens
gctatttgatgggcattctataataaacttaacatcttttgttgtggtattgaatgagatgtgatagaagtgatttggacaccactatgattctaaatagygctgctattacatgcttctgaatttttttttctttttagcagtcctattctgttttccattcatatttgctattccatcactgggtattcctccctactc

SEQ ID NO: 22952 - DNA, 201 bp, Homo sapiens
taatggaaatgtaagagggcttcattagttatccattgctgtgtaacaaactactcccaaatttagtgacttgggatcactaaatgagggatcgtgttccmgtcattccctcagagattttatcccttaattgcgtcttcccgtcattgcctcagagattttatcccttaattgtgtcagagagcagtgtggaacctcaga

SEQ ID NO: 22953 - DNA, 201 bp, Homo sapiens
tatgatgagaaactatgggacccctcctctctgcaaatttcagaatctgcttcctttaaaaagattggagacaagatgaaaactacaatccaggaaagagycctgggaggagggcaagagctggacaggtctgaaaattagtctcttgataccacaatgagatttgtatgcagggaccaccgtaggtgacatccaagtccc

SEQ ID NO: 22954 - DNA, 201 bp, Homo sapiens
aaattattagcatgatgccaataattttggcttgatgctgtagcccgaaatggttagttctaattgagaaacaagtttttttcaaaaactggctatttgaygggcattctataataaacttaacatcttttgttgtggtattgaatgagatgtgatagaagtgatttggacaccactatgattctaaatagcgctgctatt

SEQ ID NO: 22955 - DNA, 201 bp, Homo sapiens
tgcttttcatttacaaaaatgtgaatctcatacttcagtcaactttattttactttagtaaaaattattagcatgatgccaataattttggcttgatgctrtagcccgaaatggttagttctaattgagaaacaagtttttttcaaaaactggctatttgatgggcattctataataaacttaacatcttttgttgtggta

SEQ ID NO: 22956 - DNA, 201 bp, Homo sapiens
ggttatttatttatttacttatttatttttatccctctgcactatttgtcttgtaattggagtgtctgagtccattacgtttaatgtcattgttgacctcrttgggtttaagtctgtccattttcatttactgccttctaatattatctttcttgctcaactatttttcttctgttgccttctttagatgaataaaaaact

SEQ ID NO: 22957 - DNA, 201 bp, Homo sapiens
aagaagggaaggagctggagcgttcataggatatgccctaattcccattggaaaggcacgctctctctgttgtgtgggtgatggacagtgggcatgagagwcagcaggcagcccagctggaaggcccttccggttttctatcctagtgaggatggttctggggtggaggtggcagaggagtgagaagtgattggatttggt

SEQ ID NO: 22958 - DNA, 201 bp, Homo sapiens
cctggtaaaggcgcctgggcctctcccgggtcgaggatctggcgggtcccgcagcctcggggtggatctcggagccggagactcgcgggggggacccgggrcgtccgtgggggatgaggaggggtcgtgaccttcgccccaggccggggtcattcaccggcctagctctggtggtagtagcggcgcggcatgggcaggttc

SEQ ID NO: 22959 - DNA, 201 bp, Homo sapiens
cagaggggaccctgtgataaggagtgcataggaaatggtgggaaactggggtttccttgtgcctaagaagggaaggagctggagcgttcataggatatgcyctaattcccattggaaaggcacgctctctctgttgtgtgggtgatggacagtgggcatgagagtcagcaggcagcccagctggaaggcccttccggtttt

SEQ ID NO: 22960 - DNA, 201 bp, Homo sapiens
tagaaaggaacagtatcaaaggatttgaatatatgttaaaagcaaaattataactattgtttcaggtttctgaaaatcaaagtcttcttgtatctaattakttttcattaactctttaagcttgtcttttaatttaatttttttttaagttccagggtacatgtgtgtaggatgtgcaggtttgttacataaatgtgtgcc

SEQ ID NO: 22961 - DNA, 201 bp, Homo sapiens
aaatgtctgttcatgtcttgctcattgcctgttttgtatttggatttcatttttattgttgtttaaaatttcttcatatattctgaatacagtctttacakaatatgttgcctgcaaatatcttctctcattctgtagcttgtctttttatgctcttcataggtctctcacagaacaacagtttttagtgttgataagatc

SEQ ID NO: 22962 - DNA, 201 bp, Homo sapiens
ggtggcaggtgcctgtagtcccagctacttggaaagctgaggcaggagaatggcatgaacctgggaggcagagcttgcagtgagccgagatcgagccactscactccagcctgggcgacagaacgagactttgtctcaaaaaaaaaaaaaaaaaaaaagaaaagaaaagaaaaaagaaaaaaaaaggatggaacaaaggag

SEQ ID NO: 22963 - DNA, 201 bp, Homo sapiens
ctactaaaaatacaaaaaattagccgggcatggtggcaggtgcctgtagtcccagctacttggaaagctgaggcaggagaatggcatgaacctgggaggcrgagcttgcagtgagccgagatcgagccactgcactccagcctgggcgacagaacgagactttgtctcaaaaaaaaaaaaaaaaaaaaagaaaagaaaaga

SEQ ID NO: 22964 - DNA, 201 bp, Homo sapiens
ctgtaatcccagtctttgggaggccgaggcaggcagatcacgaggtcaggagatagagaccatcctggctaacatggtgaaaccctgtctctactaaaaayacaaaaaattagccgggcatggtggcaggtgcctgtagtcccagctacttggaaagctgaggcaggagaatggcatgaacctgggaggcagagcttgcag

SEQ ID NO: 22965 - DNA, 201 bp, Homo sapiens
gagctcccctaggatatgcatgtaggagtggggtcactgcacccttcccatatgatgctacatgatgtcaaattgttctctgaaagaaataatccaaatgyctatcagtagggagctggttaaaaagcattgcattcaaaaagggtaatctctattttaaaaaatgcatgcctatacaatggattgccaagaaatttttga

SEQ ID NO: 22966 - DNA, 201 bp, Homo sapiens
tagagaagaaagagatggagggagggctagaaggaaggagaaagggaaggaagaggtcaggcacagtggctcatgcctgtaatcccagtctttgggaggcygaggcaggcagatcacgaggtcaggagatagagaccatcctggctaacatggtgaaaccctgtctctactaaaaatacaaaaaattagccgggcatggtg

SEQ ID NO: 22967 - DNA, 201 bp, Homo sapiens
ccatgggaggaatatgctacaatttatctcttccccacttcattgacctctacatagtctttattaaagacactgctgcaatgaacatgctgggacattgytttctggttccaagaatatgtgagctcccctaggatatgcatgtaggagtggggtcactgcacccttcccatatgatgctacatgatgtcaaattgttct

SEQ ID NO: 22968 - DNA, 201 bp, Homo sapiens
ggaaagggagaaagaaggagggaaggcgatagtttgaatggaaatagagaagaaagagatggagggagggctagaaggaaggagaaagggaaggaagaggycaggcacagtggctcatgcctgtaatcccagtctttgggaggccgaggcaggcagatcacgaggtcaggagatagagaccatcctggctaacatggtgaa

SEQ ID NO: 22969 - DNA, 201 bp, Homo sapiens
aggaagagagagaaagaaggaggaatggaggaaaaagcaaaagaagaaaagaaggaaggggaggggaaggaaagggagaaagaaggagggaaggcgatagkttgaatggaaatagagaagaaagagatggagggagggctagaaggaaggagaaagggaaggaagaggtcaggcacagtggctcatgcctgtaatcccagt

SEQ ID NO: 22970 - DNA, 201 bp, Homo sapiens
aacttcctgttgtttacttgtttctcatatacatgacattatatttttgacatatagattcagaaaatgcttacttacagcccaatcacatagagttattktatatattaggaaaatttcataataaaaaggaaaaaatggaggaagagagagaaagaaggaggaatggaggaaaaagcaaaagaagaaaagaaggaaggg

SEQ ID NO: 22971 - DNA, 201 bp, Homo sapiens
tgcaacctcgccagcatctgttgtttcttgactttttaataattgccattctgactgacatgaggtggtatctcatttgtggttttgatttgcatttctcyaatgatcagcgatgttgagctttttttcatatttttgttggccacatgtatgtcttctttagaagtgtctgttcaagttctttgtctactttttaatgaa

SEQ ID NO: 22972 - DNA, 201 bp, Homo sapiens
tattgagctttttaaaatatgttttttggccacctgtatgtcttcttttgagaagtgtctgttcatgtgctttgtccacttcttaatgaagttgtttttttcatgtaaatttgcttaagttctttttagattatgaatattagacctttgtcagatcaatagattgcataaattttctcccattctgtaggttgtctcctt

SEQ ID NO: 22973 - DNA, 201 bp, Homo sapiens
ttttattcagactctgttaataacttcctgttgtttacttgtttctcatatacatgacattatatttttgacatatagattcagaaaatgcttacttacarcccaatcacatagagttattttatatattaggaaaatttcataataaaaaggaaaaaatggaggaagagagagaaagaaggaggaatggaggaaaaagca

SEQ ID NO: 22974 - DNA, 201 bp, Homo sapiens
tcagcattattctataagttagaagttatattagtccattctcacactgctatgaagaaatacctgagactgggtaatttataaaggaaagaggtttaatwgactcacagttctgcatggctgaggagcctgccccaggaaacttacagtcatgacagaagtggaagcaaacacatccttcttcacatgatgacaggagag

SEQ ID NO: 22975 - DNA, 201 bp, Homo sapiens
ttttccaccaacagtgtaaaagcattcctatttctctgcaacctcgccagcatctgttgtttcttgactttttaataattgccattctgactgacatgagrtggtatctcatttgtggttttgatttgcatttctctaatgatcagcgatgttgagctttttttcatatttttgttggccacatgtatgtcttctttagaa

SEQ ID NO: 22976 - DNA, 201 bp, Homo sapiens
tacaataaatgtgtaatacttgatgttgatgatgtgttctgaaaacactgtgttgaaggaattgagttaaaagccactgtcttggctgtagaattatagcrggcatttttattcagactctgttaataacttcctgttgtttacttgtttctcatatacatgacattatatttttgacatatagattcagaaaatgcttac

SEQ ID NO: 22977 - DNA, 201 bp, Homo sapiens
acagttcttcctgttttaaaacttcatacaaatctactcatcccatatggcctcccttgtatctggctttttgcgcttgttgtaatacctatgtgatcaayccatgttggtgcacgtatcagtagttctttcattttcattgctgataatattccattgtatgactgaatcatgatttttgtacattggcagttatttctt

SEQ ID NO: 22978 - DNA, 201 bp, Homo sapiens
attttcaattgcctcactctatcttttgaaatctcaggtaattcatactcctaaaaaaatctcatgttcatacataggacaaggtagaaaaggtaatattbctgttttaatttgctagggctgccataacaaagtaccaaaggctgggtgacttaaataataaatatgtgttgtctcacagttccagaggccacaggtgca

SEQ ID NO: 22979 - DNA, 201 bp, Homo sapiens
gtaccacattttctttatccagttcatcattgatgggcatttgggttgattccatgtgtttgctattgtgaatagtgctgccatgaatgtaaacatgcatrtatctttataatagaatgatttgtattcctttgggtatataccctgtaatgcgattgctggatcaaatggtatttctgattctaaatctctgaggaatca

SEQ ID NO: 22980 - DNA, 201 bp, Homo sapiens
tgtggcagctaaagaacaacatcatctcatgtggacatcgatgccgccagtgcttttctcaccaggagtgcttgtgtgtcctccctccctccctacctccycccacaccaaccctcctgcacactgcagcacacaaccatatttttctcttcaggaaagataaccctaggcttatgggtacaattttccaaccacgtatga

SEQ ID NO: 22981 - DNA, 201 bp, Homo sapiens
taaatgagaacatgtggtgtttggttttccgttcctgtgtgagtttgctgaggataatggcttccagcttcatccatatccctgcaaaggacttgatctcmttcctttttatggctgcataatattccatggtgtatatgtaccacattttctttatccagttcatcattgatgggcatttgggttgattccatgtgtttg

SEQ ID NO: 22982 - DNA, 201 bp, Homo sapiens
ctgttttgtggcagctaaagaacaacatcatctcatgtggacatcgatgccgccagtgcttttctcaccaggagtgcttgtgtgtcctccctccctccctmcctcctcccacaccaaccctcctgcacactgcagcacacaaccatatttttctcttcaggaaagataaccctaggcttatgggtacaattttccaaccac

SEQ ID NO: 22983 - DNA, 201 bp, Homo sapiens
aggagagagaagtgcagaatgaagcagggaaaagccccttataaaaccatcagatctcatgagaattccctcagtatcacgagaacagcatgggggcaccrcccccattatccaatcacctcccatgtggtccctcccccaataggtagcgattacaattcgcataacaattcaagatgagatttgggtgggaacacagaa

SEQ ID NO: 22984 - DNA, 201 bp, Homo sapiens
aagaaatacctgagactgggtaatttataaaggaaagaggtttaattgactcacagttctgcatggctgaggagcctgccccaggaaacttacagtcatgrcagaagtggaagcaaacacatccttcttcacatgatgacaggagagagaagtgcagaatgaagcagggaaaagccccttataaaaccatcagatctcatg

SEQ ID NO: 22985 - DNA, 201 bp, Homo sapiens
cattattctataagttagaagttatattagtccattctcacactgctatgaagaaatacctgagactgggtaatttataaaggaaagaggtttaattgacycacagttctgcatggctgaggagcctgccccaggaaacttacagtcatgacagaagtggaagcaaacacatccttcttcacatgatgacaggagagagaa

SEQ ID NO: 22986 - DNA, 201 bp, Homo sapiens
tctgaccctgggacaccaccctttattaaccttccccacaactccttgaaggtcaagcccccttggctgatactctgggttatcacagtaaatgtgccctytatcttttgcaggtcactgaaaaggagggttcctaaagcattcactcctgaccctgagggaggtgggtgcactcactccaggactcaggttcaccacaga

SEQ ID NO: 22987 - DNA, 201 bp, Homo sapiens
ctacacccagagttacaaaccattatgtcagcattattctataagttagaagttatattagtccattctcacactgctatgaagaaatacctgagactggstaatttataaaggaaagaggtttaattgactcacagttctgcatggctgaggagcctgccccaggaaacttacagtcatgacagaagtggaagcaaacac

SEQ ID NO: 22988 - DNA, 201 bp, Homo sapiens
atctacaaagagagatgttattttatttttaaatttttaaattcgtatatattcatggggcacaggtgcagttttgctacattgctatattgagttgtggyaaagtcagggccttcagtgcatccaccactggagacagatacattgaccccaacaagaaactcctctacgatacacccactgccaaccactcttaccctt

SEQ ID NO: 22989 - DNA, 201 bp, Homo sapiens
ttgtggctacttaaacttttacaataaatgtgtaatacttgatgttgatgatgtgttctgaaaacactgtgttgaaggaattgagttaaaagccactgtcktggctgtagaattatagcaggcatttttattcagactctgttaataacttcctgttgtttacttgtttctcatatacatgacattatatttttgacatat

SEQ ID NO: 22990 - DNA, 201 bp, Homo sapiens
ctagataatgataatacaaattccaaagtgattgtggctacttaaacttttacaataaatgtgtaatacttgatgttgatgatgtgttctgaaaacactgbgttgaaggaattgagttaaaagccactgtcttggctgtagaattatagcaggcatttttattcagactctgttaataacttcctgttgtttacttgtttc

SEQ ID NO: 22991 - DNA, 201 bp, Homo sapiens
acttctctattctaaagccaatatctttgttaaggtagcctcagggcaaatgctgttttgtggcagctaaagaacaacatcatctcatgtggacatcgatrccgccagtgcttttctcaccaggagtgcttgtgtgtcctccctccctccctacctcctcccacaccaaccctcctgcacactgcagcacacaaccatatt

SEQ ID NO: 22992 - DNA, 201 bp, Homo sapiens
gggttggttggatgatacgttgtatggactttaaccatactagataatgataatacaaattccaaagtgattgtggctacttaaacttttacaataaatgygtaatacttgatgttgatgatgtgttctgaaaacactgtgttgaaggaattgagttaaaagccactgtcttggctgtagaattatagcaggcatttttat

SEQ ID NO: 22993 - DNA, 201 bp, Homo sapiens
cataggcaagaaagccccccagagtggatgattaggaatgggttggttggatgatacgttgtatggactttaaccatactagataatgataatacaaattscaaagtgattgtggctacttaaacttttacaataaatgtgtaatacttgatgttgatgatgtgttctgaaaacactgtgttgaaggaattgagttaaaag

SEQ ID NO: 22994 - DNA, 201 bp, Homo sapiens
gtgcacataggcaagaaagccccccagagtggatgattaggaatgggttggttggatgatacgttgtatggactttaaccatactagataatgataatacraattccaaagtgattgtggctacttaaacttttacaataaatgtgtaatacttgatgttgatgatgtgttctgaaaacactgtgttgaaggaattgagtt

SEQ ID NO: 22995 - DNA, 201 bp, Homo sapiens
tctaccatttagtagtcctggcaggggtcctgttgctgcagctccgctaagaattttcctgggtattaaatttccccatttaaatatcagttccagtttcrggtcatttctttgctcacacatatgcacataggctattacaggcagccagaccaaatcctgaattctatgctactgagaaatttcttccatcagataccc

SEQ ID NO: 22996 - DNA, 201 bp, Homo sapiens
tgtgcacataggcaagaaagccccccagagtggatgattaggaatgggttggttggatgatacgttgtatggactttaaccatactagataatgataatamaaattccaaagtgattgtggctacttaaacttttacaataaatgtgtaatacttgatgttgatgatgtgttctgaaaacactgtgttgaaggaattgagt

SEQ ID NO: 22997 - DNA, 201 bp, Homo sapiens
tagtgtgcatgtctcctgtgcacataggcaagaaagccccccagagtggatgattaggaatgggttggttggatgatacgttgtatggactttaaccatastagataatgataatacaaattccaaagtgattgtggctacttaaacttttacaataaatgtgtaatacttgatgttgatgatgtgttctgaaaacactgt

SEQ ID NO: 22998 - DNA, 201 bp, Homo sapiens
acaccccttcagaacagcctgcaggaaggcaccgtctcctcacaggctcacacatgcacggtgtgtgcacagagcttttgctctagttcaggaggtgtgtrgggagcctcactagtccaacagagcttggtaccagtgtcatatgccaggaaccaaggttataagggatacaatgtccccagacctaccagagaaggcaaa

SEQ ID NO: 22999 - DNA, 201 bp, Homo sapiens
ttccagtttttgccataaatattagtgtgcatgtctcctgtgcacataggcaagaaagccccccagagtggatgattaggaatgggttggttggatgatasgttgtatggactttaaccatactagataatgataatacaaattccaaagtgattgtggctacttaaacttttacaataaatgtgtaatacttgatgttga

SEQ ID NO: 23000 - DNA, 201 bp, Homo sapiens
tttgttttgctggtttttaagcttcctgtacagcaagttcctactgcctttattttcccatgatgcacattatgtgtaggagttatctgtggtgtgggagrctgtcattcattcatttttactgctgaaggcttacatatggttataccacaatttcactagtttcctattgatgtatatgtggctgattccagtttttgc

SEQ ID NO: 23001 - DNA, 201 bp, Homo sapiens
taaaaaccttagaatctcttgagtgattagagtgtctttagaatactgaggaaaggactcttggctgagtggatcctggataccttgagaatgggggctgrctgccacagacacatacctatgatgagagggttgtcttattccgttttgtgttgctataaagaaatgtctgagactgactaatttatataaacaaggttc

SEQ ID NO: 23002 - DNA, 201 bp, Homo sapiens
ctgggacatttcatgctagaaaaaccccaacatgtgtagataaatggtatagaggacaccagccacccttcgatggagctctgcccagtagtgtcccctcmcttccactcagagacaacatgcccatttcactaaattcatgaggacatggccaacataagtaagagaacaccgggaggtaccttggacagagttccatgc

SEQ ID NO: 23003 - DNA, 201 bp, Homo sapiens
gcttgagcctcttctcttctttctaggttcccagggaaattctctgttggaagattatgcctgcaagaggcctccacctgggaaatgctggcccatggggsgatctcccttttattaaatggaatgattgttggtgaagtgacagctagtgagccagtgacagtacggttcatgtaaaaaagaccacatacctaggattac

SEQ ID NO: 23004 - DNA, 201 bp, Homo sapiens
cagagagagttaggggagcacctgtgaaaccgaccaaggcagagatgggagccctctgtgcagcaggagtggatgcaggacctgcctggaagcaagaggabgagggaacctagttgggtcctgttccctgcctgcctgtgttcgcagggtaaccagtaagggagctggggtagggaattctttcataggttatctagccag

SEQ ID NO: 23005 - DNA, 201 bp, Homo sapiens
gtgtatatatgtgtatatatatacatatatgtgtatatatgtgtatatatacacatatatgtatccatatatgtatatatgtgtatatatacacatatatrtatccatatatgtatatatgtgtatatatacacatatatgtatatatgtgtatatgtatgtgtatatatacacacacacatatatatatgtatgtgtgta

SEQ ID NO: 23006 - DNA, 201 bp, Homo sapiens
aactcatcctaccaaaccagggctgacccatggtgaaggctggctaacttccatttgtctgtttggttgttcagtgccacttcagacttgggtattttctstgggtgtaaacatgggattcaagctcaacccaggtggaccattttcacctcatgatggatgctgttgggcctgtctaatctatgactctgtgggtcacac

SEQ ID NO: 23007 - DNA, 201 bp, Homo sapiens
agactggccataaacaaaatttctgcagcaccataacatgttcataatggccctagcacccaagctggaaggttgtgggtttacgggaatgagggcaaggracacctggcccgcccagggtggaaaaccacttaaaggcattcttaagccacaaacaatagcatgagtgatctgtgtcttaagggcatgttcctgctgcag

SEQ ID NO: 23008 - DNA, 201 bp, Homo sapiens
aattataatcaagtaactaccagggggcccagcactggtgtaaaacacaaaactgtaaaactaccctgggctgctacccagtcatcctccagaaggagacygttgggagcaagtcccccaaaatctggtcataaactggccccgagactggccataaacaaaatttctgcagcaccataacatgttcataatggccctagc

SEQ ID NO: 23009 - DNA, 201 bp, Homo sapiens
ctgggattacaggcgtgagccactgcacctggccgagtggccactctggaagctttgtaaggtttatcttcaccttctggagtgcccgtgttttgccaagsactacagtgcactttctacctgctgctcatccagccaggtcaacaggaagttgtcaatgatatgagctgatttaatatcctattggatatccagtatgtt

SEQ ID NO: 23010 - DNA, 201 bp, Homo sapiens
aattataactcctacttggccagacctggagtaatctagttcattctttaggcttcatcaggcttcttcagggacaggttgctggattacgtagagacaayagacagccccaacaccatcccacatccttcagctctgtaatggtgatgtgatccccacaatacttgaagtatcttacacaagacccaccctgggacacac

SEQ ID NO: 23011 - DNA, 201 bp, Homo sapiens
aaaacaggtatattttaatttggaaaactctgtttaaggaattataatcaagtaactaccagggggcccagcactggtgtaaaacacaaaactgtaaaacwaccctgggctgctacccagtcatcctccagaaggagactgttgggagcaagtcccccaaaatctggtcataaactggccccgagactggccataaacaaa

SEQ ID NO: 23012 - DNA, 201 bp, Homo sapiens
cttcatcaggcttcttcagggacaggttgctggattacgtagagacaatagacagccccaacaccatcccacatccttcagctctgtaatggtgatgtgayccccacaatacttgaagtatcttacacaagacccaccctgggacacactatgatttttgatttggccaggatgggggcagtgtcagaggtttccctttgg

SEQ ID NO: 23013 - DNA, 201 bp, Homo sapiens
atttcctggcctccttaagccccactgtagattctgaatctgaagcttggctgaagtctaggaattgagactgggatcatgactttgtatttgatcaaacrccctcagtctcctgctcctcaattcttgcattcccatcatagatatgaagcagtgccctcgctggctgcccatctgttctgacgctgggacaccaccttt

SEQ ID NO: 23014 - DNA, 201 bp, Homo sapiens
ttcatttctataaaaaacaggtatattttaatttggaaaactctgtttaaggaattataatcaagtaactaccagggggcccagcactggtgtaaaacacraaactgtaaaactaccctgggctgctacccagtcatcctccagaaggagactgttgggagcaagtcccccaaaatctggtcataaactggccccgagact

SEQ ID NO: 23015 - DNA, 201 bp, Homo sapiens
acctgtccatgagacactgccgagggtgtcaaatgtagccagtcatagctgtcaacaatccgcagattctcattatctttttacacagcatcgatgcagcygagaagtaactagccaaagccactgtctttgtaggtttcttccaaccctgtccttattatgcagggcattctatcactgcatgtgccatagcactcccta

SEQ ID NO: 23016 - DNA, 201 bp, Homo sapiens
tgaactttgaaattcttttctttttcatttctataaaaaacaggtatattttaatttggaaaactctgtttaaggaattataatcaagtaactaccagggkgcccagcactggtgtaaaacacaaaactgtaaaactaccctgggctgctacccagtcatcctccagaaggagactgttgggagcaagtcccccaaaatct

SEQ ID NO: 23017 - DNA, 201 bp, Homo sapiens
agacactgccgagggtgtcaaatgtagccagtcatagctgtcaacaatccgcagattctcattatctttttacacagcatcgatgcagctgagaagtaacyagccaaagccactgtctttgtaggtttcttccaaccctgtccttattatgcagggcattctatcactgcatgtgccatagcactccctaaccaaggcaac

SEQ ID NO: 23018 - DNA, 201 bp, Homo sapiens
aaaacataatacaaataccagcaaaatggagccaacgcaagtagaagaagttgaataaacaaaaggattttacaaattggaataagaggacactggtgtgyagatgaaaatgattttgtagtccaaatcctccaaaaagcaagtgccatcatgggattaaagttacaacattttattaggggacatacctgtcagacgata

SEQ ID NO: 23019 - DNA, 201 bp, Homo sapiens
tctgaacccaggggtacaagtccctggggaaactcccccatgtgggaggacttcggagggggtcatgtcctcagggagacccaggttgctgctggagctgygagatgcaggaacatcctgagagaggctgaggaggttttgctgatgtggactgagaaatccagggggtgcactgggaagatttctgtggctggggaggtc

SEQ ID NO: 23020 - DNA, 201 bp, Homo sapiens
aatattgcttctggcttggctgggatgagggaagttttagatgattccctttgggcttcagcacaatgatagcccttactctccagactagggatgtagtrtgggggtgactccctttgccagtgcatcaaggccaattatgcatgtggagaatggggagataaccaggactgggtttatgaacccagtggtcccacagtg

SEQ ID NO: 23021 - DNA, 201 bp, Homo sapiens
attcagttgtatgtgtggtaaaatgtaacatagaatctttgcaagatgaaattaccttgcacagcatattgaacattgtattattgaaaatctagagagaygccagtgagccaaggatcgaatgacctatatgtagccaaggccgttttcatggcatcctggtcctctctgtcacatagctccttacaattctctgtggtt

SEQ ID NO: 23022 - DNA, 201 bp, Homo sapiens
ggcaattggggcaccagaagagggtctggctctggctgggagcagaagggttaacccacaacagtccctcacatggtaaaacgcctgacatgtggtgcagytgcaaatgcatgagcagacagtggtggaatctgtgaagttgtcttctaatgtgttcagttttctcagtgaagtgggaagcaaggtcatcagctgaagtaa

SEQ ID NO: 23023 - DNA, 201 bp, Homo sapiens
aggagcaaggaccccacctcacctctgaacccaggggtacaagtccctggggaaactcccccatgtgggaggacttcggagggggtcatgtcctcagggaracccaggttgctgctggagctgcgagatgcaggaacatcctgagagaggctgaggaggttttgctgatgtggactgagaaatccagggggtgcactggga

SEQ ID NO: 23024 - DNA, 201 bp, Homo sapiens
cagtaccctcctgaagtcccacctggggcgcaatattgcttctggcttggctgggatgagggaagttttagatgattccctttgggcttcagcacaatgawagcccttactctccagactagggatgtagtgtgggggtgactccctttgccagtgcatcaaggccaattatgcatgtggagaatggggagataaccagga

SEQ ID NO: 23025 - DNA, 201 bp, Homo sapiens
ttgatcagtgatgtgcatttccaattctgtaaaagtttaattcagttgtatgtgtggtaaaatgtaacatagaatctttgcaagatgaaattaccttgcayagcatattgaacattgtattattgaaaatctagagagatgccagtgagccaaggatcgaatgacctatatgtagccaaggccgttttcatggcatcctgg

SEQ ID NO: 23026 - DNA, 201 bp, Homo sapiens
ccttcctactcttttcatgtttcatttattttgatcagtgatgtgcatttccaattctgtaaaagtttaattcagttgtatgtgtggtaaaatgtaacatmgaatctttgcaagatgaaattaccttgcacagcatattgaacattgtattattgaaaatctagagagatgccagtgagccaaggatcgaatgacctatat

SEQ ID NO: 23027 - DNA, 201 bp, Homo sapiens
ttccttcctactcttttcatgtttcatttattttgatcagtgatgtgcatttccaattctgtaaaagtttaattcagttgtatgtgtggtaaaatgtaacrtagaatctttgcaagatgaaattaccttgcacagcatattgaacattgtattattgaaaatctagagagatgccagtgagccaaggatcgaatgacctat

SEQ ID NO: 23028 - DNA, 201 bp, Homo sapiens
ataataggcaatcccaacaccaccccccatccttcagctctctaatggcagtgccacccctacaatacctgcagtaccctcctgaagtcccacctggggcrcaatattgcttctggcttggctgggatgagggaagttttagatgattccctttgggcttcagcacaatgatagcccttactctccagactagggatgtag

SEQ ID NO: 23029 - DNA, 201 bp, Homo sapiens
accaggcctgggctgacccatggtgaaggctggctaactgccatttgtctgtttggttgttcagtgccacatcacacttgggtgttttctgtgggtgtcarcatgggattcaagctcaacccaggtggaccattttcacctgttgatgaatgctgttgggcctgtgcaatttatgactttgtgggtcacacagccacttgg

SEQ ID NO: 23030 - DNA, 201 bp, Homo sapiens
tttcattgtgttgacttttccattagtgctgcaaatgccaaggtcggtagcacacccagcacctcagcagaaccaggcagtggctccaaactgcagtcccrtttaagagtgtctttgatggagcagtaaaaaatttatgtggattaaagtttgatccttgagtatacgtctttaatattctttgtgagaaaatgggaaata

SEQ ID NO: 23031 - DNA, 201 bp, Homo sapiens
ctacggaaagacagttgtattaattcctgtttgggggtatcatgaataaagctgcaagagtatttgtgcacaggattttcgtgaacataaagtattccctygtttgaaataagtgcctaggagggcaattgctagtcataaggtaaattgcatgttcggtttgaagaaaactgcaatactcatttccagagtggctgtacc

SEQ ID NO: 23032 - DNA, 201 bp, Homo sapiens
ccacctgagctcttcctcctccacctcacagcagcgaccacagctccagtgatcacagctccaaagagaaccaggccagcaatgatgcccacgatggggayggtgggctgggaagacggctctgggaaaagaggggaaggtgaggggccctgaccctgctaaaggtcagagaggctcctgctttccctaaaagacatgaca

SEQ ID NO: 23033 - DNA, 201 bp, Homo sapiens
gcctaactacccaaagtaataaaaattttctcctgtgttttcttttagaaattttatagttttaactcataaattttagctgtttaggtctctaatttgtytgagctgatattttatatggtgttaaatgtaacattgtgttacctatgcaacttcattgaaaatcaattgacaaagaaagtaagaatatctttctagatt

SEQ ID NO: 23034 - DNA, 201 bp, Homo sapiens
aaatctcagacccacccttcatcccttccccacctgagctcttcctcctccacctcacagcagcgaccacagctccagtgatcacagctccaaagagaacyaggccagcaatgatgcccacgatggggatggtgggctgggaagacggctctgggaaaagaggggaaggtgaggggccctgaccctgctaaaggtcagaga

SEQ ID NO: 23035 - DNA, 201 bp, Homo sapiens
tggctcttgtgatttgattgggcccacacagagagtccagcagaatctccctattttaaggtccttaatcttcattacatgagtaatatcccttttgccaygcaatgcaacctgttcacaggttccaacgattaagactggacatctttggggaccattactcagcccaccacatctgcgtatgttgaagtcaccaagagt

SEQ ID NO: 23036 - DNA, 201 bp, Homo sapiens
gttctgctccatcctgcatctttccccaccactggcaccaccagccccagggggtctgagggacgctggctgcttgcaccatggcctggatctgctgcagsgtcctttcctgtgtaggccctacttgaagctggcctcctcctatgtcacctagagtgtttgccaaagcacgtacctagatgtggaatgtggtgttgtcag

SEQ ID NO: 23037 - DNA, 201 bp, Homo sapiens
ccctcagtgagacaagaaatctcagacccacccttcatcccttccccacctgagctcttcctcctccacctcacagcagcgaccacagctccagtgatcayagctccaaagagaaccaggccagcaatgatgcccacgatggggatggtgggctgggaagacggctctgggaaaagaggggaaggtgaggggccctgaccc

SEQ ID NO: 23038 - DNA, 201 bp, Homo sapiens
gtattcccttgtttgaaataagtgcctaggagggcaattgctagtcataaggtaaattgcatgttcggtttgaagaaaactgcaatactcatttccagagyggctgtaccattttaaaatacatccctaccagcaatataagagtgtcccagttcctctgcgtccttgccagcatctgttgctacctttattttgtatttc

SEQ ID NO: 23039 - DNA, 201 bp, Homo sapiens
ctctcattctgtagcttgtctttttatgctcttcataggtctctcacagagcaacagttttaattttgataagatccagtttagtaactttttcttttacrgatcatacttttggtgttatgtgtaagaactctttgtctagtcttagttctgatggctttttgttaaaagatttgtaattttaattttttaatgtatttg

SEQ ID NO: 23040 - DNA, 201 bp, Homo sapiens
gagtcatgcataaccctagcactaagagacaagaggggaatccctctctctgaaaattttgcaaaattctgggttctttttccactgagtgggcacaagtyggctaatcatgaacatgaggtatttgtcctcatttaaaggtgcttcagaagcactgacccctaggaaggcctccttgtctgggtcaggcaccctacacca

SEQ ID NO: 23041 - DNA, 201 bp, Homo sapiens
ttggaaccctcagtgagacaagaaatctcagacccacccttcatcccttccccacctgagctcttcctcctccacctcacagcagcgaccacagctccagygatcacagctccaaagagaaccaggccagcaatgatgcccacgatggggatggtgggctgggaagacggctctgggaaaagaggggaaggtgaggggccc

SEQ ID NO: 23042 - DNA, 201 bp, Homo sapiens
ctttattgaatatgtggtttgcaaatatcttctctcattctgtagcttgtctttttatgctcttcataggtctctcacagagcaacagttttaattttgawaagatccagtttagtaactttttcttttacagatcatacttttggtgttatgtgtaagaactctttgtctagtcttagttctgatggctttttgttaaaa

SEQ ID NO: 23043 - DNA, 201 bp, Homo sapiens
cgggtcctgcgtccccgccgggcgggccccttgcttctccccgcagaggcggtttccccacgaccccgcactcacccgcccaggtctgggtcagggccagrgcccccaagagtagcaggaggagggttcggggcgccatgacggccatcctcggcgtctggggagaatctgagtcccggtgggtgcgtgcggactttagaa

SEQ ID NO: 23044 - DNA, 201 bp, Homo sapiens
gtaatcaaggtgataaatctgtccttcattttaacaggtgctttacaaaagagtaagtgctggcacacagggcccaggctgggtaggcccataattgtggrtggtgcttcccagtaacgaggcagggcacacttctacctgggtcttggaaccctcagtgagacaagaaatctcagacccacccttcatcccttccccacc

SEQ ID NO: 23045 - DNA, 201 bp, Homo sapiens
aaggcaagactgggacatctagtccataggaagacctgcaccactgtcaccttcacacaggttaactcggaagacaaaggtgctttggctaagctggtggragttctcaggaccaattacaatgacagatacgatgagatccgccatcactggggagacagtgtcctgggtctcaagtatgtggtttgcattgccaagctc

SEQ ID NO: 23046 - DNA, 201 bp, Homo sapiens
atctgttgctacctttattttgtatttcagccattctcatcactgcagttttaatttgtattttcctactggatagtgatgttgagtgtcttttcatctgyttgttagcctggtgtttatcctcttcagtgaaacgtctgttcatgtcttgctcattgcctattgtttatttggatttcatttttactgttgagtttttac

SEQ ID NO: 23047 - DNA, 201 bp, Homo sapiens
ctcgcggcgtcgctgtcaaaccgcacgaactgcgtgtcgtccacgtagcccacggcgatgaagcggggctccccgcggccgggccgggacacggatgtggwgaaatacctcatggagtgggagcctgggggcgaggagtggctgagacccacccgaccctcctcccggcgcggctacccgggtcctgcgtccccgccgggc

SEQ ID NO: 23048 - DNA, 201 bp, Homo sapiens
aagcagaggctgttggcccgggccaagaagaaagctgctggcaaaggggacattccccactaagagtccacctgtccttcgagcaggagttaacaccatcrccaccttggtggagaacaagaaagctcagctggtggtgattgcacatgatgtagatcccatcaagctggttgtcttcttgcctgtcctgtgtcataaaat

SEQ ID NO: 23049 - DNA, 201 bp, Homo sapiens
atatttgctattccatcactgggtattccttcctactcttttcatgtttcatttattttgatcagtgatgtgcatttccaattctgtaaaagtttaattcmgttgtatgtgtggtaaaatgtaacatagaatctttgcaagatgaaattaccttgcacagcatattgaacattgtattattgaaaatctagagagatgcca

SEQ ID NO: 23050 - DNA, 201 bp, Homo sapiens
tcttagttctgatggaccaagtgcagaagataaactttcctgctttcagcttagtgactggtaatagaagctggagttaagagaatcagtggcagcctctstctccatgccccagcccagtaaatctaagccaggacttggggctctggcactttcttctcactgtgcgtcctccttctctggctcaaaagagaaccacat

SEQ ID NO: 23051 - DNA, 201 bp, Homo sapiens
gaagaaagcaggtgtgggtcctggaccaaccgccctcctgaaggtcctcagggaccttcccctgtgacttgtgactgctgggatcaggtcccatcaccgcygtaatcaaggtgataaatctgtccttcattttaacaggtgctttacaaaagagtaagtgctggcacacagggcccaggctgggtaggcccataattgtgg

SEQ ID NO: 23052 - DNA, 201 bp, Homo sapiens
tcacccaggcaccagacagccaaacagctactctgctgcttaagctggcccacaatacagaccagagacaaaccaagagaagaagcagaggctgttggccbgggccaagaagaaagctgctggcaaaggggacattccccactaagagtccacctgtccttcgagcaggagttaacaccatcaccaccttggtggagaaca

SEQ ID NO: 23053 - DNA, 201 bp, Homo sapiens
ttcctaccagcaatatgaatgatccagtttctctgtaaccttgccagcatctgttgctacctttattttgtatttcagccattctcatcactgcagttttratttgtattttcctactggatagtgatgttgagtgtcttttcatctgcttgttagcctggtgtttatcctcttcagtgaaacgtctgttcatgtcttgct

SEQ ID NO: 23054 - DNA, 201 bp, Homo sapiens
ggtgcccgcggctccatcctctggctcgcggcgtcgctgtcaaaccgcacgaactgcgtgtcgtccacgtagcccacggcgatgaagcggggctccccgckgccgggccgggacacggatgtggtgaaatacctcatggagtgggagcctgggggcgaggagtggctgagacccacccgaccctcctcccggcgcggctac

SEQ ID NO: 23055 - DNA, 201 bp, Homo sapiens
cagcgaggtcggccggattccgcacccctgcctccaaccaccgcccatgggcggggaggagagactaccggccgcaagcagaacgcagaacgagaagagcsgtcccgttagccatgaatgtgtccctcatctgtaccgcctccggccccgcccgggagaacgcgacgtcaccacatccatcacttgttctctttcactctt

SEQ ID NO: 23056 - DNA, 201 bp, Homo sapiens
ttttttctttttagcagtcctattctgtttccattcatatttgctattccatcactgggtattccttcctactcttttcatgtttcatttattttgatcartgatgtgcatttccaattctgtaaaagtttaattcagttgtatgtgtggtaaaatgtaacatagaatctttgcaagatgaaattaccttgcacagcatat

SEQ ID NO: 23057 - DNA, 201 bp, Homo sapiens
cttcaagggctatacaaggaccagaaaagaagaggttgcaccaatttggactgccgagtcacacttctttacacaagaaaacacactttacagcctcaaayggccaacaatgcagagggacatgtcctcctcaggggaaaatttgatagaaaattgaaatggtcaattgaaacattgtttgtctaaaaactgccaatctaa

SEQ ID NO: 23058 - DNA, 201 bp, Homo sapiens
tgctgtcgtgaagaagcaggaggccaagaaagtggtaaatcccttgtttgagaaaaggcctaagaattttggcactggacaggatatccagcccaaaagasacctcacccactttgtgaaatggccctgctatatcaggttgcagcagcagagaaccatcctctataagtggctgaaagtgcctcctgagattaaccagtt

SEQ ID NO: 23059 - DNA, 201 bp, Homo sapiens
tagcactgctattatgtgcttctgaattttttttctttttagcagtcctattctgtttccattcatatttgctattccatcactgggtattccttcctackcttttcatgtttcatttattttgatcagtgatgtgcatttccaattctgtaaaagtttaattcagttgtatgtgtggtaaaatgtaacatagaatctttg

SEQ ID NO: 23060 - DNA, 201 bp, Homo sapiens
gaaggccaaggagaagaaggtggctccagcccctgctgtcgtgaagaagcaggaggccaagaaagtggtaaatcccttgtttgagaaaaggcctaagaathttggcactggacaggatatccagcccaaaagagacctcacccactttgtgaaatggccctgctatatcaggttgcagcagcagagaaccatcctctataa

SEQ ID NO: 23061 - DNA, 201 bp, Homo sapiens
tggtattgaatgagatgtgatagaagtgatttggacaccactatgattctaaatagcactgctattatgtgcttctgaattttttttctttttagcagtcytattctgtttccattcatatttgctattccatcactgggtattccttcctactcttttcatgtttcatttattttgatcagtgatgtgcatttccaattc

SEQ ID NO: 23062 - DNA, 201 bp, Homo sapiens
ttgtcttctgaactctccaaactcttccaacctctgcctgttacccagttccaaagctgtttccacattttcaagaatttttatagtaatacccaactcchggtaccgattttctgaattagttcattctcacacttttataaagaaatacctgagactgggtaatttataaacaaaataggtttctttctttctcctccc

SEQ ID NO: 23063 - DNA, 201 bp, Homo sapiens
agatatatcagagtgataacttgaattttactgcactattctttcagcttctttgcacatttgaaaatatatacaattataagttggaagaatgagggaamaaaaagagcgagagagagtgctgaatctgaataggctaggggttgggtctcactaggaactataattgatctctgccattttgaaagtgtggccccctga

SEQ ID NO: 23064 - DNA, 201 bp, Homo sapiens
ggcattctataacacacttaacatcttttgttgtggtattgaatgagatgtgatagaagtgatttggacaccactatgattctaaatagcactgctattaygtgcttctgaattttttttctttttagcagtcctattctgtttccattcatatttgctattccatcactgggtattccttcctactcttttcatgtttca

SEQ ID NO: 23065 - DNA, 201 bp, Homo sapiens
ggtggctcatgcctgtaatcccagcacttttggtggccgaggcgggcggatcacctgagtttaggagtttgagactatcctggccaatatggtgaaacccygtctctactgaaaatacaaaaattagctgcgtgtggtggtgggcgcctgtattaccagctactcgggaggctgagacagtagaattgcttgaacctggga

SEQ ID NO: 23066 - DNA, 201 bp, Homo sapiens
gcttaacaaatctctaggaagttgcaaattttcccccattttcttgtcttctgaactctccaaactcttccaacctctgcctgttacccagttccaaagchgtttccacattttcaagaatttttatagtaatacccaactcctggtaccgattttctgaattagttcattctcacacttttataaagaaatacctgagac

SEQ ID NO: 23067 - DNA, 201 bp, Homo sapiens
aaatttcccctttaaatatcagttccagtttcaggtcatgtctttgctcacacatatgtgcataggctattacaagcaggcaggccaaatctggaatgctwtgctgcttagaaatttcttccaccagatacccttatacatcactctcaagttcaaagttctacagatccctagggagggggaacaatgcctccaagttct

SEQ ID NO: 23068 - DNA, 201 bp, Homo sapiens
catctagcttagcatgatgccaataattttggcttgatgctgtagcccgaaatggttagctcgaattgagagacaagttattttcaaaaactggctatccratgggcattctataacacacttaacatcttttgttgtggtattgaatgagatgtgatagaagtgatttggacaccactatgattctaaatagcactgcta

SEQ ID NO: 23069 - DNA, 201 bp, Homo sapiens
gtcctcacaaggttgaaactcatcatggcagacattaaaacttaaagctctaaaataatctcctttgactctatatcttgaaccctgagcacactggctgstgcaagcaatggactcacaatgccatcttcagcctcatatccgtggctttggtgaacataatccatatagctgctctcatgggtgaacattgaatgctta

SEQ ID NO: 23070 - DNA, 201 bp, Homo sapiens
ttcatttacaaaaatgagaatctcatacttcagttaacacatctagcttagcatgatgccaataattttggcttgatgctgtagcccgaaatggttagctygaattgagagacaagttattttcaaaaactggctatccgatgggcattctataacacacttaacatcttttgttgtggtattgaatgagatgtgatagaa

SEQ ID NO: 23071 - DNA, 201 bp, Homo sapiens
tgcacctgtaaaattaaaaaaagttatttacttctaaaatattaatacaacagtggtagagacatttcctatacatttccattccaaaagaaataaatggrccaaaagaaatgaatgcagtgtcctcacaaggttgaaactcatcatggcagacattaaaacttaaagctctaaaataatctcctttgactctatatcttg

SEQ ID NO: 23072 - DNA, 201 bp, Homo sapiens
attgatgatagtttcttttgctgtgcagaaaaaaattgcctaatctgattgcttttcatttacaaaaatgagaatctcatacttcagttaacacatctagyttagcatgatgccaataattttggcttgatgctgtagcccgaaatggttagctcgaattgagagacaagttattttcaaaaactggctatccgatgggca

SEQ ID NO: 23073 - DNA, 201 bp, Homo sapiens
gccactacagataagcaaaaaaatcgtcacattctaaagctgtcctgggccacatgcatcccgagagctgcaggttggacaagcttgcatctagaatgtayacacgacaaggccagaaatttttctgtttttactttaacgatgttttctaaatgcaaaaacagtcaaatacctagcagacaacaaatgccacttgaatgg

SEQ ID NO: 23074 - DNA, 201 bp, Homo sapiens
tctttttatgctcttcataggtctctcacagaacaacagtttttagtgttgataagatccaatttattaacttttatggatcatacttttggtgttatgtytaagaactctttgtccagtcttagctctgatgactttttcttaaaaggtttgtaatttaaaaatttaaatttattatttattttagaaaaaaaattcttg

SEQ ID NO: 23075 - DNA, 201 bp, Homo sapiens
gtgttcagttttctcagtgaagtgggaagcaaggtcatcagctgaagtaagaatggggaaggcaggttggatgtgtgagcacaaagaaaaagtgtgtaagrgtcacccaggccaggaggaggctgagggtgagccatgcagggagagggtgattgctggccatggtagggacttcctatgtggtttggaatcctaaatttt

SEQ ID NO: 23076 - DNA, 201 bp, Homo sapiens
tgataagatccaatttattaacttttatggatcatacttttggtgttatgtctaagaactctttgtccagtcttagctctgatgactttttcttaaaaggyttgtaatttaaaaatttaaatttattatttattttagaaaaaaaattcttgcctaggctggccttgaactcctgggctcaagggatcctcccacctcagc

SEQ ID NO: 23077 - DNA, 201 bp, Homo sapiens
cccagggaagggcaacgtgacaggccggcgggacagccccaccgccgcgaagaggggctgcccaaaaggcaacagccataggagatgagcaggggtgcctrctgcgtcggagaactcatctccccaaccccaccgacgccacaaggtagagggcgaggacagcgaggtcggccggattccgcacccctgcctccaaccacc

SEQ ID NO: 23078 - DNA, 201 bp, Homo sapiens
tcattgggtttaagtctgtccattttcatttactgccttctaatattatctttcttgctcaactatttttcttctgttgccttctttagatgaataaaaavctttgcattattgtggtcttctcagtaagtgttctagttacaaattctcttattatttctttaattatctgagaaagcacaataatctgtgacttattat

SEQ ID NO: 23079 - DNA, 201 bp, Homo sapiens
gaggaaagaaaacaaactgtgagaggccagggaagaggcagggccatgagatcctagaggagtttccagaactgtgactgcagacccaggtcaggatcagraaacccgagggaagaggatgtgttgaagctgaaccaaatgtccttttgacatctgtcctcagcaggaacattctcctgacttgtgactgctgggagtcag

SEQ ID NO: 23080 - DNA, 201 bp, Homo sapiens
ctcaggcatcagcctccttcatacttacttgcagcctgagagtagctccctccttttctatctgtgggaagaaaatgtcctgtgagataccagaaaggagycagggccttaaggtcctagaggaacctccaagtcttggacctcagagaagtttccagaaatgtgtgactgcagacccagggcgggatcaggaaacatgaa

SEQ ID NO: 23081 - DNA, 201 bp, Homo sapiens
gaaatgcagtggcacaaacacaactcacttcagcctctacctgccaggcttaagcaattcctcccttctaggcctcttgagtagctgggactagaggttcrcgccaccatgcctggctaatttctgtattttttgtagagaaagggatttatcatgtttcccagacttgtctggaacgcctggggtcaagcaatctgccca

SEQ ID NO: 23082 - DNA, 201 bp, Homo sapiens
caagagatgttgtctcttaggtcaactatactggatgcctaaaagggtgaagctgtatgtccctgagaccattcttgtttttggaacctgataagattgartggtgtctgcaaagctgagtgatgtcattctgggagacatattcatacaagaggatgataaactggcctaattttgaatgaccgaatgagacttggataa

SEQ ID NO: 23083 - DNA, 201 bp, Homo sapiens
cttttccaccaacagtgtaaaagcattcctatttctctgcaaccttgccagcatctgttgtttcttgactatttaataattgccattctgactggcataaratggtatctcatttgtcgttttgatttgcatttctctaatgatcagtgatgggagctttctttttcatatttttgttggccacatgtatgtcttctttag

SEQ ID NO: 23084 - DNA, 201 bp, Homo sapiens
tcttgcctgaattcacttccttgcagatagaaaagaggtttccacttccttgttaagagccacccttagctcctagagccttctctcagatactcacacayggtgcctaaggcacattcaatcctcctgcttggaacttctgacctcccctctccagcttctcctctgccttcctcctctgcagaatctgactccaaccag

SEQ ID NO: 23085 - DNA, 201 bp, Homo sapiens
ccccatgggctcccaaacacaatatcccaaggacctcaggcatcagcctccttcatacttacttgcagcctgagagtagctccctccttttctatctgtgrgaagaaaatgtcctgtgagataccagaaaggagtcagggccttaaggtcctagaggaacctccaagtcttggacctcagagaagtttccagaaatgtgtg

SEQ ID NO: 23086 - DNA, 201 bp, Homo sapiens
gtggtgtgagcaagagatgttgtctcttaggtcaactatactggatgcctaaaagggtgaagctgtatgtccctgagaccattcttgtttttggaacctgwtaagattgaatggtgtctgcaaagctgagtgatgtcattctgggagacatattcatacaagaggatgataaactggcctaattttgaatgaccgaatgag

SEQ ID NO: 23087 - DNA, 201 bp, Homo sapiens
gatgggagccctctgtgcagcaggagtggatgcaggacctgcctggaagcaagaggatgagggaacctagttgggtcctgttccctgcctgcctgtgttcrcagggtaaccagtaagggagctggggtagggaattctttcataggttatctagccagagatatgtttatagacatgttctttcatgtttatattcaggtt

SEQ ID NO: 23088 - DNA, 201 bp, Homo sapiens
taatttctcaaaattcctgctttaaatgctgatgtccaataaagatgttcgtagtttcagctgggtcttaaaaggatttccaccaatactaatgttgtaayctatatcaaatgaaacaggaactcaaatgtggagctccctctccaggacggtccatgtgggagacagtggctgtggcagtggcaatccccaagtgcaaag

SEQ ID NO: 23089 - DNA, 201 bp, Homo sapiens
gggtggtgctgttcttggtcaaggcagcctcagctccacccaggtaaggcagtggtggcagagagagttaggggagcacctgtgaaaccgaccaaggcagrgatgggagccctctgtgcagcaggagtggatgcaggacctgcctggaagcaagaggatgagggaacctagttgggtcctgttccctgcctgcctgtgttc

SEQ ID NO: 23090 - DNA, 201 bp, Homo sapiens
gggcactgtcactgcctggggtagaacaaaaacagaacctggtcagatcccacagaagatgtggctagaggaggaattgtggggtgggtgagctcccccaygggctcccaaacacaatatcccaaggacctcaggcatcagcctccttcatacttacttgcagcctgagagtagctccctccttttctatctgtgggaaga

SEQ ID NO: 23091 - DNA, 201 bp, Homo sapiens
gaggaaaattcaatattagcttatctcctcaaaagtggtgtgagcaagagatgttgtctcttaggtcaactatactggatgcctaaaagggtgaagctgtrtgtccctgagaccattcttgtttttggaacctgataagattgaatggtgtctgcaaagctgagtgatgtcattctgggagacatattcatacaagaggat

SEQ ID NO: 23092 - DNA, 201 bp, Homo sapiens
ctaacttcctggtcttggggcacacagatgggtggtgctgttcttggtcaaggcagcctcagctccacccaggtaaggcagtggtggcagagagagttagrggagcacctgtgaaaccgaccaaggcagagatgggagccctctgtgcagcaggagtggatgcaggacctgcctggaagcaagaggatgagggaacctagt

SEQ ID NO: 23093 - DNA, 201 bp, Homo sapiens
tcagagccctgggcactgtcactgcctggggtagaacaaaaacagaacctggtcagatcccacagaagatgtggctagaggaggaattgtggggtgggtgrgctcccccatgggctcccaaacacaatatcccaaggacctcaggcatcagcctccttcatacttacttgcagcctgagagtagctccctccttttctatc

SEQ ID NO: 23094 - DNA, 201 bp, Homo sapiens
ctacgtagactggtggtcagatagcctgcactagttcctaacctatgtaacctactgtctatgatcaagagtagattaagagaagacatggtagaatactrttgctgcatgcagtctaggccagcacagcagccaaacctaatgtcacttctagaactggaaaagactgatataaagggacagaaggaggaatagtggctg

SEQ ID NO: 23095 - DNA, 201 bp, Homo sapiens
agactgactggggaggtgggatagttattgactctgttgcgtggttcctcctaacttcctggtcttggggcacacagatgggtggtgctgttcttggtcarggcagcctcagctccacccaggtaaggcagtggtggcagagagagttaggggagcacctgtgaaaccgaccaaggcagagatgggagccctctgtgcagc

SEQ ID NO: 23096 - DNA, 201 bp, Homo sapiens
aatctttgaggaatcgccacactgtcactgtcttccacaatggattaaccatttacttttccaccaacagtgtaaaagcattcctatttctctgcaacctygccagcatctgttgtttcttgactatttaataattgccattctgactggcataaaatggtatctcatttgtcgttttgatttgcatttctctaatgatca

SEQ ID NO: 23097 - DNA, 201 bp, Homo sapiens
agagacacatcagagccctgggcactgtcactgcctggggtagaacaaaaacagaacctggtcagatcccacagaagatgtggctagaggaggaattgtgrggtgggtgagctcccccatgggctcccaaacacaatatcccaaggacctcaggcatcagcctccttcatacttacttgcagcctgagagtagctccctcc

SEQ ID NO: 23098 - DNA, 201 bp, Homo sapiens
agactatcctggccaatatggtgaaaccccgtctctactgaaaatacaaaaattagctgcgtgtggtggtgggcgcctgtattaccagctactcgggaggytgagacagtagaattgcttgaacctgggaggcagaggttgcatgagccgagatcatactactgcactccagcctgggcgacagagtgagactccatctca

SEQ ID NO: 23099 - DNA, 201 bp, Homo sapiens
tcagttcagactgactggggaggtgggatagttattgactctgttgcgtggttcctcctaacttcctggtcttggggcacacagatgggtggtgctgttcktggtcaaggcagcctcagctccacccaggtaaggcagtggtggcagagagagttaggggagcacctgtgaaaccgaccaaggcagagatgggagccctct

SEQ ID NO: 23100 - DNA, 201 bp, Homo sapiens
tggttctaaatctttgaggaatcgccacactgtcactgtcttccacaatggattaaccatttacttttccaccaacagtgtaaaagcattcctatttctcygcaaccttgccagcatctgttgtttcttgactatttaataattgccattctgactggcataaaatggtatctcatttgtcgttttgatttgcatttctct

SEQ ID NO: 23101 - DNA, 201 bp, Homo sapiens
gagtttgagactatcctggccaatatggtgaaaccccgtctctactgaaaatacaaaaattagctgcgtgtggtggtgggcgcctgtattaccagctactygggaggctgagacagtagaattgcttgaacctgggaggcagaggttgcatgagccgagatcatactactgcactccagcctgggcgacagagtgagactc

SEQ ID NO: 23102 - DNA, 201 bp, Homo sapiens
aataaacggggaatgaggataagcaagcatcagcatctcccgccatcagttcagactgactggggaggtgggatagttattgactctgttgcgtggttcckcctaacttcctggtcttggggcacacagatgggtggtgctgttcttggtcaaggcagcctcagctccacccaggtaaggcagtggtggcagagagagtta

SEQ ID NO: 23103 - DNA, 201 bp, Homo sapiens
caggccatttcagaagtgcctcattaagtccaagccacactcaagagagggaattaagctgcacctctagaaaggaacagtatcaaaggatttgaatataygttaaaagcaaaattataactattgtttcaggtttctgaaaatcaaagtcttcttgtatctaattagttttcattaactctttaagcttgtcttttaatt

SEQ ID NO: 23104 - DNA, 201 bp, Homo sapiens
ctatacaagaaccagaaaaatggagattacaccaatttggactgttgagtcacatttctttacacaagaaaacacactttacagccttaaaaagccaacartgcacagggaaatgtactattcaggggaaactttgatagaatattgaaatggctgaccaggcgcggtggctcatgcctgtaatcccagcacttttggtgg

SEQ ID NO: 23105 - DNA, 201 bp, Homo sapiens
tcagcatcaggagaacagcatgggggcaccgcccccattatccaatcacctcccatgaggtccctcccccaataggtagggattacaatttgcataacaaytcaagatgagatttgggtgggagcacagaaccaggccatttcagaagtgcctcattaagtccaagccacactcaagagagggaattaagctgcacctcta

SEQ ID NO: 23106 - DNA, 201 bp, Homo sapiens
tttatgttttcctttttatctggatgcctttaacttttaattatttgccttattgcaccagctgcaatctccagtacaatgttaagtagaagtgttggatkggacatccttgcattgatctccatcttaggagaaaagcattcagtctttcttcagcaagcatgattttagttgtgggttttttatagatgccctttatca

SEQ ID NO: 23107 - DNA, 201 bp, Homo sapiens
gtgactcattttgagttatttttgtatgaagcatgaggttttggctcaggttattttttttccactgtggttgtccagttgttccatcaccatttgatggraaagctctccttccttcattgaattgcttttgtgcttttgtaaaagtcagttgagcatgttttgctcatttttagttgagttgctcatcttcttacattg

SEQ ID NO: 23108 - DNA, 201 bp, Homo sapiens
ggcctgtgataccacacctggctcaatgtttgccattttaactctgtgctttacatgaaagcttgtgactcattttgagttatttttgtatgaagcatgargttttggctcaggttattttttttccactgtggttgtccagttgttccatcaccatttgatgggaaagctctccttccttcattgaattgcttttgtgct

SEQ ID NO: 23109 - DNA, 201 bp, Homo sapiens
atgaagcagggaaaagccccttataaaaccatcagatctcatgagaattccctcagcatcaggagaacagcatgggggcaccgcccccattatccaatcamctcccatgaggtccctcccccaataggtagggattacaatttgcataacaattcaagatgagatttgggtgggagcacagaaccaggccatttcagaagt

SEQ ID NO: 23110 - DNA, 201 bp, Homo sapiens
ttagcttttaaatagacatttctggtctgtgttttatttcaagtgtctgggaacggatagagttgaggttcaagggagaatgagagctctgtctagatgcrttgacatagcacaaagaaatctcccctcctccctgatatctccccgccagttctcagggaaggacagattcagagcaacacagacaggtctggaaaggga

SEQ ID NO: 23111 - DNA, 201 bp, Homo sapiens
tccgcccaacacccaacacacatcaggccctccaagctctcacctttacaagctgtgagagacacatcagagccctgggcactgtcactgcctggggtagracaaaaacagaacctggtcagatcccacagaagatgtggctagaggaggaattgtggggtgggtgagctcccccatgggctcccaaacacaatatcccaa

SEQ ID NO: 23112 - DNA, 201 bp, Homo sapiens
tgcaaagaaaccccatagcacagctgtgtccactgttccgcccaacacccaacacacatcaggccctccaagctctcacctttacaagctgtgagagacayatcagagccctgggcactgtcactgcctggggtagaacaaaaacagaacctggtcagatcccacagaagatgtggctagaggaggaattgtggggtgggt

SEQ ID NO: 23113 - DNA, 201 bp, Homo sapiens
acgaagaataaataaacggggaatgaggataagcaagcatcagcatctcccgccatcagttcagactgactggggaggtgggatagttattgactctgttrcgtggttcctcctaacttcctggtcttggggcacacagatgggtggtgctgttcttggtcaaggcagcctcagctccacccaggtaaggcagtggtggca

SEQ ID NO: 23114 - DNA, 201 bp, Homo sapiens
cacctggactgaaatgcagtggcacaaacacaactcacttcagcctctacctgccaggcttaagcaattcctcccttctaggcctcttgagtagctgggaytagaggttcgcgccaccatgcctggctaatttctgtattttttgtagagaaagggatttatcatgtttcccagacttgtctggaacgcctggggtcaagc

SEQ ID NO: 23115 - DNA, 201 bp, Homo sapiens
tccaatgcaaagaaaccccatagcacagctgtgtccactgttccgcccaacacccaacacacatcaggccctccaagctctcacctttacaagctgtgagrgacacatcagagccctgggcactgtcactgcctggggtagaacaaaaacagaacctggtcagatcccacagaagatgtggctagaggaggaattgtgggg

SEQ ID NO: 23116 - DNA, 201 bp, Homo sapiens
aataaataaacagggaatgagtataagcaagcatcagcatctcccgccatcagttcagactgaggggagtttggactgaattaacgaagaataaataaacrgggaatgaggataagcaagcatcagcatctcccgccatcagttcagactgactggggaggtgggatagttattgactctgttgcgtggttcctcctaact

SEQ ID NO: 23117 - DNA, 201 bp, Homo sapiens
acttcattctggcttaagctcacactcctccaggaagtcagttactgtgaaggtcactaacatgctcagtattgtcatgtctccacctgtctttacttctytgtagctttcctcacactcaacgactcctttttattttgctcaatttctgtggattcacttcacaaattttattataaggtagttctagctagaagaaaa

SEQ ID NO: 23118 - DNA, 201 bp, Homo sapiens
gggcacatcatgggcctcaattgctaatgagttggacattcagaggtgtcggcagctggatctgccttggtaggggggagtcagtgctgttggccccataygtagcctcatgcctgccactgtggttgctccattcatgaactcatcctaccaaaccagggctgacccatggtgaaggctggctaacttccatttgtctgt

SEQ ID NO: 23119 - DNA, 201 bp, Homo sapiens
gattgaattaatgaagaataaataaacagggaatgagtataagcaagcatcagcatctcccgccatcagttcagactgaggggagtttggactgaattaamgaagaataaataaacggggaatgaggataagcaagcatcagcatctcccgccatcagttcagactgactggggaggtgggatagttattgactctgttgc

SEQ ID NO: 23120 - DNA, 201 bp, Homo sapiens
cattgtatgactgaatcatgatttttgtacattggcagttatttcttgttttttactattataaataaagaaactatgaacatttttatgcagggattatygacaaaatcttcatttctcttgagtatatacctaggagtggaaatggtagctgtagaggactagcttgtttaactttattagatgatatgaaattgattt

SEQ ID NO: 23121 - DNA, 201 bp, Homo sapiens
cactacagtgcactttctacctgctgctcatccagccaggtcaacaggaagttgtcaatgatatgagctgatttaatatcctattggatatccagtatgtytagtatagtcttaagactatactatagaggtcaggggagttacaatagccctgagacaaatgataaatcaatgttttgaggatcccacatgaatgtgaat

SEQ ID NO: 23122 - DNA, 201 bp, Homo sapiens
ctcagcttcctgagtagctgagagtacaggcctgtgataccacacctggctcaatgtttgccattttaactctgtgctttacatgaaagcttgtgactcaytttgagttatttttgtatgaagcatgaggttttggctcaggttattttttttccactgtggttgtccagttgttccatcaccatttgatgggaaagctct

SEQ ID NO: 23123 - DNA, 201 bp, Homo sapiens
gggagtttggattgaattaatgaagaataaataaacagggaatgagtataagcaagcatcagcatctcccgccatcagttcagactgaggggagtttggamtgaattaacgaagaataaataaacggggaatgaggataagcaagcatcagcatctcccgccatcagttcagactgactggggaggtgggatagttattga

SEQ ID NO: 23124 - DNA, 201 bp, Homo sapiens
tgaactgacacctttaagtagatgataagggatggcaattggggcaccagaagagggtctggctctggctgggagcagaagggttaacccacaacagtccstcacatggtaaaacgcctgacatgtggtgcagctgcaaatgcatgagcagacagtggtggaatctgtgaagttgtcttctaatgtgttcagttttctcag

SEQ ID NO: 23125 - DNA, 201 bp, Homo sapiens
cagcatctcccaccatcagttcagactgaggggagtttggattgaattaatgaagaataaataaacagggaatgagtataagcaagcatcagcatctcccrccatcagttcagactgaggggagtttggactgaattaacgaagaataaataaacggggaatgaggataagcaagcatcagcatctcccgccatcagttca

SEQ ID NO: 23126 - DNA, 201 bp, Homo sapiens
ggaaagaggtttaattgactcacagttctgcatgactgaggcggctgccccaggaaacttacagtcatggcagaagtggaagcaaacccgtccttcttcaygtggtgacaggagagagaaatgcacaatgaagcagggaaaagccccttataaaaccatcagatctcatgagaattccctcagcatcaggagaacagcatg

SEQ ID NO: 23127 - DNA, 201 bp, Homo sapiens
aacaactcttgcctctcagtcccacacaaggcagctgtctcacactatagaaaaaaatattcatgaacaaattcatatctgtcacagtgaggggtcacacyttaaacagcccatcgcatgctcaatacatccaatgcaaagaaaccccatagcacagctgtgtccactgttccgcccaacacccaacacacatcaggccct

SEQ ID NO: 23128 - DNA, 201 bp, Homo sapiens
tgtggttttaatttgtattttcctactggataatgatgttgagcacctattcatctgcttattagcccagtatttatcctcttcagtgaaatgtctgttcrtgtcttgctcattgcctgttttgtatttggatttcatttttattgttgtttaaaatttcttcatatattctgaatacagtctttacagaatatgttgcct

SEQ ID NO: 23129 - DNA, 201 bp, Homo sapiens
cggggaatgaggataagcaagcatcagcatctcccaccatcagttcagactgaggggagtttggattgaattaatgaagaataaataaacagggaatgagkataagcaagcatcagcatctcccgccatcagttcagactgaggggagtttggactgaattaacgaagaataaataaacggggaatgaggataagcaagca

SEQ ID NO: 23130 - DNA, 201 bp, Homo sapiens
gactctggggaagaatccacttccaagctcattcaggttcttgcctgaattcacttccttgcagatagaaaagaggtttccacttccttgttaagagccayccttagctcctagagccttctctcagatactcacacacggtgcctaaggcacattcaatcctcctgcttggaacttctgacctcccctctccagcttctc

SEQ ID NO: 23131 - DNA, 201 bp, Homo sapiens
agggcaggaacaactcttgcctctcagtcccacacaaggcagctgtctcacactatagaaaaaaatattcatgaacaaattcatatctgtcacagtgaggrgtcacactttaaacagcccatcgcatgctcaatacatccaatgcaaagaaaccccatagcacagctgtgtccactgttccgcccaacacccaacacacat

SEQ ID NO: 23132 - DNA, 201 bp, Homo sapiens
tctcatcactgtggttttaatttgtattttcctactggataatgatgttgagcacctattcatctgcttattagcccagtatttatcctcttcagtgaaatgtctgttcatgtcttgctcattgcctgttttgtatttggatttcatttttattgttgtttaaaatttcttcatatattctgaatacagtctttacagaat

SEQ ID NO: 23133 - DNA, 201 bp, Homo sapiens
taatcttcaccttctgtagtgcacacgttttgccaaagaattcagcgtactttcctcctcttactcatccatcccaatctatgtgatattgccaatgaaahgaagagatttagtattctgtgagatgtctgatttgtccagatctcttaaggtgatatttatagaaggttgaggagttaaagtagccctgaggcaagctat

SEQ ID NO: 23134 - DNA, 201 bp, Homo sapiens
aataaataaacggggaatgaggataagcaagcatcagcatctcccaccatcagttcagactgaggggagtttggattgaattaatgaagaataaataaacrgggaatgagtataagcaagcatcagcatctcccgccatcagttcagactgaggggagtttggactgaattaacgaagaataaataaacggggaatgagga

SEQ ID NO: 23135 - DNA, 201 bp, Homo sapiens
taaagaaatacctgagactgggtaatttataaaggaaagaggtttaattgactcacagttctgcatgactgaggcggctgccccaggaaacttacagtcayggcagaagtggaagcaaacccgtccttcttcacgtggtgacaggagagagaaatgcacaatgaagcagggaaaagccccttataaaaccatcagatctca

SEQ ID NO: 23136 - DNA, 201 bp, Homo sapiens
ttcattacatgagtaatatcccttttgccacgcaatgcaacctgttcacaggttccaacgattaagactggacatctttggggaccattactcagcccacsacatctgcgtatgttgaagtcaccaagagtcaaggagacagcaatgctggagagggtgacagtgaaccaggagctacaagactcaggattgagaagaaca

SEQ ID NO: 23137 - DNA, 201 bp, Homo sapiens
gtcacaaagggaagggcaggaacaactcttgcctctcagtcccacacaaggcagctgtctcacactatagaaaaaaatattcatgaacaaattcatatctrtcacagtgaggggtcacactttaaacagcccatcgcatgctcaatacatccaatgcaaagaaaccccatagcacagctgtgtccactgttccgcccaaca

SEQ ID NO: 23138 - DNA, 201 bp, Homo sapiens
ctgctggggagattggattgaattaatgaagaataaataaacggggaatgaggataagcaagcatcagcatctcccaccatcagttcagactgaggggagwttggattgaattaatgaagaataaataaacagggaatgagtataagcaagcatcagcatctcccgccatcagttcagactgaggggagtttggactgaat

SEQ ID NO: 23139 - DNA, 201 bp, Homo sapiens
agtattagtccattctcacactgccataaagaaatacctgagactgggtaatttataaaggaaagaggtttaattgactcacagttctgcatgactgaggmggctgccccaggaaacttacagtcatggcagaagtggaagcaaacccgtccttcttcacgtggtgacaggagagagaaatgcacaatgaagcagggaaaa

SEQ ID NO: 23140 - DNA, 201 bp, Homo sapiens
aggcaccgtctcctcacaggctcacacatgcacggtgtgtgcacagagcttttgctctagttcaggaggtgtgtagggagcctcactagtccaacagagcytggtaccagtgtcatatgccaggaaccaaggttataagggatacaatgtccccagacctaccagagaaggcaaactcatacagcttgcaggaccagacaa

SEQ ID NO: 23141 - DNA, 201 bp, Homo sapiens
tttggttgttcagtgccacttcagacttgggtattttctctgggtgtaaacatgggattcaagctcaacccaggtggaccattttcacctcatgatggatrctgttgggcctgtctaatctatgactctgtgggtcacacaggcactcgaaccacatagttgcttggtgtcccgtggtcaagcattctatctaatcaggac

SEQ ID NO: 23142 - DNA, 201 bp, Homo sapiens
cttcaagtcacaaagggaagggcaggaacaactcttgcctctcagtcccacacaaggcagctgtctcacactatagaaaaaaatattcatgaacaaattcrtatctgtcacagtgaggggtcacactttaaacagcccatcgcatgctcaatacatccaatgcaaagaaaccccatagcacagctgtgtccactgttccgc

SEQ ID NO: 23143 - DNA, 201 bp, Homo sapiens
tgagcacgaatacatgggagcaccatgaatttatttacatgtctttacttcacagttgttttgaggaggctttcactgagaaacctaacagaaatgaatayatatgacttcctataaaatgaaatttaagtaaaattatactttttaaaatgttaagactggagcaagactggaacatcaccagacaaacagaaacatagg

SEQ ID NO: 23144 - DNA, 201 bp, Homo sapiens
ggattttcgtgaacataaagtattcccttgtttgaaataagtgcctaggagggcaattgctagtcataaggtaaattgcatgttcggtttgaagaaaactrcaatactcatttccagagtggctgtaccattttaaaatacatccctaccagcaatataagagtgtcccagttcctctgcgtccttgccagcatctgttgc

SEQ ID NO: 23145 - DNA, 201 bp, Homo sapiens
gcatgcccctaaccactggacccataacacttcactgcagtggccactcttgaagctctgtaaggttaatcttcaccttctgtagtgcacacgttttgccraagaattcagcgtactttcctcctcttactcatccatcccaatctatgtgatattgccaatgaaatgaagagatttagtattctgtgagatgtctgattt

SEQ ID NO: 23146 - DNA, 201 bp, Homo sapiens
tggcactattctataagttagaagtattagtccattctcacactgccataaagaaatacctgagactgggtaatttataaaggaaagaggtttaattgacycacagttctgcatgactgaggcggctgccccaggaaacttacagtcatggcagaagtggaagcaaacccgtccttcttcacgtggtgacaggagagagaa

SEQ ID NO: 23147 - DNA, 201 bp, Homo sapiens
gcaggagttgggttccgggacgcgggatccggcttctctgggaatcttggattccaggaaggatcctggagatctcccactttatgaagcccaatctccastcactgtgatggcgtctttagaccccactggaaaccagatacgacgccctcatcggccctggggaaaaaacaagagcaaagtatgagaggtggccatgag

SEQ ID NO: 23148 - DNA, 201 bp, Homo sapiens
ttgttttcacagtaataccaagatgccatctgcctgtttcattgtgttgacttttccattagtgctgcaaatgccaaggtcggtagcacacccagcacctmagcagaaccaggcagtggctccaaactgcagtcccatttaagagtgtctttgatggagcagtaaaaaatttatgtggattaaagtttgatccttgagtat

SEQ ID NO: 23149 - DNA, 201 bp, Homo sapiens
ccaatgttcaggggttgaccctgtgggaggacacctgccttcagagttagagcccacatgtgatgatgtagagctgaagggtgatatcagggaggtgatgragagtgctttggggtttcctgattatgaagagcagaggtcagtctgcttcctgggtgaagtgactgctggggagattggattgaattaatgaagaataaa

SEQ ID NO: 23150 - DNA, 201 bp, Homo sapiens
gtggaagccgcagttagttttatgttctacacccagagtcacaaactgttatgttggcactattctataagttagaagtattagtccattctcacactgcyataaagaaatacctgagactgggtaatttataaaggaaagaggtttaattgactcacagttctgcatgactgaggcggctgccccaggaaacttacagtc

SEQ ID NO: 23151 - DNA, 201 bp, Homo sapiens
ttggtatatgatattaacacatagaattgtatactgttactttggtttccagcaattgctgattaggtcatttggaccacttctcccattgagtacaactrgaaaaatgggaggaaaatacatatttgaaaagtctggttgaatttatagatgggctagcaaagcagtgaagatttgcttggccaggaaccaggaagaggc

SEQ ID NO: 23152 - DNA, 201 bp, Homo sapiens
gtcctggaggcaggcttgttttcacagtaataccaagatgccatctgcctgtttcattgtgttgacttttccattagtgctgcaaatgccaaggtcggtarcacacccagcacctcagcagaaccaggcagtggctccaaactgcagtcccatttaagagtgtctttgatggagcagtaaaaaatttatgtggattaaagt

SEQ ID NO: 23153 - DNA, 201 bp, Homo sapiens
cacatggctgttggaaaaggcctggttccttgttgtctgttcccagaaggcctcagttctcagtcatgtggaccttcctgcagggctgcttatggcacagyggctggcttcccccagagctcatgatcccagattcagagagagagagaaggtggaagccgcagttagttttatgttctacacccagagtcacaaactgtt

SEQ ID NO: 23154 - DNA, 201 bp, Homo sapiens
ataatatgccaatacctctttactgttacaatcctttttcctgtaaaagatatgtggtcaaagaaaagtgggcaatctgagttatcacaaaaacatttagwctttgtccctggtttctcctaaaaaccttagactctcttgagtgataagagtgtctttagagtactgatgagaagactcttggctgagtggatcctggat

SEQ ID NO: 23155 - DNA, 201 bp, Homo sapiens
attcatgaggcacaagtgcaattttgctacattgctatattggttgtggtaaagtcagggccttcagagcatccagcactggagacaagcacattgtaccmatcaagaaacccctctattatacaccaactgccaacccccttacccttctgggtctccatggtccatcatttcacactctccttttatgtatataaagag

SEQ ID NO: 23156 - DNA, 201 bp, Homo sapiens
catctatacaaaaaattagaaaattagccaggcatggtagttcatgatggtagtcgcagctactcaggaggctgaggtcagagagtcccttgaccccaggmgttcgacactgcagtgcatggtgatcatgccactgcattccagcctgggtgacagagcaagaccctgtctcaaaaataataatgatgatgatgacacatt

SEQ ID NO: 23157 - DNA, 201 bp, Homo sapiens
atgtttaagttactttggaatagctcagtcacaaaatcttaatctcttaatttgtgctgcctctctacacggacacacacacacaggcggacacacacacmggcacacacacacattcacacacatgctatacaaacatgtctacctgtatctataaagagacatgttatgttattttattttttatttcttaaattcata

SEQ ID NO: 23158 - DNA, 201 bp, Homo sapiens
aaatacatcctcttcagccatggaaattgtccttactttttaaaactaagttacatgtttaatatcttataattaatttaggccaggtgtggtggctcacrtctgtcatcctagcactgtggaaggcagaggaatggagatttgttgactccagaagttcaagatcagcctgggcaaaacctccatctatacaaaaaatta

SEQ ID NO: 23159 - DNA, 201 bp, Homo sapiens
actgctggggagattggattgaattaatgaagaataagtgagctgggattgaggatgagtaaagcaagcatcagcatctcccgccatcagttcagactgaytggggaggtgggatagttcctgaccttgttgtgtggttcctcctaacttcctggtcttggggacacagatgggtggtgctgttcttggtcagggcagcct

SEQ ID NO: 23160 - DNA, 201 bp, Homo sapiens
tgctctttgaatcatctgtgaatcatggacaaacacctccatgctagcaacattactgaaatgcagggaggaacaagtgattcaattgggaggaaaaaaarcaaagtgatgacatttactcctagacaaaactttttaggaaaatgtatcttaaaagtaggagaaaaacatataatacctgcaatcccctgcaaaagaagc

SEQ ID NO: 23161 - DNA, 201 bp, Homo sapiens
ggagtttcactcttgttgctcaggctggagtgtaggggcgggatctcagctcacttgatctcagctgcttggttcagctccatctagcatctttccccacrctgtcacccccagcaccaggggactgagagttgatgacctggtacaccaccgcctggatctgctgcagtgtcctttcctgtctagtccgcactcaaagct

SEQ ID NO: 23162 - DNA, 201 bp, Homo sapiens
gtgtttaattgggacacagttggaaagtgaagttcaagtaacgtgatcattgtgaatggtcataaaatacatcctcttcagccatggaaattgtccttacyttttaaaactaagttacatgtttaatatcttataattaatttaggccaggtgtggtggctcacgtctgtcatcctagcactgtggaaggcagaggaatgg

SEQ ID NO: 23163 - DNA, 201 bp, Homo sapiens
gctgtgtgacctcaggagaagctctctgctctttgaatcatctgtgaatcatggacaaacacctccatgctagcaacattactgaaatgcagggaggaacmagtgattcaattgggaggaaaaaaagcaaagtgatgacatttactcctagacaaaactttttaggaaaatgtatcttaaaagtaggagaaaaacatataa

SEQ ID NO: 23164 - DNA, 201 bp, Homo sapiens
tgctattccttggcattgtcactgaagatttttacaataatacccaaatcacagtttgacctgtatttttttaacttccccatacagagaactcacaccghatgtatattatgtgttggggagttatctctgatgtgggagggtgcttatccttttaatttttttttctttttgagatggagtttcactcttgttgctcag

SEQ ID NO: 23165 - DNA, 201 bp, Homo sapiens
tttgctattccttggcattgtcactgaagatttttacaataatacccaaatcacagtttgacctgtatttttttaacttccccatacagagaactcacachgcatgtatattatgtgttggggagttatctctgatgtgggagggtgcttatccttttaatttttttttctttttgagatggagtttcactcttgttgctc

SEQ ID NO: 23166 - DNA, 201 bp, Homo sapiens
ttcattcgtatctctgcaaaggacttgatctcattcctttttatggttgcataatattccgtggtgtatatgtaccatattttctttatccagttcctcayttgtgggcatttgggttgattccatgtctttgctattgtgaatagtgctgcaatgaacatacacatgcatatacctttataatagaatgatttatattcc

SEQ ID NO: 23167 - DNA, 201 bp, Homo sapiens
gctttcaatttttggggggtatacacccaaaagtggaattgttgcttcatatggaaattctatgtttaccttcttgagaaagcgtcatcctgtttccatgrtggctgcactgttgttcactctcagcagcagtgcacaagcattccattttctccacatcctcaccaacacctggactagtgaagctgagcatattttcat

SEQ ID NO: 23168 - DNA, 201 bp, Homo sapiens
gtagttgtattatcacaggtgagctttatgagtgagtgtcctggtgacggctcctccaggggagccaaggaccaactttcctggcacgttgaggtcccctygccctgtcacactctcctgcattaccccattctactctgtcttcatattttatactatagatatttagcttttaaatagacatttctggtctgtgtttta

SEQ ID NO: 23169 - DNA, 201 bp, Homo sapiens
caccccgtctgggaggtaaggagcgtctctccccggccgccccgtctgagaggtgaggagcccctccgcccagcagccaccccgtctgggaagtgaggagygtctctgcccggcagccgccccgtccaggagggaggtggggggcagcccccgcccggccagccacctcgtccaggaggtggggggcgcctctgcccggcc

SEQ ID NO: 23170 - DNA, 201 bp, Homo sapiens
gccttttatcattgttaaacaaagttgtcattaggcataaacttgcatgttaactgaagcttttgtttttattttattcgaagttacaattgcacataatkgaaagagtaaatatttgcgcaggacttcctgagaaaaacgagtcttctctgcctttctagggagagtcctctcttctctgtttctgcctttctagggagc

SEQ ID NO: 23171 - DNA, 201 bp, Homo sapiens
tttatagacatattctttcaagtttgtattcagggttgatgtcacatacacatttatacatgctgttttatgtttaagtgtttttatattttggttagccytttatcattgttaaacaaagttgtcattaggcataaacttgcatgttaactgaagcttttgtttttattttattcgaagttacaattgcacataattgaa

SEQ ID NO: 23172 - DNA, 201 bp, Homo sapiens
ccatgttggtgcacgtatcagtagttctttcattttcattgctgataatattccattgtatgactgaatcatgatttttgtacattggcagttatttcttrttttttactattataaataaagaaactatgaacatttttatgcagggattatcgacaaaatcttcatttctcttgagtatatacctaggagtggaaatgg

SEQ ID NO: 23173 - DNA, 201 bp, Homo sapiens; identical to SEQ ID NO: 4286
  misc_feature (1)...(201): n = A,T,C or G, or insertion/deletion polymorphism (see Tables 1-2)

SEQ ID NO: 23174 - DNA, 201 bp, Homo sapiens
catctggggccaatgttcaggggttgaccctgtgggaggacacctgccttcagagttagagcccacatgtgatgatgtagagctgaagggtgatatcaggraggtgatggagagtgctttggggtttcctgattatgaagagcagaggtcagtctgcttcctgggtgaagtgactgctggggagattggattgaattaatg

SEQ ID NO: 23175 - DNA, 201 bp, Homo sapiens
aatacctatgtgatcaacccatgttggtgcacgtatcagtagttctttcattttcattgctgataatattccattgtatgactgaatcatgatttttgtamattggcagttatttcttgttttttactattataaataaagaaactatgaacatttttatgcagggattatcgacaaaatcttcatttctcttgagtatat

SEQ ID NO: 23176 - DNA, 201 bp, Homo sapiens; identical to SEQ ID NO: 4287

SEQ ID NO: 23177 - DNA, 201 bp, Homo sapiens
ggctttttgcgcttgttgtaatacctatgtgatcaacccatgttggtgcacgtatcagtagttctttcattttcattgctgataatattccattgtatgaytgaatcatgatttttgtacattggcagttatttcttgttttttactattataaataaagaaactatgaacatttttatgcagggattatcgacaaaatct

SEQ ID NO: 23178 - DNA, 201 bp, Homo sapiens
gtgtgctgctctccagcctcctgcagctcatgggggcaggctcagcataggcagaggtggaacccaccagctgtgtagttttgccaggtgagtgtgacaaytcaagggagagggaagggagggatggaaattatttaccatagaattcaaaatgggtgaggagggaggacaggacacccagggtgagggacagtgagtaga

SEQ ID NO: 23179 - DNA, 201 bp, Homo sapiens; identical to SEQ ID NO: 4289

SEQ ID NO: 23180 - DNA, 201 bp, Homo sapiens
aaagggctgggaagagatggggagacatctggggccaatgttcaggggttgaccctgtgggaggacacctgccttcagagttagagcccacatgtgatgaygtagagctgaagggtgatatcagggaggtgatggagagtgctttggggtttcctgattatgaagagcagaggtcagtctgcttcctgggtgaagtgactg

SEQ ID NO: 23181 - DNA, 201 bp, Homo sapiens
aatttctcaaaattcctgctttaaatgctgatgtccaataaagatgttcgtagtttcagctgggtcttaaaaggatttccaccaatactaatgttgtaacstatatcaaatgaaacaggaactcaaatgtggagctccctctccaggacggtccatgtgggagacagtggctgtggcagtggcaatccccaagtgcaaagg

SEQ ID NO: 23182 - DNA, 201 bp, Homo sapiens; identical to SEQ ID NO: 4290

SEQ ID NO: 23183 - DNA, 201 bp, Homo sapiens
tggaaggttctcatgtgttccatttattttgtctctcaaattttaggaatcttctcctttaattaactcatcaacctctcatggcaagaatttgagaaagkaaatttatactcaggttctaattttaatagggaaggaagaagttacagctcagtgcaccatgaagttgagacagagatggagacacctcagccccacctc

SEQ ID NO: 23184 - DNA, 201 bp, Homo sapiens
ggagaccaccagggcagtgcacagctgagatctcagtctctggtgtcagctcctgggttcgctggctccactgagggcaactagactctgcagccaggcgrtctggattcaactccttgcctaggcctcaccagcatgttctctctttgtgcctcattttcctcatctatgacatggggaaactacgagcatttatttctt

SEQ ID NO: 23185 - DNA, 201 bp, Homo sapiens
agatagagtgtgaggttcaggagagaaggagaggtctgtcttgatgctttgacacagcaccaagaaatttcccctcctcccccacatcgccccgccagttstcagtgagggacagattcacagcagtactgaaagggctgggaagagatggggagacatctggggccaatgttcaggggttgaccctgtgggaggacacct

SEQ ID NO: 23186 - DNA, 201 bp, Homo sapiens
aggagctgcttgttgaggccatcatagaatcagcctagcaagggttggatcttccttttgtgtttaattgggacacagttggaaagtgaagttcaagtaamgtgatcattgtgaatggtcataaaatacatcctcttcagccatggaaattgtccttactttttaaaactaagttacatgtttaatatcttataattaatt

SEQ ID NO: 23187 - DNA, 201 bp, Homo sapiens
cctgggtcctttcactcactgcacaatggatggtggacacagggcaggtgctgatgttgatggagtcacgggaggggactggcaggggctggaaaagtgcsatgggagggagaaaaaagtggggacgtcatcttccgtcagagaaagggtaaatctgatttgggagtgactgaggagggagaactcctcagggaataaaaa

SEQ ID NO: 23188 - DNA, 201 bp, Homo sapiens
gccggaacagaaactgggcacagccccatctactctcctcccctgcaacaaatcagcataagcaacacgtggactctggaaggttctcatgtgttccattwattttgtctctcaaattttaggaatcttctcctttaattaactcatcaacctctcatggcaagaatttgagaaagtaaatttatactcaggttctaattt

SEQ ID NO: 23189 - DNA, 201 bp, Homo sapiens
tcactgtgtcagggctggtcaggcttgagaggaggaggaaagggcactgagtttcctcttgggtcttgttccttagtcctgggtcctttcactcactgcamaatggatggtggacacagggcaggtgctgatgttgatggagtcacgggaggggactggcaggggctggaaaagtgccatgggagggagaaaaaagtgggg

SEQ ID NO: 23190 - DNA, 201 bp, Homo sapiens
ccatggtggccggaacagaaactgggcacagccccatctactctcctcccctgcaacaaatcagcataagcaacacgtggactctggaaggttctcatgtsttccatttattttgtctctcaaattttaggaatcttctcctttaattaactcatcaacctctcatggcaagaatttgagaaagtaaatttatactcaggt

SEQ ID NO: 23191 - DNA, 201 bp, Homo sapiens
ggacatggagacagggccagggcctctctttggggaggcctctcactgtgtcagggctggtcaggcttgagaggaggaggaaagggcactgagtttcctcbtgggtcttgttccttagtcctgggtcctttcactcactgcacaatggatggtggacacagggcaggtgctgatgttgatggagtcacgggaggggactgg

SEQ ID NO: 23192 - DNA, 201 bp, Homo sapiens
gagccccagggcttcctgataggatctctagttaggagctgtctgctcagagctgggaggggaggaacagtgagctgctggtggagggcagaacccacagygtgcagggcctgccctggtatgcaggtgcctctgcaggtgaagagggcctggggtctcaggaagagaaggactgtgtgtgacttggcccagacctggaag

SEQ ID NO: 23193 - DNA, 201 bp, Homo sapiens
agcaagggggtccccagcatcaggtcaggtgcagactccatggcagccacatatttccatgcagggcctgtgagccccagggcttcctgataggatctctwgttaggagctgtctgctcagagctgggaggggaggaacagtgagctgctggtggagggcagaacccacagtgtgcagggcctgccctggtatgcaggtgc

SEQ ID NO: 23194 - DNA, 201 bp, Homo sapiens
ctccttgagcaagggggtccccagcatcaggtcaggtgcagactccatggcagccacatatttccatgcagggcctgtgagccccagggcttcctgatagkatctctagttaggagctgtctgctcagagctgggaggggaggaacagtgagctgctggtggagggcagaacccacagtgtgcagggcctgccctggtatg

SEQ ID NO: 23195 - DNA, 201 bp, Homo sapiens
gcctccttgagcaagggggtccccagcatcaggtcaggtgcagactccatggcagccacatatttccatgcagggcctgtgagccccagggcttcctgatrggatctctagttaggagctgtctgctcagagctgggaggggaggaacagtgagctgctggtggagggcagaacccacagtgtgcagggcctgccctggta

SEQ ID NO: 23196 - DNA, 201 bp, Homo sapiens
ggaatccaaggagaggtggtgcctctagtcccttcctctctgcatccccctcccctgtttctccagccatcaggaggacatcaagaaaaagacccacgagrcccagaatgagggcccccatgtgtacagcccctttgaggtccccttgtaacagggagagtcctgagtgcacatggccatcctctgtccactttgcagctc

SEQ ID NO: 23197 - DNA, 201 bp, Homo sapiens
caggcctgggctgacccatggtgaaggctggctaactgccatttgtctgtttggttgttcagtgccacatcacacttgggtgttttctgtgggtgtcaacrtgggattcaagctcaacccaggtggaccattttcacctgttgatgaatgctgttgggcctgtgcaatttatgactttgtgggtcacacagccacttggaa

SEQ ID NO: 23198 - DNA, 201 bp, Homo sapiens
agggagagaaagaaggaggaattgaggaaggagtgaaagaagaaaagaaggaaggggaaggggaagaaaaaggacggaaaggaggaagggagaaggagggbgagagattgaatggaattaaagagggaaggagggacagaaggaaagagaaaaagaaggaacaaaggagaaaagaaactaaaataaagaaaagaataggcg

SEQ ID NO: 23199 - DNA, 201 bp, Homo sapiens
aaagaaggaggaattgaggaaggagtgaaagaagaaaagaaggaaggggaaggggaagaaaaaggacggaaaggaggaagggagaaggagggcgagagatwgaatggaattaaagagggaaggagggacagaaggaaagagaaaaagaaggaacaaaggagaaaagaaactaaaataaagaaaagaataggcgttgggaac

SEQ ID NO: 23200 - DNA, 201 bp, Homo sapiens
ggaattgaggaaggagtgaaagaagaaaagaaggaaggggaaggggaagaaaaaggacggaaaggaggaagggagaaggagggcgagagattgaatggaaktaaagagggaaggagggacagaaggaaagagaaaaagaaggaacaaaggagaaaagaaactaaaataaagaaaagaataggcgttgggaactggaaaccc

SEQ ID NO: 23201 - DNA, 201 bp, Homo sapiens
ttactgctgaaggcttacatatggttataccacaatttcactagtttcctattgatgtatatgtggctgattccagtttttgccataaatattagtgtgcrtgtctcctgtgcacataggcaagaaagccccccagagtggatgattaggaatgggttggttggatgatacgttgtatggactttaaccatactagataat

SEQ ID NO: 23202 - DNA, 201 bp, Homo sapiens
atatcaggggtcatggtggacatgagggtgggctggtctctccacttctcacatgttaccagggacatagacacattcagatgccttggcagaaagagaaracagaggcccttgaagtctcaaagtggagccatgaacaaatcttgcatctcagtccctcacaaggcagtcttggaaagaaaatagtcgtgaacaaattca

SEQ ID NO: 23203 - DNA, 201 bp, Homo sapiens
ctttgcaattagaaaaatgtgagtctcacatctttgtctgtacaactggcttagcatcatgacaatgatttggtttgatgtggtaggtggaaatggttaamttcaatctaggaacaagatttttcagtaactggctattcagtgggcatcctgtgatcagtttaacatctttcactgtggtttttaattagatgtggtaga

SEQ ID NO: 23204 - DNA, 201 bp, Homo sapiens
caccttttactaacctttcccaaaactccatgaaggttgagcccctttggctgctactctgggttctcacagtaaccgtgccctctatcttttgcaggtcrctgcaaaggagggttcctaaagcattcactcctgatcctgagggaggtgggtgcactcactccaggtctcaggtccgccacagaaaagcaaaaactcctc

SEQ ID NO: 23205 - DNA, 201 bp, Homo sapiens
tcagatctcatgagaattccctcagtatcacgagaacagcatgggggcaccgcccccattatccaatcacctcccatgtggtccctcccccaataggtagsgattacaattcgcataacaattcaagatgagatttgggtgggaacacagaaccaggccatatcagaagtgcctcattaagtccaagccacactcaggaga

SEQ ID NO: 23206 - DNA, 201 bp, Homo sapiens
tttgttaaggtagcctcagggcaaatgctgttttgtggcagctaaagaacaacatcatctcatgtggacatcgatgccgccagtgcttttctcaccaggastgcttgtgtgtcctccctccctccctacctcctcccacaccaaccctcctgcacactgcagcacacaaccatatttttctcttcaggaaagataacccta

SEQ ID NO: 23207 - DNA, 201 bp, Homo sapiens
actacaatccaggaaagagccctgggaggagggcaagagctggacaggtctgaaaattagtctcttgataccacaatgagatttgtatgcagggaccaccstaggtgacatccaagtccctgtgatcacaggtggtggtgggacaaggttctactgaagggccaaggagaatgaaggagcaaagatgacccagctgagcag

SEQ ID NO: 23208 - DNA, 201 bp, Homo sapiens
ggtctcactatgtttcccaggctagtcttgaactcccaggctcaaacaattctcctgtctcatcatcccaaagtgccaggattacaggtatgtgccactgbgcctggctcttccagttttgtgtactcttcaatttccttcatcagtgccttatagtttttgttttacttcctggggtaaattgattcttagttattttat

SEQ ID NO: 23209 - DNA, 201 bp, Homo sapiens
agagccctgggaggagggcaagagctggacaggtctgaaaattagtctcttgataccacaatgagatttgtatgcagggaccaccgtaggtgacatccaastccctgtgatcacaggtggtggtgggacaaggttctactgaagggccaaggagaatgaaggagcaaagatgacccagctgagcagtgaccacataaagtc

SEQ ID NO: 23210 - DNA, 201 bp, Homo sapiens
tccatactggcctgagcacccactaggcacagccccatctattctcctcccctgcaacaaatcagcacaagaaacacatggactctggaaggttctcatgkgttccatttattttgtctctcaaattttaggaatcttctcctttaattaagtcatcaacctctcatggcaagaatttgaaaaagtaaatgtttactcaga

SEQ ID NO: 23211 - DNA, 201 bp, Homo sapiens
ctaccaggcctgggctgacccatggtgaaggctggctaactgccatttgtctgtttggttgttcagtgccacatcacacttgggtgttttctgtgggtgtmaacatgggattcaagctcaacccaggtggaccattttcacctgttgatgaatgctgttgggcctgtgcaatttatgactttgtgggtcacacagccactt

SEQ ID NO: 23212 - DNA, 201 bp, Homo sapiens
caaaacatcaaattcaaagaaccccatagcacagctgtgtccactgttcccccccaacaccccccacacatcaggccccccaaggtctcacctttcacgcygtgagagacacatcagagccctgggcactgttgccgcctggagtagaataaaaacaggacctggtcagatcccacagtagatgtggctagaggaagaatt

SEQ ID NO: 23213 - DNA, 201 bp, Homo sapiens
ccctcggcatgggccctgtccctctcccttcacttttcatccaggaatctccgtccctgaactggactccctgtccacctggactcttctagaagaaaaghcacccacggagtttggtgacagagagtgagcttgctctgggaatggaggtgtagaaactgttttttgttttcctttttttttttttttttattgggaaaa

SEQ ID NO: 23214 - DNA, 201 bp, Homo sapiens
ttggatagcagaaccttggtaacccctgaatgatcaggaatctaatcggtaaaaaatgtgactttggccccatgatgtataaatgtgcccaaaagcgttasaacaggactcacaaagcttctaagtttcacttttgcagtgtacctgtgactcccgcttgtcatattttaaatttgccatcattccatagctctgagtttc

SEQ ID NO: 23215 - DNA, 201 bp, Homo sapiens
gatagggattgaattgaatctgtaaattgctttgggtagtatgaacattttaacaatattctcccaatttatgtgcatgaaatttatgtgtctcatttttwaaattaatatttaacaatattaattctcccaatttatgtgttttattttttttcttagagacaaggtctcactatgtttcccaggctagtcttgaactcc

SEQ ID NO: 23216 - DNA, 201 bp, Homo sapiens
cccatggtggccggaacagaaactgggcacagccccatctactctcctcccctgcaacaaatcagcataagcaacacgtggactctggaaggttctcatgygttccatttattttgtctctcaaattttaggaatcttctcctttaattaactcatcaacctctcatggcaagaatttgagaaagtaaatttatactcagg

SEQ ID NO: 23217 - DNA, 201 bp, Homo sapiens
gaaggacagattcagagcaacacagacaggtctggaaagggatggggggacatctgaagcaaatgttcagggcctgaagctgtgagagtacacctgccctrcagagttggagccctcatgtgatgatgcagagctgaagtgttatattctggaggggataaaaagtgctctggggtttcctgattatgaagggtaggggtc

SEQ ID NO: 23218 - DNA, 201 bp, Homo sapiens
ccagtggctctaccatttagtagtcctggcaggggtcctgttgctgcagctccgctaagaattttcctgggtattaaatttccccatttaaatatcagttycagtttcgggtcatttctttgctcacacatatgcacataggctattacaggcagccagaccaaatcctgaattctatgctactgagaaatttcttccatc

SEQ ID NO: 23219 - DNA, 201 bp, Homo sapiens
tgccaatgtttgttaaggatgttttcatttatgtttattggtgacactggtgtatggcactcttttcctgtgagtcttgctgtgactttgatatgagggtratgccagttctgtaaatgggctggaaagtcttccctcctctcttcttgtctgaaagagctttcaaaatatttgatagaattcaccagtgaagatatctgg

SEQ ID NO: 23220 - DNA, 201 bp, Homo sapiens
cacaggtcttggtgggacaaggttctactgaagggccaaggacaatggagcagcaaagatgacccagccaagcagtgaccacataaagcccatggtggccrgaacagaaactgggcacagccccatctactctcctcccctgcaacaaatcagcataagcaacacgtggactctggaaggttctcatgtgttccatttatt

SEQ ID NO: 23221 - DNA, 201 bp, Homo sapiens
cagcagcacctatattagagttggttgaataatggggggaaggtgaatgaccaggagcttgttgttgaggccatcatagaatcagcctagcaagggctggrtcttctttttgtgttcacttgggacacagttgcaaattgaagttcaagtaaagtaatcattgtgaacggtaataaaatacatccttttcagccacgaaaa

SEQ ID NO: 23222 - DNA, 201 bp, Homo sapiens
actatctcagagggagcaaatagtaaaggcagatgtgatctagggagggctagaaactggagaggaatccaaggagaggtggtgcctctagtcccttcctytctgcatccccctcccctgtttctccagccatcaggaggacatcaagaaaaagacccacgaggcccagaatgagggcccccatgtgtacagcccctttga

SEQ ID NO: 23223 - DNA, 201 bp, Homo sapiens
caggaacatcctgagagagggtgtggaggttttgttgatcattgactgagattccagggggtgcactgggaagatttctgtggttcgggaggttggggagmcagaatagtggtgtgcagagccttgtggggatgtgagtgcagagtatgtgggggacccagtgtcactgacacaaacagggaaaggacatgatgagctgag

SEQ ID NO: 23224 - DNA, 201 bp, Homo sapiens
gctttgtccccatcccggtctctgtctctcaggcttaccaggttgcatccaggtgggtgagttgggaattgcgtgctgattgctgagggcctggatgatcrctatctcagagggagcaaatagtaaaggcagatgtgatctagggagggctagaaactggagaggaatccaaggagaggtggtgcctctagtcccttcctc

SEQ ID NO: 23225 - DNA, 201 bp, Homo sapiens
catccatcctcatgagccaatcacgtcccaccaagcaccacctccaacattagggattacaagtgagcatgagatttgggtggggacacagatccaaacartatcaggggtcatggtggacatgagggtgggctggtctctccacttctcacatgttaccagggacatagacacattcagatgccttggcagaaagagaaa

SEQ ID NO: 23226 - DNA, 201 bp, Homo sapiens
ctgtggcctcctcctgctgcaggtgaggagtgggcagcagggagggccgtggtgcctgctttgtccccatcccggtctctgtctctcaggcttaccaggtygcatccaggtgggtgagttgggaattgcgtgctgattgctgagggcctggatgatcactatctcagagggagcaaatagtaaaggcagatgtgatctagg

SEQ ID NO: 23227 - DNA, 201 bp, Homo sapiens
aatgtgatggtcaagccctgtgccacctggaaggggatagagggtaggataggactagaagacccaaagagggaagactctcagagggaaggatgaggatrtaaagtgtgaaaagatacagaaagtaaggaggtgggagagtgggtgtccctctgggtgtggggcttaactgctgcaggtaggtctcagaatcctcatgca

SEQ ID NO: 23228 - DNA, 201 bp, Homo sapiens
aatgcattgtgattgtctcaggactctttaaacatttgacttatgtccctaatggctgcacttagttgataagaaagggtacaattatctatgttgcaagytagcctaaactacattttttggtgaggtggggaaggggtcgttgagggggccccaaccgataggtgcctggccagtgcatgaaagggaaagcaagaagta

SEQ ID NO: 23229 - DNA, 201 bp, Homo sapiens
ttattccctagtgcgcaactccctcccccagttgctcattagctgagtaccaaggacttacgatcttcccggatgtcacctattggtagtttaagacttcwagtatgttccttagggttttttttttttttgctgcattttgttgcagcccataatgcattgtgattgtctcaggactctttaaacatttgacttatgtcc

SEQ ID NO: 23230 - DNA, 201 bp, Homo sapiens
gagaacagcaaaagtgagagtgttagtgacggttttgcaatattgggtgtctggaatgcaggcacaccagggagagtttcaacaatttattccctagtgckcaactccctcccccagttgctcattagctgagtaccaaggacttacgatcttcccggatgtcacctattggtagtttaagacttcaagtatgttccttag

SEQ ID NO: 23231 - DNA, 201 bp, Homo sapiens
gagatccccatataggcaactagattatgagaaacaaacgcacccatccaaacccaaagaatggactctgagacccagagaacagcaaaagtgagagtgtyagtgacggttttgcaatattgggtgtctggaatgcaggcacaccagggagagtttcaacaatttattccctagtgcgcaactccctcccccagttgctca

SEQ ID NO: 23232 - DNA, 201 bp, Homo sapiens
tttattaatctgctctaccagtgatatccagacaacataaaagctgcaattataactcctacttggccatacctagagtaatctcattcattctttaggcmtcatcaggctccctcagggacagtttgctggattacgtagagacgatagacagccccaacaccaccccacatccttcagctctctcatggtgatgtgacc

SEQ ID NO: 23233 - DNA, 201 bp, Homo sapiens
gttcacccataaaacttcacttcagtggccactcttgaagctctgtaaggtttaccttcaccttctggagtgtgcttgttttgccaaggactccagtgcastttctacctgctgctcatccaccccagtaaacatgaaattgtcaatgaaatgagctgatttaatatcctataggatatccagtatgtctagtgtagtctt

SEQ ID NO: 23234 - DNA, 201 bp, Homo sapiens
ggttcagctccatcctgcatctttccccaccactggcaccaccagccccaaggggtctgagggatgctggctgcttgtaccatggcctggatctgctgcarggtcctttcctgtgtgggccccacatgaaggtggcctcctcctatgtcacctagagtgtgggccaaagcaacacacctaaatgtggaatgtggtgtcatc

SEQ ID NO: 23235 - DNA, 201 bp, Homo sapiens
cccaataggccccagtgtgtgttgttcctctccctgtgtccatgtgttctcattactcagttcccaattataaatgagaacatgtggtgtttggttttccrttcctgtgtgagtttgctgaggataatggcttccagcttcatccatatccctgcaaaggacttgatctcattcctttttatggctgcataatattccatg

SEQ ID NO: 23236 - DNA, 201 bp, Homo sapiens
ccccaaagcccccagagtggatgattaggaatgggttggttgcatgatacattgtatggactttaaccatactagataatgataatatgatttccaaagtrattgtggctacttaaacttttacaataaatgtgtaatacttgatgttgatgatgtgttctgaaaacactgagttgaaggaattgtgttaaaagtcaccgt

SEQ ID NO: 23237 - DNA, 201 bp, Homo sapiens
ttttcacctcatgatggatgctgttgggcctgtctaatctatgactctgtgggtcacacaggcactcgaaccacatagttgcttggtgtcccgtggtcaarcattctatctaatcaggacaagggacactaaaagttgcttctaataggtggcatatgtctctgctgtgaatgacatgaccttactccagaatcccaggcc

SEQ ID NO: 23238 - DNA, 201 bp, Homo sapiens
ctgtcaccgtgttcaggggaaggaccgagcctcactcccacgcagagaggaggctctggttgtaactgctccagtggagagatgaggacctcctccctctrcactgatggccaaagcctgcagactgggccaggcttcccctcagctatgtcctgtcaggttcatccaggactcaagaaataaactgtggacattgtctcc

SEQ ID NO: 23239 - DNA, 201 bp, Homo sapiens
cctgccctccttgtgtgatagcagccctgcctcctcctcttctcacctgcttgtatctggacacatactattcaaacatccctgggggcagccataatgtrtatttccatggactctcatttaaatgtctccttgccagggtgccccctttgggaaaccaggacctcctcccctacagagcccagatattggagatgagaa

SEQ ID NO: 23240 - DNA, 201 bp, Homo sapiens
acagagccttgggtgctgcagggaaaacagtttgagacagagaaaggagaaacaacagtatctctgcgtttctcttgtaaatacctttaataacaatgttyttcaataagttaacacagttgagaacatagagtaactagatcaaatagttccaagacttcagtgccataagaatgatgccttgaaaataagtctttgttt

SEQ ID NO: 23241 - DNA, 201 bp, Homo sapiens
gccgcagtgagttttaggttctacacccagagttacaaaccattatgtcagcattattctataagttagaagttatattagtccattctcacactgctatraagaaatacctgagactgggtaatttataaaggaaagaggtttaattgactcacagttctgcatggctgaggagcctgccccaggaaacttacagtcatg

SEQ ID NO: 23242 - DNA, 201 bp, Homo sapiens
cgaactcctgatctcgtgatccacaggcctcgacttcccaaagtgctaggatcacagaagtgagccaccgtgcccggccagctgcggctttgttttactaygagtagttatcgcaaaggatgcttgtgatgaactttggcattttcttttctctttcatttccaaataatcaatcaggaatggcacacaaggtgcattttg

SEQ ID NO: 23243 - DNA, 201 bp, Homo sapiens
ataaaaccatcagatctcatgagaattccctcagtatcacgagaacagcatgggggcaccgcccccattatccaatcacctcccatgtggtccctcccccwataggtagcgattacaattcgcataacaattcaagatgagatttgggtgggaacacagaaccaggccatatcagaagtgcctcattaagtccaagccaca

SEQ ID NO: 23244 - DNA, 201 bp, Homo sapiens
agggaaaccagaaggcccccaggtggatctctggtttccacacacacttccgccctcattgtgtgaaagtagccatgccttctcctgaagatgaggatctrttacctgggcctggagaggaggagaatcctcttttcaccaggtggtctctgggcacaaactatcaaaacttctctcgtgacaaccataatgtgtagttca

SEQ ID NO: 23245 - DNA, 201 bp, Homo sapiens
gacagccctgcatgcccctaaccactggacccataacacttcactgcagtggccactcttgaagctctgtaaggttaatcttcaccttctgtagtgcacaygttttgccaaagaattcagcgtactttcctcctcttactcatccatcccaatctatgtgatattgccaatgaaatgaagagatttagtattctgtgagat

SEQ ID NO: 23246 - DNA, 201 bp, Homo sapiens
caagcagtgatatccagccagcatggcagctgcaatcaggactcctacttggtcaagtctggagtaattccattcattctttatcaggcttcttcagggayagactgctgaattatatggagataataggcaatcccaacaccaccccccatccttcagctctctaatggcagtgccacccctacaatacctgcagtaccc

SEQ ID NO: 23247 - DNA, 201 bp, Homo sapiens
acctgagctcttcttcctccacattacagcagcgaccacagctccagtgaccacagctacaagtagaaccaggccagcaacgatgcccacgatggggatgktgggctgggaagatggctctgggaaaaggggggaaggtgagggaccctgaccctgctaaagctctccagagaggctccggctttccctaagggacatgac

SEQ ID NO: 23248 - DNA, 201 bp, Homo sapiens
agagagaagtgcagaatgaagcagggaaaagccccttataaaaccatcagatctcatgagaattccctcagtatcacgagaacagcatgggggcaccgccyccattatccaatcacctcccatgtggtccctcccccaataggtagcgattacaattcgcataacaattcaagatgagatttgggtgggaacacagaacca

SEQ ID NO: 23249 - DNA, 201 bp, Homo sapiens
agagtatgtgggggacccagtgtgactgacacaaacagggacagagcatgatgagctcagtccaggtgcactccaggccgacgatggtgctgagcctgtgrgagatgcgggaggaggagcaggggtggctttcacctgggctctgtccatggaggtgaggacagtgaggtggttgggtcttagtgctgtggggaacttttc

SEQ ID NO: 23250 - DNA, 201 bp, Homo sapiens
aaggggaaaatgtggcatggtgagaataaggcatgaaaaggaaaaagtgaggcaggagcacacggcacacatgcagatgctggtgtactgtgtgggttcasaggacagacttgggagtgggggaagagatgtaatatgatgaaagaaaacagataccccacataacggtcagaaaaacatcccaacacggcatcaaagacc

SEQ ID NO: 23251 - DNA, 201 bp, Homo sapiens
ttctatcaaatcaggacaagtaacactaaatgttgcttctaacagggggcatatgtctctgctgtggatgacatgatcttactccagaatcccaggccctycattgtgactctcccactggtgcttggttcagctccatcctgcatctttccccaccactggcaccaccagccccaaggggtctgagggatgctggctgct

SEQ ID NO: 23252 - DNA, 201 bp, Homo sapiens
cctgcagtctcctcctgaagcgtggtcacatgccagaatgggctagtcccctactgtgtctgttcaactaaggggaaaatgtggcatggtgagaataaggmatgaaaaggaaaaagtgaggcaggagcacacggcacacatgcagatgctggtgtactgtgtgggttcagaggacagacttgggagtgggggaagagatgt

SEQ ID NO: 23253 - DNA, 201 bp, Homo sapiens
tggaccattttcacctgttgatgaatgctgttgggcctgtgcaatttatgactttgtgggtcacacagccacttggaaccacattgttgtttggtgtctcwtggtcaagcattctatcaaatcaggacaagtaacactaaatgttgcttctaacagggggcatatgtctctgctgtggatgacatgatcttactccagaat

SEQ ID NO: 23254 - DNA, 201 bp, Homo sapiens
ctccttcacccccaacctgcagtctcctcctgaagcgtggtcacatgccagaatgggctagtcccctactgtgtctgttcaactaaggggaaaatgtggcmtggtgagaataaggcatgaaaaggaaaaagtgaggcaggagcacacggcacacatgcagatgctggtgtactgtgtgggttcagaggacagacttgggag

SEQ ID NO: 23255 - DNA, 201 bp, Homo sapiens
ggtggaccattttcacctgttgatgaatgctgttgggcctgtgcaatttatgactttgtgggtcacacagccacttggaaccacattgttgtttggtgtcycttggtcaagcattctatcaaatcaggacaagtaacactaaatgttgcttctaacagggggcatatgtctctgctgtggatgacatgatcttactccaga

SEQ ID NO: 23256 - DNA, 201 bp, Homo sapiens
tggcaggggtcctgttgctgcagctccgctaagaattttcctgggtattaaatttccccatttaaatatcagttccagtttcgggtcatttctttgctcamacatatgcacataggctattacaggcagccagaccaaatcctgaattctatgctactgagaaatttcttccatcagatacccttaatcatcactctcaag

SEQ ID NO: 23257 - DNA, 201 bp, Homo sapiens
cccacacataatgcagatgcacttgtgtttcatttttagttatgttaaaaattctgacaatcaggaatgggggttcaggagtggtgctgaggcagaggacrgaagccagggggtgggggaagaggatgtcaggggtggggtcagtagagtctccttcacccccaacctgcagtctcctcctgaagcgtggtcacatgccag

SEQ ID NO: 23258 - DNA, 201 bp, Homo sapiens
tagggcacatcatgggctccaaatgctgacgagttgacattcaggagtggcagtagctggatctaccttggtagggctgggagagtcagtgctgctggccycatacatagcctcatgcctgccactgtggttgctccattcatgcacccatcctaccaggcctgggctgacccatggtgaaggctggctaactgccatttg

SEQ ID NO: 23259 - DNA, 201 bp, Homo sapiens
ggagagagcacccacacataatgcagatgcacttgtgtttcatttttagttatgttaaaaattctgacaatcaggaatgggggttcaggagtggtgctgargcagaggacagaagccagggggtgggggaagaggatgtcaggggtggggtcagtagagtctccttcacccccaacctgcagtctcctcctgaagcgtggt

SEQ ID NO: 23260 - DNA, 201 bp, Homo sapiens
tgcgtgtcgtccacgtagcccacggcgatgaagcggggctccccgcggccgggccgggacacggatgtggtgaaatacctcatggagtgggagcctggggrcgaggagtggctgagacccacccgaccctcctcccggcgcggctacccgggtcctgcgtccccgccgggcgggccccttgcttctccccgcagaggcggt

SEQ ID NO: 23261 - DNA, 201 bp, Homo sapiens
atagtgccccactagggcacatcatgggctccaaatgctgacgagttgacattcaggagtggcagtagctggatctaccttggtagggctgggagagtcastgctgctggccccatacatagcctcatgcctgccactgtggttgctccattcatgcacccatcctaccaggcctgggctgacccatggtgaaggctggct

SEQ ID NO: 23262 - DNA, 201 bp, Homo sapiens
ttcttctcacattgcaaaatataataatctactcccaattgtcccaaatgtgttaggttgttccagcatcaactcaaaattctagagtctcatctgagacdcaaggtaaattcttatagctttgagcctgtaaaatttttttaaaaaatgttatttgcatctaaaatattaataaaacagtggaagagacatttcttgtac

SEQ ID NO: 23263 - DNA, 201 bp, Homo sapiens
accccaaataaaataaagggagagagcacccacacataatgcagatgcacttgtgtttcatttttagttatgttaaaaattctgacaatcaggaatggggrttcaggagtggtgctgaggcagaggacagaagccagggggtgggggaagaggatgtcaggggtggggtcagtagagtctccttcacccccaacctgcagt

SEQ ID NO: 23264 - DNA, 201 bp, Homo sapiens
gtcgtccacgtagcccacggcgatgaagcggggctccccgcggccgggccgggacacggatgtggtgaaatacctcatggagtgggagcctgggggcgagsagtggctgagacccacccgaccctcctcccggcgcggctacccgggtcctgcgtccccgccgggcgggccccttgcttctccccgcagaggcggtttccc

SEQ ID NO: 23265 - DNA, 201 bp, Homo sapiens
atgagcctatttctgtgaagatgaacctctggcccttccaggatggaagtagctaaatgtagtcacttgttacttagtggctggtcgccgaaagaaatagygccccactagggcacatcatgggctccaaatgctgacgagttgacattcaggagtggcagtagctggatctaccttggtagggctgggagagtcagtgct

SEQ ID NO: 23266 - DNA, 201 bp, Homo sapiens
cagggcaccaaggccttacaggaatttaccctgggccatgccctaaaataacctcaccccaaataaaataaagggagagagcacccacacataatgcagakgcacttgtgtttcatttttagttatgttaaaaattctgacaatcaggaatgggggttcaggagtggtgctgaggcagaggacagaagccagggggtgggg

SEQ ID NO: 23267 - DNA, 201 bp, Homo sapiens
acccatggaatatgagcctatttctgtgaagatgaacctctggcccttccaggatggaagtagctaaatgtagtcacttgttacttagtggctggtcgcckaaagaaatagtgccccactagggcacatcatgggctccaaatgctgacgagttgacattcaggagtggcagtagctggatctaccttggtagggctggga

SEQ ID NO: 23268 - DNA, 201 bp, Homo sapiens
gagcaccgcctagcctgcagatcaggaatgtcaacagcacccggagagtggtgctggctgagtgtcagagcaagacaggaaaacccacccatggaatatgrgcctatttctgtgaagatgaacctctggcccttccaggatggaagtagctaaatgtagtcacttgttacttagtggctggtcgccgaaagaaatagtgcc

SEQ ID NO: 23269 - DNA, 201 bp, Homo sapiens
agttgtgcctatagaagacctgtccagcattccttgtggctggtagctcctgggtggtgcagatggtgataggattagtggaacccacagccatggaaacwttaaaactttccaggccaaatgggtccttcaggcagagaatgggctaggagcaccgcctagcctgcagatcaggaatgtcaacagcacccggagagtggt

SEQ ID NO: 23270 - DNA, 201 bp, Homo sapiens
accttttgatttctggacccacatgttcttccattgagaacacagcaccatagagacatctctgattcaaacaatataccatgttctgaaagatggcactytcagagtgcttcctccaggctggcactgagttgtgcctatagaagacctgtccagcattccttgtggctggtagctcctgggtggtgcagatggtgatag

SEQ ID NO: 23271 - DNA, 201 bp, Homo sapiens
cattccttgctatctgcccttttgctacaggagataaagacctgtccatgagacactgccgagggtgtcaaatgtagccagtcatagctgtcaacaatccrcagattctcattatctttttacacagcatcgatgcagctgagaagtaactagccaaagccactgtctttgtaggtttcttccaaccctgtccttattatg

SEQ ID NO: 23272 - DNA, 201 bp, Homo sapiens
atgaaaagtgttagtatatatgaggtgtttgcagctgtgccatattatttttgttattttgttatgattttattatattttaatacattaatgtcatgtarttgtattatcacaggtgagctttatgagtgagtgtcctggtgacggctcctccaggggagccaaggaccaactttcctggcacgttgaggtcccctcgcc

SEQ ID NO: 23273 - DNA, 201 bp, Homo sapiens
atgagacagaaaatgctgggaaagccactggaccacaaagcaactctgagcctcagtgatgtagagagtgcaggaaggtcagctggaagcatcctagaccstgtgcaggctaagggaagttcagtaagggtggcagggagccctggagcttcagtcagccttcagaagaggaatgtcctgccttagtttctgccctacttt

SEQ ID NO: 23274 - DNA, 201 bp, Homo sapiens
agtttctgccctactttcctcaatcattggctggaaaaagccaggggtgggcatagtctcagagcaaatgtggcaatagatttcagacttcaagagctggrgccatcatcaattctgcttcttctagatgaggggctgggatgtgcattctcatgactgccacaatgatccagtggggagagaggaaaaaggttgacgata

SEQ ID NO: 23275 - DNA, 201 bp, Homo sapiens
tgcagccaggcggcctggattgaacgccctgcccaggtctcaccagcactttttctcttgctggctcagctttctcatctatgaaatagggaatgtaacarcatttatttcttgtggttgggtggatgaaaagtgttagtatatatgaggtgtttgcagctgtgccatattatttttgttattttgttatgattttattat

SEQ ID NO: 23276 - DNA, 201 bp, Homo sapiens
ctctgtccatggaggtgaggacagtgaggtggttgggtcttagtgctgtggggaacttttcttgacctcctgatgactggatggagtgtctgagggaggargggtcttacaggattgactcatgaccctgagggatgtgctcactccaggtctcaggtctgtcctgacacctttatttgtggcttagagctccctactgta

SEQ ID NO: 23277 - DNA, 201 bp, Homo sapiens
ggagttagttcattttggagtttataacttaaagcagaaattcagatggttgaaatgtcattttcatgaaggtttgttattagtgtatcatttagattgtyttgcaaaagtctcattttttttctaaagggttgccaatcttgttttaaatttacaaaggttgttaatttatcttcactgttaattggttgtgggttgttt

SEQ ID NO: 23278 - DNA, 201 bp, Homo sapiens
gttcattttggagtttataacttaaagcagaaattcagatggttgaaatgtcattttcatgaaggtttgttattagtgtatcatttagattgttttgcaamagtctcattttttttctaaagggttgccaatcttgttttaaatttacaaaggttgttaatttatcttcactgttaattggttgtgggttgtttaaactta

SEQ ID NO: 23279 - DNA, 201 bp, Homo sapiens
aaggtttgttattagtgtatcatttagattgttttgcaaaagtctcattttttttctaaagggttgccaatcttgttttaaatttacaaaggttgttaatytatcttcactgttaattggttgtgggttgtttaaacttatactgtgtagttttacatatctgtaacagcagtagtttgggcctcttatattctaataatt

SEQ ID NO: 23280 - DNA, 201 bp, Homo sapiens
agaaaacaaactgtgagaggccagggaggaggcagggcatgagatcctagagaagtttccagaactgtgactacagacccaggtcaggatcagaaaacccragggaagaggatgtgttgaggctggaccagttgtcctcctgaggtctgtcctcagcagggaccttcccctgacctgtgactgctgggagtcaggttccca

SEQ ID NO: 23281 - DNA, 201 bp, Homo sapiens
accccacaaagggctggcaattggcaggtagtgggggagccagggctctgcagtcttagtcccatccctctttgacctcacagcagggcaccaaggccttrcaggaatttaccctgggccatgccctaaaataacctcaccccaaataaaataaagggagagagcacccacacataatgcagatgcacttgtgtttcattt

SEQ ID NO: 23282 - DNA, 201 bp, Homo sapiens
gtgcccacagcaccctccatgcctggaactaatgtgcaccacccccaggagccccaggatcagaaacaccccagcatctcccaggccagagaaagcagaaragaccccacaaagggctggcaattggcaggtagtgggggagccagggctctgcagtcttagtcccatccctctttgacctcacagcagggcaccaaggcc

SEQ ID NO: 23283 - DNA, 201 bp, Homo sapiens
ttgtgcagggcattctatcaccccacctgccatagcttcccctaaccagggcatcctctcagctcagcactggtgagacccatagcagctcggctgcatchtgtgctatggaatttctgtgtctcccacaaccctggtggcatcctcttggcctgccaggcagtgggcaagcttttttcaaattctcatttttgcctgttt

SEQ ID NO: 23284 - DNA, 201 bp, Homo sapiens
catgagacactgcagaggctgtcacatgtagccagtgacagctgttaacaatctgcagattctcatgatactttcacagggcatcattgcagctgagcagyaaccagccaactccactgtctttgtaggtttccccctaaccccgtcattattgtgcagggcattctatcaccccacctgccatagcttcccctaaccagg

SEQ ID NO: 23285 - DNA, 201 bp, Homo sapiens
atgtgccctttatcttttgcaggtcactgaaaaggagggttcctaaagcattcactcctgaccctgagggaggtgggtgcactcactccaggactcaggtkcaccacagataagcaaaaaagtcctcacattcaaaattgtcctgggccacatgcagcccacgagccgcgggttggacaagcctgcatctagaacgtatgc

SEQ ID NO: 23286 - DNA, 201 bp, Homo sapiens
tggacatggagccatacctgcttccaccttttgatttctggacccacatgttcttccattgagaacacagcaccatagagacatctctgattcaaacaatrtaccatgttctgaaagatggcactctcagagtgcttcctccaggctggcactgagttgtgcctatagaagacctgtccagcattccttgtggctggtagc

SEQ ID NO: 23287 - DNA, 201 bp, Homo sapiens
gcccattgttgggagataaaaaaggcaaaataccttagtgggtgaatctaagagattggacatggagccatacctgcttccaccttttgatttctggaccyacatgttcttccattgagaacacagcaccatagagacatctctgattcaaacaatataccatgttctgaaagatggcactctcagagtgcttcctccagg

SEQ ID NO: 23288 - DNA, 201 bp, Homo sapiens
tcttttgtctacttttaagggtaccctcctttggaaaccaggacctcctaacccgcacagcccattgttgggagataaaaaaggcaaaataccttagtggrtgaatctaagagattggacatggagccatacctgcttccaccttttgatttctggacccacatgttcttccattgagaacacagcaccatagagacatct

SEQ ID NO: 23289 - DNA, 201 bp, Homo sapiens
attccgtggaaaattctagtccctgaggagggaacagcgacttctggtcctgacctgagtggaggctgagggactcagaagagctggactcagacccccasgcacattgagtgtgaagcagagaacaaggcctgagaggaaaagtcacggggcccaaggctgctgccagtgtcaaagggaaccactcatcagtattccagg

SEQ ID NO: 23290 - DNA, 201 bp, Homo sapiens
taaagtaatgtgtagttcaatgggctctcttttgtctacttttaagggtaccctcctttggaaaccaggacctcctaacccgcacagcccattgttgggasataaaaaaggcaaaataccttagtgggtgaatctaagagattggacatggagccatacctgcttccaccttttgatttctggacccacatgttcttccat

SEQ ID NO: 23291 - DNA, 201 bp, Homo sapiens
ggatgattctgctcacacttacaatggggcaaggggacccagaaggttcccaggtggatgtctggtttccacacacacttctgccctcattgtgtgaaagyagccatgcctcctcctggggatgagggcctattacctgggcctggagagaaggacactcctcttctcacgatgtggtctctgggaacatgctctccaaac

SEQ ID NO: 23292 - DNA, 201 bp, Homo sapiens
ccacggcgatgaagcggggctccccgcggccgggccgggacacggatgtggtgaaatacctcatggagtgggagcctgggggcgaggagtggctgagaccyacccgaccctcctcccggcgcggctacccgggtcctgcgtccccgccgggcgggccccttgcttctccccgcagaggcggtttccccacgaccccgcact

SEQ ID NO: 23293 - DNA, 201 bp, Homo sapiens
cacaggagcagggccttgggagattacccaggagtgtgactcaaacctgctgcccagatgggtctgggttcttggaaatcaaatcctctcaggctaaattkctggatgattctgctcacacttacaatggggcaaggggacccagaaggttcccaggtggatgtctggtttccacacacacttctgccctcattgtgtgaa

SEQ ID NO: 23294 - DNA, 201 bp, Homo sapiens
gggctccccgcggccgggccgggacacggatgtggtgaaatacctcatggagtgggagcctgggggcgaggagtggctgagacccacccgaccctcctccmggcgcggctacccgggtcctgcgtccccgccgggcgggccccttgcttctccccgcagaggcggtttccccacgaccccgcactcacccgcccaggtctg

SEQ ID NO: 23295 - DNA, 201 bp, Homo sapiens
atgtcagagcacaggagcagggccttgggagattacccaggagtgtgactcaaacctgctgcccagatgggtctgggttcttggaaatcaaatcctctcargctaaattgctggatgattctgctcacacttacaatggggcaaggggacccagaaggttcccaggtggatgtctggtttccacacacacttctgccctca

SEQ ID NO: 23296 - DNA, 201 bp, Homo sapiens
cggccgggccgggacacggatgtggtgaaatacctcatggagtgggagcctgggggcgaggagtggctgagacccacccgaccctcctcccggcgcggcthcccgggtcctgcgtccccgccgggcgggccccttgcttctccccgcagaggcggtttccccacgaccccgcactcacccgcccaggtctgggtcagggcc

SEQ ID NO: 23297 - DNA, 201 bp, Homo sapiens
ggacagaaggagagaaggtttactggatgtttcctagaccacaggcaatctaaggagagttgagcaaggccatggaggagacccggagccaccattggccrtcagaggagtcccctgtctcccaggaatgtcctgccttagtgtcactggtgtgagccatcactgactgggaacagcccatgggaagcagggcctccatac

SEQ ID NO: 23298 - DNA, 201 bp, Homo sapiens
atgcaagtgtgacccccagtgatggacagaaggagagaaggtttactggatgtttcctagaccacaggcaatctaaggagagttgagcaaggccatggagragacccggagccaccattggccatcagaggagtcccctgtctcccaggaatgtcctgccttagtgtcactggtgtgagccatcactgactgggaacagcc

SEQ ID NO: 23299 - DNA, 201 bp, Homo sapiens
ggacagaaggaaggagaaagggaaggaacaaaaaagaaaagaaactaaaataaagaaaagaatacacgttgagaaactagaaaccctacgtatggccagtrttatgaaaatggaaggaaataaagcagatgtacgtaacctgtatagaataatggaaatgtaagagggcttcattagttatccattgccgcataacaaact

SEQ ID NO: 23300 - DNA, 201 bp, Homo sapiens
ttcttcagggacagactgctgaattatatggagataataggcaatcccaacaccaccccccatccttcagctctctaatggcagtgccacccctacaatayctgcagtaccctcctgaagtcccacctggggcgcaatattgcttctggcttggctgggatgagggaagttttagatgattccctttgggcttcagcacaa

SEQ ID NO: 23301 - DNA, 201 bp, Homo sapiens
tggggatggtgggctgggaagatggctctgggaaaaggggggaaggtgagggaccctgaccctgctaaagctctccagagaggctccggctttccctaagrgacatgacacccccatctccctccttaccccatctcagggtgaggggctctggcagaccctcatgctgcacatggcaggtgtatctctgctcctctccag

SEQ ID NO: 23302 - DNA, 201 bp, Homo sapiens
cgccctcgctctggttgtagtagcggagcgcgatccgcaggttctctcgttcagtctgtgcctgggccttgcagatctgtgtgttccggtcccaatactcyggcccctcccgctccatccacggcgcccgcggctccatcctctggctcgcggcgtcgctgtcgaaccgcacgaactgcgtatcgtccacgtagccgacgg

SEQ ID NO: 23303 - DNA, 201 bp, Homo sapiens
gttgggttccgggacgcgggatccggcttctctgggaatcttggattccaggaaggatcctggagatctcccactttatgaagcccaatctccactcactstgatggcgtctttagaccccactggaaaccagatacgacgccctcatcggccctggggaaaaaacaagagcaaagtatgagaggtggccatgaggtcagg

SEQ ID NO: 23304 - DNA, 201 bp, Homo sapiens
ctggggaaaaaacaagagcaaagtatgagaggtggccatgaggtcagggaaactcctgcagaattctcaggaaaggaaactcttccgagctgggcccttgscttagtttgtcttccctgcccagccacctgtcccagagctggagacgcccaggtttaagccagagactttggatactttccttgatggtgacataatttt

SEQ ID NO: 23305 - DNA, 201 bp, Homo sapiens
caggaaaggaaactcttccgagctgggcccttggcttagtttgtcttccctgcccagccacctgtcccagagctggagacgcccaggtttaagccagagahtttggatactttccttgatggtgacataatttttgtcttcttctctcctggaagagaagccccagaaccatcagagtgatccagtctgcccactcttctt

SEQ ID NO: 23306 - DNA, 201 bp, Homo sapiens
cgctacaagagataaagacctgtgcatgagacactgcagaggctgtcacatgtagccagtgacagctgttaacaatctgcagattctcatgatactttcabagggcatcattgcagctgagcagtaaccagccaactccactgtctttgtaggtttccccctaaccccgtcattattgtgcagggcattctatcaccccac

SEQ ID NO: 23307 - DNA, 201 bp, Homo sapiens
tttcctattgtatcacctgaaaacggaaaattagcaggcacaccccatagttgtatagtgacaattaaatgaattcatattttgaaagtgctaaggacacrgattaacacatagcaccatgacagtgtatgatattatcgctgttggttttttttttttttttttttagatggagttttgctctcgttgcccatgctggag

SEQ ID NO: 23308 - DNA, 201 bp, Homo sapiens
atttctcaaaattcctgctttaaatgctgatgtccaataaagatgttcgtagtttcagctgggtcttaaaaggatttccaccaatactaatgttgtaaccyatatcaaatgaaacaggaactcaaatgtggagctccctctccaggacggtccatgtgggagacagtggctgtggcagtggcaatccccaagtgcaaaggg

SEQ ID NO: 23309 - DNA, 201 bp, Homo sapiens
gctgagtggcaaacctctctggagcactgtggccctcatagtgatgtcttcagctaccattccacggtatctgccctttcgctacaagagataaagacctstgcatgagacactgcagaggctgtcacatgtagccagtgacagctgttaacaatctgcagattctcatgatactttcacagggcatcattgcagctgagc

SEQ ID NO: 23310 - DNA, 201 bp, Homo sapiens
ccataaactggccccaagactggccataaacaaaatctctgcagcaccgtaacatgttcataatggccctaatgtccaagctggaaggttgcgggtttacragaatgagggaaaggaacacctggcctgcccagggcggaaaaccgcttaaaggcattcttaagccacaaacaatagcatgagcgatctgtgtcttaaggg

SEQ ID NO: 23311 - DNA, 201 bp, Homo sapiens
tatcatgctcataatttttgtacctttttaaatgccccatattgtgttgtttattttttaaattttttaaaattggtacataatatttgtacatatttatrggatacatgtgacattttgatacatgcatagaatgtgtgtatcagtcaagatatttagggtatccatgacctcaagcatttatcatttctttctgttgag

SEQ ID NO: 23312 - DNA, 201 bp, Homo sapiens
tttgcagaatctcaggtttccccaccagggtcctgactttcctgtaacaggcctgccttggctgagtggcaaacctctctggagcactgtggccctcatartgatgtcttcagctaccattccacggtatctgccctttcgctacaagagataaagacctgtgcatgagacactgcagaggctgtcacatgtagccagtga

SEQ ID NO: 23313 - DNA, 201 bp, Homo sapiens
gatgaaacagtttgtctgttaccttggaggggacacacctgcattcccctaaacacttggccattgttcacccataaaactttacttcaatgcccactatytttttctttttgagatggaattttgctcttgttgcccactctggagtgcaatggcacgatcttggctcactgcaatctctgcctcctgggttcaagtgat

SEQ ID NO: 23314 - DNA, 201 bp, Homo sapiens
cctcctatgcatgcccagaggatcctggagggcacccatcggataaccctgttcctgtttgcagaatctcaggtttccccaccagggtcctgactttcctstaacaggcctgccttggctgagtggcaaacctctctggagcactgtggccctcatagtgatgtcttcagctaccattccacggtatctgccctttcgcta

SEQ ID NO: 23315 - DNA, 201 bp, Homo sapiens
tctcctgcctcagcctccagagtagctgagattacaggcgcccgctactacgcccagctaattttttgtatttttagtagaaacggagtttccccatgttrggcagtctggtcttgaactcctgacctcaggtgatccaccctcttcggcctcccaaagtgctgggattacaggtgtgagccaccatgccccgccgttgtt

SEQ ID NO: 23316 - DNA, 201 bp, Homo sapiens
cttggtcaagtctggagtaattccattcattctttagccatatcaggcttctgcaggtacagattgctgagttatatggagataacaggcaatcccaacamcaccccgcatcgttcaggtctgtaatggcagtgccacccctataatacctgcagtaccctccacaagacccaccctggggcacaatattgcttctggttt

SEQ ID NO: 23317 - DNA, 201 bp, Homo sapiens
tgagaaagtgcctccaagccaaaggatttttattcttccagcttgaaattctggttccttgatcaaacaccctcaaattccaatcccagaagtgctcctcrgcctcctatggggacgtgccagctagttcctgcaaagctcttcagtgggattcctgctgtatcatgggggtgagacttctgtagcatcttccagcatagg

SEQ ID NO: 23318 - DNA, 201 bp, Homo sapiens
aaaaagagaaaacgaggtcgaattcctcacttaccatgagatcttgcaacacaggttccaagggcctcaacccctctaccctggctgatgctccctcctcyactccctctgaccagggccctgagccccccacacagctgagctggcccaagctgaggagttgcttgcacagcagctggagctggaccaggccctcctgga

SEQ ID NO: 23319 - DNA, 201 bp, Homo sapiens
agcggtgggtttggccccccccttatcaaagtcctggggtgtttgataaacccatgccttgagaaagtgcctccaagccaaaggatttttattcttccagvttgaaattctggttccttgatcaaacaccctcaaattccaatcccagaagtgctcctcggcctcctatggggacgtgccagctagttcctgcaaagctct

SEQ ID NO: 23320 - DNA, 201 bp, Homo sapiens
agggacagaaggaaggagaaagggaaggaacaaaaaagaaaagaaactaaaataaagaaaagaatacacgttgagaaactagaaaccctacgtatggccartgttatgaaaatggaaggaaataaagcagatgtacgtaacctgtatagaataatggaaatgtaagagggcttcattagttatccattgccgcataacaaa

SEQ ID NO: 23321 - DNA, 201 bp, Homo sapiens
ctgtatctgccctccagaggcctatgcccaagacaggttgctccctgggattctcactacaggtggacttaagctaatgggctggaaaaagagaaaacgasgtcgaattcctcacttaccatgagatcttgcaacacaggttccaagggcctcaacccctctaccctggctgatgctccctcctccactccctctgaccag

SEQ ID NO: 23322 - DNA, 201 bp, Homo sapiens
agaaaaaagtcatgtaaaatacataacatgctgtgctataatttctttatttatcttcccacccccacctttgacttctatgaagtccaaggaagtttgaktcttttatctgaggctcaactccatagagcacagtacccagaataaggtaggtgcttaatgatgtttaccatttgaatgagtttcctggaagtacttagc

SEQ ID NO: 23323 - DNA, 201 bp, Homo sapiens
aaccaccacgcctggcttaaacttttgaaataagtgcgtaatacttgatgttgatgatgtgttctgaaaacactgagttgaaggaattgagttgaaagccrctgtcttggctgcagaattatagcaggcatttttatttagattctgtcaataactttctgttgtttacttgtttctcatataccgtggcattgtactttt

SEQ ID NO: 23324 - DNA, 201 bp, Homo sapiens
atcagttcagactgattcggaggtggggaggtgggatagttcctgaccctgttgcaaggtttcttttgactttctggttttggggcacatagatgggtggygctcttcttggtcagggcggcctcagctccacccaggtaaggcagtggtggcagagagttaggggagcacctatgaaacagaccaaggcagggatgggag

SEQ ID NO: 23325 - DNA, 201 bp, Homo sapiens
atctgtatctgccctccagaggcctatgcccaagacaggttgctccctgggattctcactacaggtggacttaagctaatgggctggaaaaagagaaaacraggtcgaattcctcacttaccatgagatcttgcaacacaggttccaagggcctcaacccctctaccctggctgatgctccctcctccactccctctgacc

SEQ ID NO: 23326 - DNA, 201 bp, Homo sapiens
ctcccaaagtgctgggattacaggcgtgaaccaccacgcctggcttaaacttttgaaataagtgcgtaatacttgatgttgatgatgtgttctgaaaacaytgagttgaaggaattgagttgaaagccgctgtcttggctgcagaattatagcaggcatttttatttagattctgtcaataactttctgttgtttacttgt

SEQ ID NO: 23327 - DNA, 201 bp, Homo sapiens
gagtcctcctgctgtcagagctggccaggcttgagaggaggggagggcactgggtttttcccaggtcttgtcctttggtcctggggctcttttcctccttkcatggtggctggtgggcacagggcaggggctgatgttgatggagtcacgggaggggactggcaggggctgggaaaagtgccatgggagggagaaaaaagt

SEQ ID NO: 23328 - DNA, 201 bp, Homo sapiens
gaactcctgacctcaggtggtccacccacctcagcctcccaaagtgctgggattacaggcgtgaaccaccacgcctggcttaaacttttgaaataagtgcrtaatacttgatgttgatgatgtgttctgaaaacactgagttgaaggaattgagttgaaagccgctgtcttggctgcagaattatagcaggcatttttatt

SEQ ID NO: 23329 - DNA, 201 bp, Homo sapiens
tatcctcattcaaggcatccagatatagcccctgagccagggatctgtatctgccctccagaggcctatgcccaagacaggttgctccctgggattctcastacaggtggacttaagctaatgggctggaaaaagagaaaacgaggtcgaattcctcacttaccatgagatcttgcaacacaggttccaagggcctcaacc

SEQ ID NO: 23330 - DNA, 201 bp, Homo sapiens
tgaactcctgacctcaggtggtccacccacctcagcctcccaaagtgctgggattacaggcgtgaaccaccacgcctggcttaaacttttgaaataagtgygtaatacttgatgttgatgatgtgttctgaaaacactgagttgaaggaattgagttgaaagccgctgtcttggctgcagaattatagcaggcatttttat

SEQ ID NO: 23331 - DNA, 201 bp, Homo sapiens; identical to SEQ ID NO: 4304

SEQ ID NO: 23332 - DNA, 201 bp, Homo sapiens
agccctccctctgcccagagcagcacagtccagagtccttgaacaggaattccccctcatctaacagttaatcatttattagtggggacagacatctggtygtctctttccggtgaccccatatcctcattcaaggcatccagatatagcccctgagccagggatctgtatctgccctccagaggcctatgcccaagacag

SEQ ID NO: 23333 - DNA, 201 bp, Homo sapiens
catgttagccagactggtcttgaactcctgacctcaggtggtccacccacctcagcctcccaaagtgctgggattacaggcgtgaaccaccacgcctggcytaaacttttgaaataagtgcgtaatacttgatgttgatgatgtgttctgaaaacactgagttgaaggaattgagttgaaagccgctgtcttggctgcaga

SEQ ID NO: 23334 - DNA, 201 bp, Homo sapiens
ctctccagccctccctctgcccagagcagcacagtccagagtccttgaacaggaattccccctcatctaacagttaatcatttattagtggggacagacayctggttgtctctttccggtgaccccatatcctcattcaaggcatccagatatagcccctgagccagggatctgtatctgccctccagaggcctatgccca

SEQ ID NO: 23335 - DNA, 201 bp, Homo sapiens
accctcggcatgggccctgtccctctcccttcacttttcatccaggaatctccgtccctgaactggactccctgtccacctggactcttctagaagaaaastcacccacggagtttggtgacagagagtgagcttgctctgggaatggaggtgtagaaactgttttttgttttcctttttttttttttttttattgggaaa

SEQ ID NO: 23336 - DNA, 201 bp, Homo sapiens
ctgctgaaggtttacattttatggttataccataattgcactagttttctattgatatatatgtagctgattccagttcttgccataaacattagtgtgcmtgtctcctgggcacataggcaagaaagcccgcagagtgtatgattaggagtgggatgattggatgatatgttgtatggcctttaaccatactagataata

SEQ ID NO: 23337 - DNA, 201 bp, Homo sapiens
aaagaaattatagagtttctttaaggatttgtgtaataagtatagatatatccccaatccaaatattagttagttttgatggtttttaagcttccagtacmgcaaattcctactgcatttattttcccatgatgcacattacatataggagttatctgtggtgtgggaggctgtcattcattcgtttttactgctgaaggt

SEQ ID NO: 23338 - DNA, 201 bp, Homo sapiens
cgggccgggacacggatgtggtgaaatacctcatggagtgggagcctgggggcgaggagtggctgagacccacccgaccctcctcccggcgcggctacccsggtcctgcgtccccgccgggcgggccccttgcttctccccgcagaggcggtttccccacgaccccgcactcacccgcccaggtctgggtcagggccaggg

SEQ ID NO: 23339 - DNA, 201 bp, Homo sapiens
taagtcaattctttcaactcaatgttttcagaacacatcatcaacatcaagtattacacatttattttaaaagttccattttaaaagggaatggatgatatgttgtttggactttagccagcactgttgtaaaacacagaacctgtaaactaccctgggctgctgcccattcacatcccccaaaaggagactccatcctga

SEQ ID NO: 23340 - DNA, 201 bp, Homo sapiens
atctgtggtgtgggaggctgtcattcattcatttttacgctgaaggcttacatatcgttttaccacaatttcaccggtttcctattgatgtacatgtggcygattccagtttttgccataaatattagtgtgcatgtctcctgtgcacataggcaagaaagccccaaagcccccagagtggatgattaggaatgggttggt

SEQ ID NO: 23341 - DNA, 201 bp, Homo sapiens
ttaagtcaattctttcaactcaatgttttcagaacacatcatcaacatcaagtattacacatttattttaaaagttccattttaaaagggaatggatgatatgttgtttggactttagccagcactgttgtaaaacacagaacctgtaaactaccctgggctgctgcccattcacatcccccaaaaggagactccatcctg

SEQ ID NO: 23342 - DNA, 201 bp, Homo sapiens
gtaattgtggctacttaaacttttacaataaatgtgtaatacttgatgttgatgatgtgttctgaaaacactgagttgaaggaattgtgttaaaagtcacygtcttggtggtagaattatagcaagcatttttattctgttaataacttcctgttgtttacttgtttctcatataaaagacattatgcttttgacatatag

SEQ ID NO: 23343 - DNA, 201 bp, Homo sapiens
tggtgaaatacctcatggagtgggagcctgggggcgaggagtggctgagacccacccgaccctcctcccggcgcggctacccgggtcctgcgtccccgccrggcgggccccttgcttctccccgcagaggcggtttccccacgaccccgcactcacccgcccaggtctgggtcagggccagggcccccaagagtagcagga

SEQ ID NO: 23344 - DNA, 201 bp, Homo sapiens
tcggagaaagggtgaatctgatttgggactgactgaggagggagaagtcgtcagggagtaaaaagcagcactgtgcacccaggggagcacttactattttytctcttttctccagagcacatgagcctgcaaggcccagatcaacacctgactcagacagaacaccagggcagtgcacagctgggatttcagtctctgctc

SEQ ID NO: 23345 - DNA, 201 bp, Homo sapiens
tgaaatacctcatggagtgggagcctgggggcgaggagtggctgagacccacccgaccctcctcccggcgcggctacccgggtcctgcgtccccgccgggmgggccccttgcttctccccgcagaggcggtttccccacgaccccgcactcacccgcccaggtctgggtcagggccagggcccccaagagtagcaggagga

SEQ ID NO: 23346 - DNA, 201 bp, Homo sapiens
tgtggaaggtgctaaataaagatgagtcctctttctctagtgctggacctaaagcagaatgttcagagtccctccacatatcccaatccagccaaccacayaccatgtttgcctccagaagctcctactccttcatccgtctttcacggtctatcacttcattctggcttaagctcacactcctccaggaagtcagttact

SEQ ID NO: 23347 - DNA, 201 bp, Homo sapiens
gagtcctctttctctagtgctggacctaaagcagaatgttcagagtccctccacatatcccaatccagccaaccacataccatgtttgcctccagaagctsctactccttcatccgtctttcacggtctatcacttcattctggcttaagctcacactcctccaggaagtcagttactgtgaaggtcactaacatgctcag

SEQ ID NO: 23348 - DNA, 201 bp, Homo sapiens
gcaagttccagggcaactaagtcacgtctaccttgttgagagttaggcatcattttttctagtctatatggattcaccccagcggtgggtttggccccccscttatcaaagtcctggggtgtttgataaacccatgccttgagaaagtgcctccaagccaaaggatttttattcttccagcttgaaattctggttccttga

SEQ ID NO: 23349 - DNA, 201 bp, Homo sapiens
gttggaaattgaagttcaagtaaagtgatcattgtgaatggtcataaaatacatcctcttcagccatggaaattctccttaccttttaaaactaagttacrtgtttaatatcttataattaatttacgccaggtatggtggctcacgcctgccatcctagcactgtggaaggcagaggaaggcagatttgttgactccaga

SEQ ID NO: 23350 - DNA, 201 bp, Homo sapiens
gtctcctcttcccaatactccggcccctcctgctccacccacggcgcccgcggctccatcctcggacacgccgagtcgctgtcgaaccgcacgaactgcgwgtcgtccacgtagcccatggcgatgaagcggggctccccgcggccgggccgggacacggcggcgctgaaatacctcatggagtgggagcctgggggcgag

SEQ ID NO: 23351 - DNA, 201 bp, Homo sapiens
ttgttattccatcctgtgcaagttccagggcaactaagtcacgtctaccttgttgagagttaggcatcattttttctagtctatatggattcaccccagcrgtgggtttggccccccccttatcaaagtcctggggtgtttgataaacccatgccttgagaaagtgcctccaagccaaaggatttttattcttccagcttg

SEQ ID NO: 23352 - DNA, 201 bp, Homo sapiens
cccagtcaccccctagaaggagaccgttgggagcaagtcccccaaaatctggccataaactggccccaagactggccataaacaaaatctctgcagcaccrtaacatgttcataatggccctaatgtccaagctggaaggttgcgggtttacaagaatgagggaaaggaacacctggcctgcccagggcggaaaaccgctt

SEQ ID NO: 23353 - DNA, 201 bp, Homo sapiens
caagtttaaagttccacagatccctagggaggtggcacaatgcctccaagaactatcacaagaacagcatgaaagagatgattctaaaccattcatgaatsatccatcctcatgagccaatcacgtcccaccaagcaccacctccaacattagggattacaagtgagcatgagatttgggtggggacacagatccaaacaa

SEQ ID NO: 23354 - DNA, 201 bp, Homo sapiens
ggtactggtgggccttcaccatgcccacttccctcagccttgttattccatcctgtgcaagttccagggcaactaagtcacgtctaccttgttgagagttrggcatcattttttctagtctatatggattcaccccagcggtgggtttggccccccccttatcaaagtcctggggtgtttgataaacccatgccttgagaa

SEQ ID NO: 23355 - DNA, 201 bp, Homo sapiens
tggaccgtcttgtggagcatggtactggtgggccttcaccatgcccacttccctcagccttgttattccatcctgtgcaagttccagggcaactaagtcahgtctaccttgttgagagttaggcatcattttttctagtctatatggattcaccccagcggtgggtttggccccccccttatcaaagtcctggggtgtttg

SEQ ID NO: 23356 - DNA, 201 bp, Homo sapiens
tttggaccgtcttgtggagcatggtactggtgggccttcaccatgcccacttccctcagccttgttattccatcctgtgcaagttccagggcaactaagthacgtctaccttgttgagagttaggcatcattttttctagtctatatggattcaccccagcggtgggtttggccccccccttatcaaagtcctggggtgtt

SEQ ID NO: 23357 - DNA, 201 bp, Homo sapiens
ggtttatcgtagggactaaattaatttttgtcgactgaatgaatgaaatatgagtgtattaaattgcattacagataattataaagtgcaaaacacggaaraagttcagaaaatttttattttatgtaactagtgtgcatatcaattcatcaattcattcgtgcactaccatgcctggcgaaacaacacccatttatctgc

SEQ ID NO: 23358 - DNA, 201 bp, Homo sapiens
gtgggggcctgggtagggccaggcactggagtgaagacaggcctggagagagcctcctgaaggctgctgagcggctcagacagctccttgcctcacctgcsacagtcctcccactcccctggctctctcggtgctgttttcttcacctcctcctgccctcctggtccctggcaccccagggctcataaacatgctgctccc

SEQ ID NO: 23359 - DNA, 201 bp, Homo sapiens
tccagcctgcagaggacaacaccccgacatttcttaatgatgcaggtccctctcaccatcacgtttctgaggctctggtggaaggtgtttcctttggaccstcttgtggagcatggtactggtgggccttcaccatgcccacttccctcagccttgttattccatcctgtgcaagttccagggcaactaagtcacgtctac

SEQ ID NO: 23360 - DNA, 201 bp, Homo sapiens
aaacccccatctatacaaaaaattagaaaattagccaggcatagtagttcatgatggtagtcccagctactcaggaggctgagatcagtgggtcccttgamcccaggaggtcgacactgcagtgcatggtgatcatgccactgcactccagcctgggtgacagagcgagaccatgtctcaaaaataataatgatgacgatg

SEQ ID NO: 23361 - DNA, 201 bp, Homo sapiens
gtgctctaaagcaagttctgcctaaagcggcagaaacatttttcacattaggaacaggagttgtttgggatcctgtctggggccagcttgagagcagagcrggagtgggggcctgggtagggccaggcactggagtgaagacaggcctggagagagcctcctgaaggctgctgagcggctcagacagctccttgcctcacc

SEQ ID NO: 23362 - DNA, 201 bp, Homo sapiens
atccagcctgcagaggacaacaccccgacatttcttaatgatgcaggtccctctcaccatcacgtttctgaggctctggtggaaggtgtttcctttggacbgtcttgtggagcatggtactggtgggccttcaccatgcccacttccctcagccttgttattccatcctgtgcaagttccagggcaactaagtcacgtcta

SEQ ID NO: 23363 - DNA, 201 bp, Homo sapiens
tagaaaattagccaggcatagtagttcatgatggtagtcccagctactcaggaggctgagatcagtgggtcccttgaacccaggaggtcgacactgcagtrcatggtgatcatgccactgcactccagcctgggtgacagagcgagaccatgtctcaaaaataataatgatgacgatgatacatttaaagcaaatgcaatt

SEQ ID NO: 23364 - DNA, 201 bp, Homo sapiens
agggccacactctccccagggatattaataaatgcaactctgggtcatctttactaccatcacatccagcctgcagaggacaacaccccgacatttcttartgatgcaggtccctctcaccatcacgtttctgaggctctggtggaaggtgtttcctttggaccgtcttgtggagcatggtactggtgggccttcaccatg

SEQ ID NO: 23365 - DNA, 201 bp, Homo sapiens
ttctgtgtgggccctacttgaagctggcctcctcctatgtcacctagagtgtgggccaaagcaacatacctagatgtggaaagtggtgttgtcagaactgraagaggctcatcaggcagtgtgcttccttctttctggtgaggatgcaagatgaaacagtttgtctgttaccttggaggggacacacctgcattcccctaa

SEQ ID NO: 23366 - DNA, 201 bp, Homo sapiens
tatgattctaaatagcatgccatcaggtgcttctgaagtggttttgtttgtttctttgttttcgcagtcctattgtgttttctattcatattgctattccrtcactggttattcctttctactcttttcttgtttcatttattttgatcaatgatgtgcatttccaattctgtaaaagtttaattcagtggtatgtgtggt

SEQ ID NO: 23367 - DNA, 201 bp, Homo sapiens
ttgcctcacccaaccagtgatataattccttccttgcagaagaataagtgaaaaaaggcacagtgccaagagaatcagacacacgacctgcggaaggctgygccagtgctctaaagcaagttctgcctaaagcggcagaaacatttttcacattaggaacaggagttgtttgggatcctgtctggggccagcttgagagca

SEQ ID NO: 23368 - DNA, 201 bp, Homo sapiens
caacacatctagcatgccaataacttcggtttgatgcagtatcacgaaattgttagctcgaattgagaaactagttttttcaataactggctattcgatcrgcattctataatacacttaacatcttttgttgtgatattgaatgatatgtgatagaagtgatttggacaccactatgattctaaatagcatgccatcagg

SEQ ID NO: 23369 - DNA, 201 bp, Homo sapiens
ccagttgcctcacccaaccagtgatataattccttccttgcagaagaataagtgaaaaaaggcacagtgccaagagaatcagacacacgacctgcggaagsctgtgccagtgctctaaagcaagttctgcctaaagcggcagaaacatttttcacattaggaacaggagttgtttgggatcctgtctggggccagcttgag

SEQ ID NO: 23370 - DNA, 201 bp, Homo sapiens
gtgaatctcatacttcagtcaacacatctagcatgccaataacttcggtttgatgcagtatcacgaaattgttagctcgaattgagaaactagttttttcrataactggctattcgatcagcattctataatacacttaacatcttttgttgtgatattgaatgatatgtgatagaagtgatttggacaccactatgattc

SEQ ID NO: 23371 - DNA, 201 bp, Homo sapiens
gcttccatcttttgatccctggacacacatgttcttcctattgagaacacagcactctagagacatctctgattcaaacaatgcaccgtgtcctaaaagayggcacccacctctcagagtgcttcctccaggctggcactgagttttgcctgtagaagacctgtccagcattccttgtggctggcagcctctggatggtgc

SEQ ID NO: 23372 - DNA, 201 bp, Homo sapiens
tatctttaataacagcaatgttctcttcaatgagttaacacagttgagaacatagaataactagatcaaatagttccaagactttagtgctataaaaatartgccttgaaaataagtctttgttttgtctaaaatgtctcaaatttaggggaagtatgcccctagtgccagttttcttattgaaatatcgtcttccaaaaa

SEQ ID NO: 23373 - DNA, 201 bp, Homo sapiens
gtggagccaaacctgcttccatcttttgatccctggacacacatgttcttcctattgagaacacagcactctagagacatctctgattcaaacaatgcacsgtgtcctaaaagatggcacccacctctcagagtgcttcctccaggctggcactgagttttgcctgtagaagacctgtccagcattccttgtggctggcag

SEQ ID NO: 23374 - DNA, 201 bp, Homo sapiens
ggaatcctttgcccattgcttatttttgtcgggctcattgaagatcacagggttttagatgtgtggtcttatttctgagttctctattctgttccattggyctatgtgcctgtttttgtaccagtaccttgctgtttcagttactgtagccttgtagtatagttttaagtcaggtagcctcatgcctccagctttgttctt

SEQ ID NO: 23375 - DNA, 201 bp, Homo sapiens
tgttaaatagggaatcctttgcccattgcttatttttgtcgggctcattgaagatcacagggttttagatgtgtggtcttatttctgagttctctattctrttccattggtctatgtgcctgtttttgtaccagtaccttgctgtttcagttactgtagccttgtagtatagttttaagtcaggtagcctcatgcctccag

SEQ ID NO: 23376 - DNA, 201 bp, Homo sapiens
taaggaaggagtccagtttcaattttctgcagattgctagccagttctcccagcaccatttgttaaatagggaatcctttgcccattgcttatttttgtcrggctcattgaagatcacagggttttagatgtgtggtcttatttctgagttctctattctgttccattggtctatgtgcctgtttttgtaccagtaccttg

SEQ ID NO: 23377 - DNA, 201 bp, Homo sapiens
cattcgtatctctgcaaaggacttgatctcattcctttttatggttgcataatattccgtggtgtatatgtaccatattttctttatccagttcctcattkgtgggcatttgggttgattccatgtctttgctattgtgaatagtgctgcaatgaacatacacatgcatatacctttataatagaatgatttatattcctt

SEQ ID NO: 23378 - DNA, 201 bp, Homo sapiens
cacctcagggtggcctcatagtcaaagacagggtggtgggtcacgtgtgtcttgggggggtctgaaaggaagagtcagaaaactcaagcactttgcatctstcatgggacactccagcagcacctggatgtgaccatcctaagaatgaaccagatacctggggtggggaagggagcacagaacccagacaccagcctggac

SEQ ID NO: 23379 - DNA, 201 bp, Homo sapiens
tttgctgaggataatggcttccagcttcattcgtatctctgcaaaggacttgatctcattcctttttatggttgcataatattccgtggtgtatatgtacyatattttctttatccagttcctcatttgtgggcatttgggttgattccatgtctttgctattgtgaatagtgctgcaatgaacatacacatgcatatacc

SEQ ID NO: 23380 - DNA, 201 bp, Homo sapiens
gaaggtattccaaaatcttttgtatagtaaactcctgagtttgcttgagaatctgcctatctgtcttttcttctcaggacatcatctcctacccagagcamacctttgttcttctgcaagtagaaagccctctttcagaacattgtccaagatcagccaggcccaaccctcaaaatgactttctgtctttgacccaaatgc

SEQ ID NO: 23381 - DNA, 201 bp, Homo sapiens
ttaggaaaaataggttcaaccgctgacttccacagcttgggggaatcatccccatgattcgatcacctcccatgaagtccctccgccaatatgtggggathagaattcgcatgacaattcaaaatgagatttgggtgggaacacagagacaggccatatcagaagtgcatcattaagtccaagccacacttaagagaggga

SEQ ID NO: 23382 - DNA, 201 bp, Homo sapiens
gaacatacgaattgtcactgcattgtgcactttaaatggttacggtggtatcctttgtgtttatgtgtattttaccacaatgaaaaagaggctgaggaagrtattccaaaatcttttgtatagtaaactcctgagtttgcttgagaatctgcctatctgtcttttcttctcaggacatcatctcctacccagagcaaacct

SEQ ID NO: 23383 - DNA, 201 bp, Homo sapiens
cctcatggagtgggagcctgggggcgaggagtggctgagacccacccgaccctcctcccggcgcggctacccgggtcctgcgtccccgccgggcgggcccsttgcttctccccgcagaggcggtttccccacgaccccgcactcacccgcccaggtctgggtcagggccagggcccccaagagtagcaggaggagggttcg

SEQ ID NO: 23384 - DNA, 201 bp, Homo sapiens
gagcctgggggcgaggagtggctgagacccacccgaccctcctcccggcgcggctacccgggtcctgcgtccccgccgggcgggccccttgcttctccccrcagaggcggtttccccacgaccccgcactcacccgcccaggtctgggtcagggccagggcccccaagagtagcaggaggagggttcggggcgccatgacg

SEQ ID NO: 23385 - DNA, 201 bp, Homo sapiens
aaactttctactccacagggagaagaagatcccctatgggctgtgagggcagtggcttgggtggaatccctgctaggaatccctgctaggaacaggagagraaggcctttcagcctccccaagcagcagccctggggagaagctgtgcttccagggatgagtggaccaggctggagcaagcttggcccaagtgcaggtcat

SEQ ID NO: 23386 - DNA, 201 bp, Homo sapiens
tccgtgtctcctcttcccaatactccggcccctcctgctccacccacggcgcccgcggctccatcctcggacacgccgagtcgctgtcgaaccgcacgaaytgcgtgtcgtccacgtagcccatggcgatgaagcggggctccccgcggccgggccgggacacggcggcgctgaaatacctcatggagtgggagcctgggg

SEQ ID NO: 23387 - DNA, 201 bp, Homo sapiens; identical to SEQ ID NO: 4338

SEQ ID NO: 23388 - DNA, 201 bp, Homo sapiens
tctcttcagggccacactctccccagggatattaataaatgcaactctgggtcatctttactaccatcacatccagcctgcagaggacaacaccccgacayttcttaatgatgcaggtccctctcaccatcacgtttctgaggctctggtggaaggtgtttcctttggaccgtcttgtggagcatggtactggtgggcctt

SEQ ID NO: 23389 - DNA, 201 bp, Homo sapiens
ttttcatagtaagcacatgctaatatattttcaataaattcatgtgctcttttcctaagttggtatcagagctaattatttttttcattgcgccaaaatcyatattatataaaatttggtatcgtaacaatttttaagtatagagtactataatatgaactgtagcacattgttatgcaacagatctctagaacttttcat

SEQ ID NO: 23390 - DNA, 201 bp, Homo sapiens
tatagagtactataatatgaactgtagcacattgttatgcaacagatctctagaacttttcatcttgcaaaactgaaactctacgctgaaaatctcctcawgaatccccccagcctaaccactggcagccgccattctactttcaggttctaagagtttagacgccgcatataacgaattgcgcagtattggaatttcctt

SEQ ID NO: 23391 - DNA, 201 bp, Homo sapiens
ttcaggtcactgccaccatttggtctttgtctcttcagggccacactctccccagggatattaataaatgcaactctgggtcatctttactaccatcacabccagcctgcagaggacaacaccccgacatttcttaatgatgcaggtccctctcaccatcacgtttctgaggctctggtggaaggtgtttcctttggaccg

SEQ ID NO: 23392 - DNA, 201 bp, Homo sapiens
tttcaggtcactgccaccatttggtctttgtctcttcagggccacactctccccagggatattaataaatgcaactctgggtcatctttactaccatcacvtccagcctgcagaggacaacaccccgacatttcttaatgatgcaggtccctctcaccatcacgtttctgaggctctggtggaaggtgtttcctttggacc

SEQ ID NO: 23393 - DNA, 201 bp, Homo sapiens
tggacctgaatatgaaccctccaggcctttccaccagctagctatagagccttggacacatcttggccatagctggccctgacagacacttgcccagtggktgagtgctcagtgaacccctctgagccagttgcctcacccaaccagtgatataattccttccttgcagaagaataagtgaaaaaaggcacagtgccaaga

SEQ ID NO: 23394 - DNA, 201 bp, Homo sapiens
tttgccatagtaactctgccctctggctttttcaggtcactgccaccatttggtctttgtctcttcagggccacactctccccagggatattaataaatgbaactctgggtcatctttactaccatcacatccagcctgcagaggacaacaccccgacatttcttaatgatgcaggtccctctcaccatcacgtttctgag

SEQ ID NO: 23395 - DNA, 201 bp, Homo sapiens
cctggacacaggcacctgggataatctcctattccgtggaaaattctagtccctgaagagggaacagcgacttctggtcctgacctgagtggaggctgagrgactcagaagtgctggactcagacccccacacacattgagtgtgaagcagagaacaaggcctgagaggaaaagtcacgggcccaaggctgctgcctgtgt

SEQ ID NO: 23396 - DNA, 201 bp, Homo sapiens
caagttaggtggacctgaatatgaaccctccaggcctttccaccagctagctatagagccttggacacatcttggccatagctggccctgacagacacttkcccagtgggtgagtgctcagtgaacccctctgagccagttgcctcacccaaccagtgatataattccttccttgcagaagaataagtgaaaaaaggcaca

SEQ ID NO: 23397 - DNA, 201 bp, Homo sapiens
ctactccttttagtttgccatagtaactctgccctctggctttttcaggtcactgccaccatttggtctttgtctcttcagggccacactctccccagggwtattaataaatgcaactctgggtcatctttactaccatcacatccagcctgcagaggacaacaccccgacatttcttaatgatgcaggtccctctcacca

SEQ ID NO: 23398 - DNA, 201 bp, Homo sapiens
tcaagttaggtggacctgaatatgaaccctccaggcctttccaccagctagctatagagccttggacacatcttggccatagctggccctgacagacactygcccagtgggtgagtgctcagtgaacccctctgagccagttgcctcacccaaccagtgatataattccttccttgcagaagaataagtgaaaaaaggcac

SEQ ID NO: 23399 - DNA, 201 bp, Homo sapiens
cattccctgcagcttgagtcctattggctactccttttagtttgccatagtaactctgccctctggctttttcaggtcactgccaccatttggtctttgtstcttcagggccacactctccccagggatattaataaatgcaactctgggtcatctttactaccatcacatccagcctgcagaggacaacaccccgacatt

SEQ ID NO: 23400 - DNA, 201 bp, Homo sapiens
gaggcttcagctaatcttaatctttttgctggggcagggtcttgcctcaatgttgatgactgctggctgatcaggagggtggttgctaaaggctcttatgrcaacttcttaaaataagacaatgaagtttgcggcatggattataaagggggaatcagtacttaagtaaggtcaatataagttttcaagttaggtggacct

SEQ ID NO: 23401 - DNA, 201 bp, Homo sapiens
ttgggtcaaacaccttcaccctcctgcttctcaattcttgctttcttatcatagatatcaagcagcgcccttgttggcttcctgtcctaatcctgggacavcaccctctactatccttccccacattccctgcagcttgagtcctattggctactccttttagtttgccatagtaactctgccctctggctttttcaggtc

SEQ ID NO: 23402 - DNA, 201 bp, Homo sapiens
ggcagtgctgaggggagcattaggaaaaataggttcaaccgctgacttccacagcttgggggaatcatccccatgattcgatcacctcccatgaagtcccdccgccaatatgtggggattagaattcgcatgacaattcaaaatgagatttgggtgggaacacagagacaggccatatcagaagtgcatcattaagtccaa

SEQ ID NO: 23403 - DNA, 201 bp, Homo sapiens
tttaaaattactctattgctcaaaaatgctaaggatcatctgaggcttcagctaatcttaatctttttgctggggcagggtcttgcctcaatgttgatgaytgctggctgatcaggagggtggttgctaaaggctcttatggcaacttcttaaaataagacaatgaagtttgcggcatggattataaagggggaatcagta

SEQ ID NO: 23404 - DNA, 201 bp, Homo sapiens
ggtaatttataaaggcaagaggtttagttgactcacagttgtgcatggctgaggaggctgccccaggaaacttacaatcatggcagaaggggaagcaaacrtgtcattcttcacatggtggcaggagagaaaaatgcagagtgaagtggggaaaatccccttatatggtacatatacaccatggaatattatgcagccata

SEQ ID NO: 23405 - DNA, 201 bp, Homo sapiens
ccaaggcctccactgccaccctgcaccctgggtgccctccacactctccaagtgtccagatgtgtgtgaggagttaagggcaggaagaactattggatcgwggatttaggtgcctttttccacctctgcaggtggcaaggtgtggattcataagctggcattgaagcgagttctgtcctttgtgaatagttgtttggtcac

SEQ ID NO: 23406 - DNA, 201 bp, Homo sapiens
gggcgaggagtggctgagacccacccgaccctcctcccggcgcggctacccgggtcctgcgtccccgccgggcgggccccttgcttctccccgcagaggcsgtttccccacgaccccgcactcacccgcccaggtctgggtcagggccagggcccccaagagtagcaggaggagggttcggggcgccatgacggccatcct

SEQ ID NO: 23407 - DNA, 201 bp, Homo sapiens
ctctatcagttagaagttgtattagtctgttctcacactgctataaagaaatacctgagactgggtaatttataaaggcaagaggtttagttgactcacarttgtgcatggctgaggaggctgccccaggaaacttacaatcatggcagaaggggaagcaaacatgtcattcttcacatggtggcaggagagaaaaatgca

SEQ ID NO: 23408 - DNA, 201 bp, Homo sapiens
agttttcccaaggcctccactgccaccctgcaccctgggtgccctccacactctccaagtgtccagatgtgtgtgaggagttaagggcaggaagaactatwggatcgtggatttaggtgcctttttccacctctgcaggtggcaaggtgtggattcataagctggcattgaagcgagttctgtcctttgtgaatagttgtt

SEQ ID NO: 23409 - DNA, 201 bp, Homo sapiens
ttactctatcagttagaagttgtattagtctgttctcacactgctataaagaaatacctgagactgggtaatttataaaggcaagaggtttagttgactcrcagttgtgcatggctgaggaggctgccccaggaaacttacaatcatggcagaaggggaagcaaacatgtcattcttcacatggtggcaggagagaaaaat

SEQ ID NO: 23410 - DNA, 201 bp, Homo sapiens
cccctgaggagcggaccccaatacagtattcaatgtgcaaggatttattagaggaaatagttatgagagaaattcaggacacagacggaaaatgctgggartgtcatcagaccacaaagcaactctgagccccagtgaggtaaacagtgcaggaaggtcagctggaagcatcctagaccctgtgcaggctaacagaagttc

SEQ ID NO: 23411 - DNA, 201 bp, Homo sapiens
tgggtccccaagagctcatgatcccagagacagagagagagaaggtggaagccatagtgagtttcacattctacacccagagtcacaaactgttatgtcarcattactctatcagttagaagttgtattagtctgttctcacactgctataaagaaatacctgagactgggtaatttataaaggcaagaggtttagttgac

SEQ ID NO: 23412 - DNA, 201 bp, Homo sapiens
ttcctgagtgcttctggctcagggcctctcacaaggttgcagtccagttgtcagcctagggctgcatcgtctgagggcttcactggggctagggattcacrtgaaacatggcttagtcacatggctgttggaaaagcctagttccttgctgtctggtcccagggggcctcagttcttagccacatggaccttcctgcaggg

SEQ ID NO: 23413 - DNA, 201 bp, Homo sapiens
ggatgcaaagttcccagacctaccagagaaggcaaacccctgcagcatgcagggctagacaggggcaagaaacaaggtcattccgggccagcaggaagagrgaaagggaaactacagacgtacctcagagacactgcagatttggtttcagaccatggcaacaaacaagtcacacaaatttttgtttttccagtgcataga

SEQ ID NO: 23414 - DNA, 201 bp, Homo sapiens
tttcctgagtgcttctggctcagggcctctcacaaggttgcagtccagttgtcagcctagggctgcatcgtctgagggcttcactggggctagggattcaygtgaaacatggcttagtcacatggctgttggaaaagcctagttccttgctgtctggtcccagggggcctcagttcttagccacatggaccttcctgcagg

SEQ ID NO: 23415 - DNA, 201 bp, Homo sapiens
ggagcggttttcctgagtgcttctggctcagggcctctcacaaggttgcagtccagttgtcagcctagggctgcatcgtctgagggcttcactggggctarggattcacgtgaaacatggcttagtcacatggctgttggaaaagcctagttccttgctgtctggtcccagggggcctcagttcttagccacatggacctt

SEQ ID NO: 23416 - DNA, 201 bp, Homo sapiens
gaactaaagggcttcatgacatcagcactcactgtggaggagatgtctgtctcatcaggcagctcactatcactgacctcaaagcgatgctgcccatactraggatcctggcattattgtcacctgacacaaatgtgatggtcaagccctgtgccacctggaaggggatagagggtaggataggactagaagacccaaaga

SEQ ID NO: 23417 - DNA, 201 bp, Homo sapiens
aggagcggttttcctgagtgcttctggctcagggcctctcacaaggttgcagtccagttgtcagcctagggctgcatcgtctgagggcttcactggggctrgggattcacgtgaaacatggcttagtcacatggctgttggaaaagcctagttccttgctgtctggtcccagggggcctcagttcttagccacatggacct

SEQ ID NO: 23418 - DNA, 201 bp, Homo sapiens
ctgtctcatcaggcagctcactatcactgacctcaaagcgatgctgcccatactgaggatcctggcattattgtcacctgacacaaatgtgatggtcaagycctgtgccacctggaaggggatagagggtaggataggactagaagacccaaagagggaagactctcagagggaaggatgaggatgtaaagtgtgaaaaga

SEQ ID NO: 23419 - DNA, 201 bp, Homo sapiens
aaatgcaaattaacgtgtaataatacatcctctcttgtgaaaatgtattagttatttactattgtgtaacaaattatgtaaaacttagcagctcaaaacarcaaatattcatcatctcccacagtttctaatggtcaggaatccaggagcggttttcctgagtgcttctggctcagggcctctcacaaggttgcagtccag

SEQ ID NO: 23420 - DNA, 201 bp, Homo sapiens
ggccggggtcactcaccgccctcgctctggttgtagtagcggagcgcgatccgcaggttctctcgttcagtctgtgcctgggccttgcagatctgtgtgtyccggtcccaatactccggcccctcccgctccatccacggcgcccgcggctccatcctctggctcgcggcgtcgctgtcgaaccgcacgaactgcgtatcg

SEQ ID NO: 23421 - DNA, 201 bp, Homo sapiens
cgggccggggtcactcaccgccctcgctctggttgtagtagcggagcgcgatccgcaggttctctcgttcagtctgtgcctgggccttgcagatctgtgtsttccggtcccaatactccggcccctcccgctccatccacggcgcccgcggctccatcctctggctcgcggcgtcgctgtcgaaccgcacgaactgcgtat

SEQ ID NO: 23422 - DNA, 201 bp, Homo sapiens
tcgttcaaggcgatgtaatccttgccgtcgtaggcgtcctgccggtacccgcggaggaagcgcccgtccgaccccacgtcgcagccatacatcatctggayggtgtgagaacctggccccgaccccacggtcagcccagtcccccgagccccgtccggccccgaccaacccggggggatttttggcctaaactgaaaatga

SEQ ID NO: 23423 - DNA, 201 bp, Homo sapiens
tgcttaaatatgttcacagagctaaaggaaactatgggcaaaaaactaaaggaaatcagaagaactatcttaactcaaatagagaacatcaataaaaagayagaaagtttaaaaagaaaccaaatagaaattttggagctgaaaagtgcaataactgaaatgaaaaatttactagagtaattttactattttttactatat

SEQ ID NO: 23424 - DNA, 201 bp, Homo sapiens
ctgcatctttcctttcgccagtgtacaatctcctgagtaaatggctataggttcctttgctgaaggactgagggaattgtgccagcatttacttccacggrgttgcagggtattcctcctagggatatggactcctcctctgtcactgggatctgaatctgaactttggctgaggtctaggcattgaggatgggatcatga

SEQ ID NO: 23425 - DNA, 201 bp, Homo sapiens
ctgggcatcaatgtcagctctcactcagtgtcaataatctgaccagttctgcatctttcctttcgccagtgtacaatctcctgagtaaatggctataggtwcctttgctgaaggactgagggaattgtgccagcatttacttccacggagttgcagggtattcctcctagggatatggactcctcctctgtcactgggatc

SEQ ID NO: 23426 - DNA, 201 bp, Homo sapiens
gcatcattcttttgcatgtggatatccaggtttccagcaccatttgttgatgcaccatctgttgcagtggggctgacacatttgtaagatgcaatgagcaygaatacatgggagcaccatgaatttatttacatgtctttacttcacagttgttttgaggaggctttcactgagaaacctaacagaaatgaatatatatga

SEQ ID NO: 23427 - DNA, 201 bp, Homo sapiens
tactccctgacctccgtaagccccactgtgatgggagacatgatagtgctgtgggcatctgggcatcaatgtcagctctcactcagtgtcaataatctgahcagttctgcatctttcctttcgccagtgtacaatctcctgagtaaatggctataggttcctttgctgaaggactgagggaattgtgccagcatttacttc

SEQ ID NO: 23428 - DNA, 201 bp, Homo sapiens
gaaacataggctgaaatgaagggtttatgtttatcttgctacaaattctgttggcccacaatctcttatgcttattgcataagagagccacagagtggggygatagctcaaataaccagtccctggttttctgcttcagaaacaagtttaaattctctgcttagacaaagtaaagaaaataattgaaagatgttgaatgtg

SEQ ID NO: 23429 - DNA, 201 bp, Homo sapiens
cacctgtggtgtctcctgaagagggattgtcagttctggttccccgtgggcgggaacggttgccttgtaggttactggggcactggccaggaaaggggtgwgaaagttatgtgctaatttctcaaaattcctgctttaaatgctgatgtccaataaagatgttcgtagtttcagctgggtcttaaaaggatttccaccaat

SEQ ID NO: 23430 - DNA, 201 bp, Homo sapiens
gggtgactccacttaacagtgcatcagtgttaattatgcactcagggaattggaagataaccagggctgggtctatggatccagtagttccattgtgggcbgtaatgtgtccaggtttactccctgacctccgtaagccccactgtgatgggagacatgatagtgctgtgggcatctgggcatcaatgtcagctctcactc

SEQ ID NO: 23431 - DNA, 201 bp, Homo sapiens
cagactagggacccagtgtgggggtgactccacttaacagtgcatcagtgttaattatgcactcagggaattggaagataaccagggctgggtctatggawccagtagttccattgtgggccgtaatgtgtccaggtttactccctgacctccgtaagccccactgtgatgggagacatgatagtgctgtgggcatctggg

SEQ ID NO: 23432 - DNA, 201 bp, Homo sapiens
gtttccctttggctttcagcacaatgagagtcctgactccacagactagggacccagtgtgggggtgactccacttaacagtgcatcagtgttaattatgbactcagggaattggaagataaccagggctgggtctatggatccagtagttccattgtgggccgtaatgtgtccaggtttactccctgacctccgtaagcc

SEQ ID NO: 23433 - DNA, 201 bp, Homo sapiens
cagagaaggcaaacccctgcagcatgcagggctagacaggggcaagaaacaaggtcattccgggccagcaggaagagggaaagggaaactacagacgtacmtcagagacactgcagatttggtttcagaccatggcaacaaacaagtcacacaaatttttgtttttccagtgcatagaaaagttatattcacactctactg

SEQ ID NO: 23434 - DNA, 201 bp, Homo sapiens
cgtcagaggtttccctttggctttcagcacaatgagagtcctgactccacagactagggacccagtgtgggggtgactccacttaacagtgcatcagtgtyaattatgcactcagggaattggaagataaccagggctgggtctatggatccagtagttccattgtgggccgtaatgtgtccaggtttactccctgacctc

SEQ ID NO: 23435 - DNA, 201 bp, Homo sapiens
cgttgggagcaagtcccccaaaatctggccataaactggccccaagactggccataaacaaaatctctgcagcaccgtaacatgttcataatggccctaaygtccaagctggaaggttgcgggtttacaagaatgagggaaaggaacacctggcctgcccagggcggaaaaccgcttaaaggcattcttaagccacaaaca

SEQ ID NO: 23436 - DNA, 201 bp, Homo sapiens
gtggctgagacccacccgaccctcctcccggcgcggctacccgggtcctgcgtccccgccgggcgggccccttgcttctccccgcagaggcggtttccccmcgaccccgcactcacccgcccaggtctgggtcagggccagggcccccaagagtagcaggaggagggttcggggcgccatgacggccatcctcggcgtctg

SEQ ID NO: 23437 - DNA, 201 bp, Homo sapiens
aaatgaaaccgggtaaaggcgcctgggcctctcccggggcaagggtctcggggtcccgcggcttcggggtggatctcggacccggagactgtgggcgaccyggcccgtccgtgggggatgagaggtcgtgacctgcgccccgggccggggtcactcaccggcctcgctctggttgtagtagccgcgcagggtccccaggtt

SEQ ID NO: 23438 - DNA, 201 bp, Homo sapiens
aatgctctggctctgagacacaggggtggtggaagtaggatagtgattggatgatgaatctgtagctgcagaggcatctgggcccctcaccttcattcctygtagatgtcacctccactggatgcctgcaatgccctctcctctgtatgctcctgccagagtctccccatctccactgacagcagctccacccttctgctc

SEQ ID NO: 23439 - DNA, 201 bp, Homo sapiens
gtggaaagttctcatgtcttccatttattttgtctctcaaatttcaggaatcttctcctttaattaacccatcaatctctcttggaaataatttgaaaaastaaatttatactcagattctaattttaatacagaagtaagttatagctcagtgcaccacaaatttgagacagagacggagacatcccagccccttttctg

SEQ ID NO: 23440 - DNA, 201 bp, Homo sapiens
caagacacaccctgggacacactatgattttttttttttttttttttgccaggatgtgggcagcgtcagaggtttccctttggctttcagcacaatgagadtcctgactccacagactagggacccagtgtgggggtgactccacttaacagtgcatcagtgttaattatgcactcagggaattggaagataaccagggct

SEQ ID NO: 23441 - DNA, 201 bp, Homo sapiens
tctcatgtcttccatttattttgtctctcaaatttcaggaatcttctcctttaattaacccatcaatctctcttggaaataatttgaaaaagtaaatttayactcagattctaattttaatacagaagtaagttatagctcagtgcaccacaaatttgagacagagacggagacatcccagccccttttctggaacaggaa

SEQ ID NO: 23442 - DNA, 201 bp, Homo sapiens
agctctctaatggtggtgtgacccccacattactttcagtgtcttcctcaagacacaccctgggacacactatgattttttttttttttttttttgccagratgtgggcagcgtcagaggtttccctttggctttcagcacaatgagagtcctgactccacagactagggacccagtgtgggggtgactccacttaacagt

SEQ ID NO: 23443 - DNA, 201 bp, Homo sapiens
ctcctttaattaacccatcaatctctcttggaaataatttgaaaaagtaaatttatactcagattctaattttaatacagaagtaagttatagctcagtgsaccacaaatttgagacagagacggagacatcccagccccttttctggaacaggaaaggtgattggggaaggaatgcagttcagcatgaggaagagggtca

SEQ ID NO: 23444 - DNA, 201 bp, Homo sapiens
ctcatcaggcttcctcagggacaggttgctggattatgtagagacaatagacaaccccaacaccatcccacatccttcagctctctaatggtggtgtgacbcccacattactttcagtgtcttcctcaagacacaccctgggacacactatgattttttttttttttttttttgccaggatgtgggcagcgtcagaggttt

SEQ ID NO: 23445 - DNA, 201 bp, Homo sapiens
gcaaggacaaccaggccagcaacgatacccatgatggggatggtgggcagggaagactgctctgggaaaggaggtgaaggtgagggtctctgacccccagscctcaccaccgaccctgttaaaggtcttcagagaggctcctgctttccctaacagacatgatgcctccatctccctccttactccatctcagcatgaggg

SEQ ID NO: 23446 - DNA, 201 bp, Homo sapiens
tagaagcccagggcccagcacctcagggtggcctcatagtcaaagacagggtggtgggtcacgtgtgtcttgggggggtctgaaaggaagagtcagaaaaytcaagcactttgcatctctcatgggacactccagcagcacctggatgtgaccatcctaagaatgaaccagatacctggggtggggaagggagcacagaac

SEQ ID NO: 23447 - DNA, 201 bp, Homo sapiens
aggaggcacccacagcaggggcagtgcaggtctgtggtcgctcctgctctcacctgtggtgtctcctgaagagggattgtcagttctggttccccgtgggygggaacggttgccttgtaggttactggggcactggccaggaaaggggtgtgaaagttatgtgctaatttctcaaaattcctgctttaaatgctgatgtcc

SEQ ID NO: 23448 - DNA, 201 bp, Homo sapiens
cgctccatatcccctttctaattggagtggaaagaaatgcactcaccaaatccatagctgcacgctgtgtgcccgaggctttattattctgctctgcagtkatatccagacaacataaaagctgcaattataattcctgcttggccaggcctggagtaatctcattcattctttagtcctcatcaggcttcctcagggaca

SEQ ID NO: 23449 - DNA, 201 bp, Homo sapiens
gttgtggatcccacatggatgtgaatcgctccatatcccctttctaattggagtggaaagaaatgcactcaccaaatccatagctgcacgctgtgtgcccraggctttattattctgctctgcagtgatatccagacaacataaaagctgcaattataattcctgcttggccaggcctggagtaatctcattcattcttta

SEQ ID NO: 23450 - DNA, 201 bp, Homo sapiens
aggggagttacaatagccctgagaaaaaactataaataaatgtgttgtggatcccacatggatgtgaatcgctccatatcccctttctaattggagtggaragaaatgcactcaccaaatccatagctgcacgctgtgtgcccgaggctttattattctgctctgcagtgatatccagacaacataaaagctgcaattata

SEQ ID NO: 23451 - DNA, 201 bp, Homo sapiens
atgaaccctccaggcctttccaccagctagctatagagccttggacacatcttggccatagctggccctgacagacacttgcccagtgggtgagtgctcartgaacccctctgagccagttgcctcacccaaccagtgatataattccttccttgcagaagaataagtgaaaaaaggcacagtgccaagagaatcagacac

SEQ ID NO: 23452 - DNA, 201 bp, Homo sapiens
aagaatcttttgcctaactacccaaagtaataaaaattttctcctgtgttttcttttagaaattttatagttttaactcataaattttagctgtttaggtbtctaatttgtttgagctgatattttatatggtgttaaatgtaacattgtgttacctatgcaacttcattgaaaatcaattgacaaagaaagtaagaatat

SEQ ID NO: 23453 - DNA, 201 bp, Homo sapiens
gcctgtgattcattttgagtttttttttttttgtataaagcgtgaggtttgggctcagcctattttttttccactgtggttgtccagttgctccagcaccrtttgttgggaaagctctccttccttcattgaattgtgtttgtgcttttgtaaatgtcagttgagcatatttgtgtgttttgctcattttcagttgagttg

SEQ ID NO: 23454 - DNA, 201 bp, Homo sapiens
agaattcactcactatcattagaacagcatgatccaatcacctcccatgaggtccctccttcaatactggggattacaattcgcatgacaattgaagatgwgatttgggtgggaacacagaaccaggccatatcagaagtgcatcattaagtccaagccacactcaagagagggaattaagctgcacctctggaagggagc

SEQ ID NO: 23455 - DNA, 201 bp, Homo sapiens
atgcttaactcgaattgagaatcaaattttttccaaaaacggctcaggggcattctattgtaaacttaacatttttgggtgtggtattgcatgagatgtgrtagaagtgatttggacactactacagttctaaatagcactgctattatgtgcttctgaagctttcttttttttttttttttagctgtcttattttgcttt

SEQ ID NO: 23456 - DNA, 201 bp, Homo sapiens
agggagcacagaacccagacaccagcctggacacgggcacctgggataatctcctattccttggaaagttctagtctctgagcgggggagcagggacctcyggttctgacctgagtggaggccaagggactcagaggagctggagtcagacccccacacacattgagtgtgaggcagagaacaaggcctgaggggaaaagt

SEQ ID NO: 23457 - DNA, 201 bp, Homo sapiens
ctcatgagaattcactcactatcattagaacagcatgatccaatcacctcccatgaggtccctccttcaatactggggattacaattcgcatgacaattgragatgagatttgggtgggaacacagaaccaggccatatcagaagtgcatcattaagtccaagccacactcaagagagggaattaagctgcacctctggaa

SEQ ID NO: 23458 - DNA, 201 bp, Homo sapiens
tcctattccttggaaagttctagtctctgagcgggggagcagggacctctggttctgacctgagtggaggccaagggactcagaggagctggagtcagacycccacacacattgagtgtgaggcagagaacaaggcctgaggggaaaagtcctggtgccaaggctgctgtggggtcaaagggaacccctgatcagtcttcc

SEQ ID NO: 23459 - DNA, 201 bp, Homo sapiens
gcctgtgacaccacacctggctcaatgtttgtaattttaactgtgtgttttacattaaagcctgtgattcattttgagtttttttttttttgtataaagcrtgaggtttgggctcagcctattttttttccactgtggttgtccagttgctccagcaccatttgttgggaaagctctccttccttcattgaattgtgtttg

SEQ ID NO: 23460 - DNA, 201 bp, Homo sapiens
aaggttgtcagctgagataagaatggggaaggagggttggatgtgtgagcacagagagaaggtgtgtaagggtcacccaggccaggaggaggctgagggtragccatgcagggagagggtgattgctggccctggtgggggctccccatgtggtttgggtcatgaagttagagaagacaccaacgatgagggacagtgagt

SEQ ID NO: 23461 - DNA, 201 bp, Homo sapiens
cagagggaagcggggaaaagccccttataaaaccatcagatctcatgagaattcactcactatcattagaacagcatgatccaatcacctcccatgaggtycctccttcaatactggggattacaattcgcatgacaattgaagatgagatttgggtgggaacacagaaccaggccatatcagaagtgcatcattaagtcc

SEQ ID NO: 23462 - DNA, 201 bp, Homo sapiens
gacccccacacacattgagtgtgaggcagagaacaaggcctgaggggaaaagtcctggtgccaaggctgctgtggggtcaaagggaacccctgatcagtcytccagggattgtcttcccctccactccctcagagacttcatcccttaattgtcccagagagcaggacgggccctcagaatcactctctggtacaggatct

SEQ ID NO: 23463 - DNA, 201 bp, Homo sapiens
ccaggaaacttacaatcatggcagaagtggaagaaaacctgtccttcttcacatggtggcaggagagagaaatgcagagggaagcggggaaaagccccttrtaaaaccatcagatctcatgagaattcactcactatcattagaacagcatgatccaatcacctcccatgaggtccctccttcaatactggggattacaat

SEQ ID NO: 23464 - DNA, 201 bp, Homo sapiens
cccagagagcaggacgggccctcagaatcactctctggtacaggatctggaaacccaggaggattcctctccctcaggaccagagggagggcgatattctrgtgttggtcccattttcctcctctccttgtgctaggccaggctgagaggtctacaggagatcagggaggcgccccactgcccctggtacccgcgcgctgc

SEQ ID NO: 23465 - DNA, 201 bp, Homo sapiens
tgcatggctgaggaggccgccccaggaaacttacaatcatggcagaagtggaagaaaacctgtccttcttcacatggtggcaggagagagaaatgcagagsgaagcggggaaaagccccttataaaaccatcagatctcatgagaattcactcactatcattagaacagcatgatccaatcacctcccatgaggtccctcc

SEQ ID NO: 23466 - DNA, 201 bp, Homo sapiens
gtaatttataaaggaaagaggtttaactgactcccagttctgcatggctgaggaggccgccccaggaaacttacaatcatggcagaagtggaagaaaaccygtccttcttcacatggtggcaggagagagaaatgcagagggaagcggggaaaagccccttataaaaccatcagatctcatgagaattcactcactatcat

SEQ ID NO: 23467 - DNA, 201 bp, Homo sapiens
tggcctcgctctggttgtagtagccgcgcagggtctgcaggttcattctgtcagtctgtgcgtgggccttggtgttccgtgtctcctcttcccaatactcyggcccctcctgctccacccacggcgcccgcggctccatcctcggacacgccgagtcgctgtcgaaccgcacgaactgcgtgtcgtccacgtagcccatgg

SEQ ID NO: 23468 - DNA, 201 bp, Homo sapiens
tagtctgttctcacactgctataaagaaatacctgagactgggtaatttataaaggaaagaggtttaactgactcccagttctgcatggctgaggaggccrccccaggaaacttacaatcatggcagaagtggaagaaaacctgtccttcttcacatggtggcaggagagagaaatgcagagggaagcggggaaaagcccc

SEQ ID NO: 23469 - DNA, 201 bp, Homo sapiens
gtccacgtagcccatggcgatgaagcggggctccccgcggccgggccgggacacggcggcgctgaaatacctcatggagtgggagcctgggggcgaggagrggttgagacccgcccgaccctcctcccggcgcggctgccgagtcctgcgcccccgccgggccggcccctccctcctccgcgcaggggccgtttccctcct

SEQ ID NO: 23470 - DNA, 201 bp, Homo sapiens
gcgctgaaatacctcatggagtgggagcctgggggcgaggaggggttgagacccgcccgaccctcctcccggcgcggctgccgagtcctgcgcccccgccrggccggcccctccctcctccgcgcaggggccgtttccctcctgaccccgcactcacccgcccaggtctcggtcagggtcagggcccccgagagcagcagg

SEQ ID NO: 23471 - DNA, 201 bp, Homo sapiens
cagagctcatgatcccagagacagagagagagaaggtggaagccacagggagttttaggttctacacccagagtcacaagctgttacgtcggcattgctcmatcagttagaagttgtattagtctgttctcacactgctataaagaaatacctgagactgggtaatttataaaggaaagaggtttaactgactcccagttc

SEQ ID NO: 23472 - DNA, 201 bp, Homo sapiens
tgaaatacctcatggagtgggagcctgggggcgaggaggggttgagacccgcccgaccctcctcccggcgcggctgccgagtcctgcgcccccgccgggcsggcccctccctcctccgcgcaggggccgtttccctcctgaccccgcactcacccgcccaggtctcggtcagggtcagggcccccgagagcagcaggaaga

SEQ ID NO: 23473 - DNA, 201 bp, Homo sapiens
ccccagagctcatgatcccagagacagagagagagaaggtggaagccacagggagttttaggttctacacccagagtcacaagctgttacgtcggcattgytctatcagttagaagttgtattagtctgttctcacactgctataaagaaatacctgagactgggtaatttataaaggaaagaggtttaactgactcccag

SEQ ID NO: 23474 - DNA, 201 bp, Homo sapiens
ctgcattcccctaaacacttggcacttgttaacccataaaacttcacttcagtggccactcttgaagctctgtaaggtttatcttcacatactggagtgcrtgtgttttgccaatgactccagtgcactttctacctgctgctcattcaccgcagtcaacatgaagttgtcagtgaaatgagctgatttaatatcctatag

SEQ ID NO: 23475 - DNA, 201 bp, Homo sapiens
tggaatgtggtgttgtcagaactcaaagaggctcatcaggcagtgtgcttccttccttctggtgaggatgcaagatgaaacagtttgtcttttaccttggrgggaacacacctgcattcccctaaacacttggcacttgttaacccataaaacttcacttcagtggccactcttgaagctctgtaaggtttatcttcacat

SEQ ID NO: 23476 - DNA, 201 bp, Homo sapiens
tcctgtgtaggccctacttgaagctggcctcctcctatgtcacctagagtgtttgccaaagcacgtacctagatgtggaatgtggtgttgtcagaactcavagaggctcatcaggcagtgtgcttccttccttctggtgaggatgcaagatgaaacagtttgtcttttaccttggggggaacacacctgcattcccctaaa

SEQ ID NO: 23477 - DNA, 201 bp, Homo sapiens
cccagggggtctgagggacgctggctgcttgcaccatggcctggatctgctgcagggtcctttcctgtgtaggccctacttgaagctggcctcctcctatrtcacctagagtgtttgccaaagcacgtacctagatgtggaatgtggtgttgtcagaactcaaagaggctcatcaggcagtgtgcttccttccttctggtg

SEQ ID NO: 23478 - DNA, 201 bp, Homo sapiens
cactgtgactctcccactggtgcttggttctgctccatcctgcatctttccccaccactggcaccaccagccccagggggtctgagggacgctggctgctygcaccatggcctggatctgctgcagggtcctttcctgtgtaggccctacttgaagctggcctcctcctatgtcacctagagtgtttgccaaagcacgtac

SEQ ID NO: 23479 - DNA, 201 bp, Homo sapiens
ctctgctgtggatgacatgatcttactccagaatcccaggcccttcactgtgactctcccactggtgcttggttctgctccatcctgcatctttccccacmactggcaccaccagccccagggggtctgagggacgctggctgcttgcaccatggcctggatctgctgcagggtcctttcctgtgtaggccctacttgaag

SEQ ID NO: 23480 - DNA, 201 bp, Homo sapiens
accctacataggttgggagagggagaaaagaaactgcggagttggggaatccccaaggctgggactccccaatccatacaccgccttcggggcctgagacyctgagagccacgcctggggccctgggacttcgccctgacccctctgcttctgtgccaagcgctctgtctcaatgtctccctgagtcttggcccaagagct

SEQ ID NO: 23481 - DNA, 201 bp, Homo sapiens
tttggtttgatgcagtagcccaaaatgcttaactcgaattgagaatcaaattttttccaaaaacggctcaggggcattctattgtaaacttaacatttttkggtgtggtattgcatgagatgtggtagaagtgatttggacactactacagttctaaatagcactgctattatgtgcttctgaagctttcttttttttttt

SEQ ID NO: 23482 - DNA, 201 bp, Homo sapiens
ccgggccgggacatggtggtgtagaaatacctcatggagtgggagcctgggagcgaggaggagctgagacccgcccgaccctcctccctgcgcggctcccygggtcctgcgcccccgccgggcgggcccctcgctcctcccgaccatttccctgcagaccctgcactcacgcgcccaggtctgggtcagggccagggcccc

SEQ ID NO: 23483 - DNA, 201 bp, Homo sapiens
gccaattttcttattgacatatcatcttcagaaaacatttgcctacacttaaaaaaaaaatacacacacactgctctgtctatggagtagccattcttttstttctttacttctctaataaacttgctttcacttagaaaaaattgcataatcagattgcttctcatttacaaaaatgggaatctcatacttcagtcaaca

SEQ ID NO: 23484 - DNA, 201 bp, Homo sapiens
tcctccctgcgcggctccctgggtcctgcgcccccgccgggcgggcccctcgctcctcccgaccatttccctgcagaccctgcactcacgcgcccaggtcwgggtcagggccagggcccctgagagcagcaggaggagggttcggggcgccatgagcaccatcctcggcgtctggggagaatctgagtcccggtgggtgcg

SEQ ID NO: 23485 - DNA, 201 bp, Homo sapiens
gactaaattaatttttgtcgactgaatgaatgaaatatgagtgtattaaattgcattacagataattataaagtgcaaaacacggaaaaagttcagaaaawttttattttatgtaactagtgtgcatatcaattcatcaattcattcgtgcactaccatgcctggcgaaacaacacccatttatctgcttatagttccttg

SEQ ID NO: 23486 - DNA, 201 bp, Homo sapiens
tggacagaaggagacaaggtttactggatgtgccgtagaccacaggcaatctaaggagagttaagcaaggccatggaggagtccttgagctacagttggcyatcagaggagtccctggtctcccaggaatgtcctgctttcgtgtcactggtgtgatctgtcactggttgggaacagcccattggaagcaggacctcagca

SEQ ID NO: 23487 - DNA, 201 bp, Homo sapiens
gtcctggagggaaacctgttttcacagtaataccaagatgccatttgcctgtttcattatgttgacttttccattaatgctgcaaatgccaaggtcggtarcacacccagcaccttagcagaaccaaggcagtggctccaaactgcagtcccatttaagaatgcctttgatggagcagtaaaatatttatgttcattaaat

SEQ ID NO: 23488 - DNA, 201 bp, Homo sapiens
attggaagcaggacctcagcaccaatgctactgaggatgtcagagcacaggagcagggccttgggagattacccagcattactcaaaccttctgccctgaygggtctgggtccttggaaatcaagctgtctcaggctgaattgctggatgattctgctcacacttacaatgaggtaagggaaaccagaaggcccccaggtg

SEQ ID NO: 23489 - DNA, 201 bp, Homo sapiens
ccattttgaaagtgtggccccctgagctgccttcagagagtcctggagggaaacctgttttcacagtaataccaagatgccatttgcctgtttcattatgbtgacttttccattaatgctgcaaatgccaaggtcggtagcacacccagcaccttagcagaaccaaggcagtggctccaaactgcagtcccatttaagaat

SEQ ID NO: 23490 - DNA, 201 bp, Homo sapiens
ctcttgtaaatacctttaataacaatgttcttcaataagttaacacagttgagaacatagagtaactagatcaaatagttccaagacttcagtgccataaraatgatgccttgaaaataagtctttgttttgtctaagatgtctcaaatttagtggaagtatgccccaagtgccaattttcttattgacatatcatcttca

SEQ ID NO: 23491 - DNA, 201 bp, Homo sapiens
ggccttgggagattacccagcattactcaaaccttctgccctgacgggtctgggtccttggaaatcaagctgtctcaggctgaattgctggatgattctgytcacacttacaatgaggtaagggaaaccagaaggcccccaggtggatctctggtttccacacacacttccgccctcattgtgtgaaagtagccatgcctt

SEQ ID NO: 23492 - DNA, 201 bp, Homo sapiens
gaatgagggaaaaaaaagagcgagagagagtgctgaatctgaataggctaggggttgggtctcactaggaactataattgatctctgccattttgaaagtrtggccccctgagctgccttcagagagtcctggagggaaacctgttttcacagtaataccaagatgccatttgcctgtttcattatgttgacttttccatt

SEQ ID NO: 23493 - DNA, 201 bp, Homo sapiens
taggagcaccgcctagcctgcagatcaggaatgtcaacagcacccggagaggtgctggctgagtttctgagagcaggacatgaaaacacccatggaatagragcctatccctgtgaagatgaacctctggcccttccaggatggaagtagctaaatgtagtcaacttgttacttagtggctagttagtcacctaaagaaat

SEQ ID NO: 23494 - DNA, 201 bp, Homo sapiens
caggaaggtcagctggaagcatcctagaccctgtgcaggctaagggaagttcagtaagggtggcagggagccctggagcttcagtcagccttcagaagagraatgtcctgccttagtttctgccctactttcctcaatcattggctggaaaaagccaggggtgggcatagtctcagagcaaatgtggcaatagatttcaga

SEQ ID NO: 23495 - DNA, 201 bp, Homo sapiens
tgaaaatatatacaattataagttggaagaatgagggaaaaaaaagagcgagagagagtgctgaatctgaataggctaggggttgggtctcactaggaacbataattgatctctgccattttgaaagtgtggccccctgagctgccttcagagagtcctggagggaaacctgttttcacagtaataccaagatgccatttg

SEQ ID NO: 23496 - DNA, 201 bp, Homo sapiens
tgctttcatgcatataaagagatattaatcagatatatcagagtgataacttgaattttactgcactattctttcagcttctttgcacatttgaaaatatrtacaattataagttggaagaatgagggaaaaaaaagagcgagagagagtgctgaatctgaataggctaggggttgggtctcactaggaactataattgat

SEQ ID NO: 23497 - DNA, 201 bp, Homo sapiens
cagctgactttccccagagctcatgatcccagagacagagagagagaaggtggaagccacagggagttttaggttctacacccagagtcacaagctgttabgtcggcattgctctatcagttagaagttgtattagtctgttctcacactgctataaagaaatacctgagactgggtaatttataaaggaaagaggtttaa

SEQ ID NO: 23498 - DNA, 201 bp, Homo sapiens
ttttaaatttttaaattcgtatatattcatggggcacaggtgcagttttgctacattgctatattgagttgtggtaaagtcagggccttcagtgcatccascactggagacagatacattgaccccaacaagaaactcctctacgatacacccactgccaaccactcttacccttctgggtctctattgtctatcattcca

SEQ ID NO: 23499 - DNA, 201 bp, Homo sapiens
gccagatggaccttcctgcagggctgctcatggcacagcagctgactttccccagagctcatgatcccagagacagagagagagaaggtggaagccacagkgagttttaggttctacacccagagtcacaagctgttacgtcggcattgctctatcagttagaagttgtattagtctgttctcacactgctataaagaaat

SEQ ID NO: 23500 - DNA, 201 bp, Homo sapiens
cttagccagatggaccttcctgcagggctgctcatggcacagcagctgactttccccagagctcatgatcccagagacagagagagagaaggtggaagccrcagggagttttaggttctacacccagagtcacaagctgttacgtcggcattgctctatcagttagaagttgtattagtctgttctcacactgctataaag

SEQ ID NO: 23501 - DNA, 201 bp, Homo sapiens
tcttagccagatggaccttcctgcagggctgctcatggcacagcagctgactttccccagagctcatgatcccagagacagagagagagaaggtggaagckacagggagttttaggttctacacccagagtcacaagctgttacgtcggcattgctctatcagttagaagttgtattagtctgttctcacactgctataaa

SEQ ID NO: 23502 - DNA, 201 bp, Homo sapiens
ctaggcctgcatcatctgagggcttcactggggctgaggattcacatgaaacatggatcagtcacatggctgttggaaaaggcctagttcgttgtaattgrgtcccagaaggcctcagttcttagccagatggaccttcctgcagggctgctcatggcacagcagctgactttccccagagctcatgatcccagagacaga

SEQ ID NO: 23503 - DNA, 201 bp, Homo sapiens
gttgcttctaacagggggcatatgtctctgctgtggatgacatgatcttactccagaatcccaggcccttcactgtgactctcccactggtgcttggttcwgctccatcctgcatctttccccaccactggcaccaccagccccagggggtctgagggacgctggctgcttgcaccatggcctggatctgctgcagggtcc

SEQ ID NO: 23504 - DNA, 201 bp, Homo sapiens
agttgtcagtctaggcctgcatcatctgagggcttcactggggctgaggattcacatgaaacatggatcagtcacatggctgttggaaaaggcctagttcrttgtaattgagtcccagaaggcctcagttcttagccagatggaccttcctgcagggctgctcatggcacagcagctgactttccccagagctcatgatcc

SEQ ID NO: 23505 - DNA, 201 bp, Homo sapiens
aatccaggagaagtttccctgagtgcttcttgctaagggcctctcacaaggttgcagtccagttgtcagtctaggcctgcatcatctgagggcttcactgsggctgaggattcacatgaaacatggatcagtcacatggctgttggaaaaggcctagttcgttgtaattgagtcccagaaggcctcagttcttagccagat

SEQ ID NO: 23506 - DNA, 201 bp, Homo sapiens
gtacaaggaacactaaaagttgcttctaacagggggcatatgtctctgctgtggatgacatgatcttactccagaatcccaggcccttcactgtgactctbccactggtgcttggttctgctccatcctgcatctttccccaccactggcaccaccagccccagggggtctgagggacgctggctgcttgcaccatggcct

SEQ ID NO: 23507 - DNA, 201 bp, Homo sapiens
aaaatgtaccatttcaaaacaacaaatattgatcatctcccacagtttccaattgtcaggaatccaggagaagtttccctgagtgcttcttgctaagggcmtctcacaaggttgcagtccagttgtcagtctaggcctgcatcatctgagggcttcactggggctgaggattcacatgaaacatggatcagtcacatggct

SEQ ID NO: 23508 - DNA, 201 bp, Homo sapiens
agttgcctggtgtcctgtggtcaagctttctatcaaatcagtacaaggaacactaaaagttgcttctaacagggggcatatgtctctgctgtggatgacahgatcttactccagaatcccaggcccttcactgtgactctcccactggtgcttggttctgctccatcctgcatctttccccaccactggcaccaccagccc

SEQ ID NO: 23509 - DNA, 201 bp, Homo sapiens
atagttgcctggtgtcctgtggtcaagctttctatcaaatcagtacaaggaacactaaaagttgcttctaacagggggcatatgtctctgctgtggatgayatgatcttactccagaatcccaggcccttcactgtgactctcccactggtgcttggttctgctccatcctgcatctttccccaccactggcaccaccagc

SEQ ID NO: 23510 - DNA, 201 bp, Homo sapiens
tgctgttgggcctgtgcaatttatgatgttgtgggtcacaaaggcacttggaaccacatagttgcctggtgtcctgtggtcaagctttctatcaaatcagkacaaggaacactaaaagttgcttctaacagggggcatatgtctctgctgtggatgacatgatcttactccagaatcccaggcccttcactgtgactctcc

SEQ ID NO: 23511 - DNA, 201 bp, Homo sapiens
tcacttcatgatgaatgctgttgggcctgtgcaatttatgatgttgtgggtcacaaaggcacttggaaccacatagttgcctggtgtcctgtggtcaagcwttctatcaaatcagtacaaggaacactaaaagttgcttctaacagggggcatatgtctctgctgtggatgacatgatcttactccagaatcccaggccct

SEQ ID NO: 23512 - DNA, 201 bp, Homo sapiens
atcagacttgggtgttttctgtgggtgtaaacgtgggattcaagctcaatccaggtggaccattttcacttcatgatgaatgctgttgggcctgtgcaatktatgatgttgtgggtcacaaaggcacttggaaccacatagttgcctggtgtcctgtggtcaagctttctatcaaatcagtacaaggaacactaaaagttg

SEQ ID NO: 23513 - DNA, 201 bp, Homo sapiens
cagtgccacatcagacttgggtgttttctgtgggtgtaaacgtgggattcaagctcaatccaggtggaccattttcacttcatgatgaatgctgttgggcbtgtgcaatttatgatgttgtgggtcacaaaggcacttggaaccacatagttgcctggtgtcctgtggtcaagctttctatcaaatcagtacaaggaacac

SEQ ID NO: 23514 - DNA, 201 bp, Homo sapiens
tgctaaggacacagattaacacatagcaccatgacagtgtatgatattatcgctgttggttttttttttttttttttttagatggagttttgctctcgttrcccatgctggagtgcagtggcaccatctcggctcactgcaacctccacctcctgagttcaagcgattctcctgcctcagcctccagagtagctgagatta

SEQ ID NO: 23515 - DNA, 201 bp, Homo sapiens
attgttgtttggtgtctcttggtcaagcattctatcaaatcaggacaagtaacactaaatgttgcttctaacagggggcatatgtctctgctgtggatgayatgatcttactccagaatcccaggccctccattgtgactctcccactggtgcttggttcagctccatcctgcatctttccccaccactggcaccaccagc

SEQ ID NO: 23516 - DNA, 201 bp, Homo sapiens
agcttctcctctgccttcctcctctgcagaatctgactccaaccagggcaggctctctgcttttaatggctcttgtgatttgattgggcccacacagagaktccagcagaatctccctattttaaggtccttaatcttcattacatgagtaatatcccttttgccacgcaatgcaacctgttcacaggttccaacgattaa

SEQ ID NO: 23517 - DNA, 201 bp, Homo sapiens
tgctgttgggcctgtgcaatttatgactttgtgggtcacacagccacttggaaccacattgttgtttggtgtctcttggtcaagcattctatcaaatcagkacaagtaacactaaatgttgcttctaacagggggcatatgtctctgctgtggatgacatgatcttactccagaatcccaggccctccattgtgactctcc

SEQ ID NO: 23518 - DNA, 201 bp, Homo sapiens
gaaccctcagtgagacaagaaatctcagacccacccttcatcccttccccacctgagctcttcctcctccacctcacagcagcgaccacagctccagtgawcacagctccaaagagaaccaggccagcaatgatgcccacgatggggatggtgggctgggaagacggctctgggaaaagaggggaaggtgaggggccctga

SEQ ID NO: 23519 - DNA, 201 bp, Homo sapiens
gcaggtggagggcagaaccacagtgtttagggcctgcctttgtgtgcaggtgtctctacaggtgaggtgggactggggactgaggaagagaaggactgtgmgtgtgacccagcccagtcctggaaggacatggagccagggccagagcctctctttggggagtcctcctgctgtcagagctggccaggcttgagaggaggg

SEQ ID NO: 23520 - DNA, 201 bp, Homo sapiens
gtatctacaaagagagatgttattttatttttaaatttttaaattcgtatatattcatggggcacaggtgcagttttgctacattgctatattgagttgtrgtaaagtcagggccttcagtgcatccaccactggagacagatacattgaccccaacaagaaactcctctacgatacacccactgccaaccactcttaccc

SEQ ID NO: 23521 - DNA, 201 bp, Homo sapiens
acatacacacacattcacacacatgctatgcaaacatgtctacctgtatctacaaagagagatgttattttatttttaaatttttaaattcgtatatatthatggggcacaggtgcagttttgctacattgctatattgagttgtggtaaagtcagggccttcagtgcatccaccactggagacagatacattgaccccaa

SEQ ID NO: 23522 - DNA, 201 bp, Homo sapiens
tagacatgttctttcatgtttatattcaggtttgttgtcacatagacatttatccatgcgtgttttatgtttgttactttagaatggctcagtcacaaaakcttaatctcttcattcctgctgcctctctacacacacatacacacacattcacacacatgctatgcaaacatgtctacctgtatctacaaagagagatgt

SEQ ID NO: 23523 - DNA, 201 bp, Homo sapiens
tgtcttgtgaaaatgtattagttatttactattgcataacaaattatgtaaaatgtaccatttcaaaacaacaaatattgatcatctcccacagtttccarttgtcaggaatccaggagaagtttccctgagtgcttcttgctaagggcctctcacaaggttgcagtccagttgtcagtctaggcctgcatcatctgaggg

SEQ ID NO: 23524 - DNA, 201 bp, Homo sapiens
gcaaatgcaaattaacatgtaataatacatcctgtcttgtgaaaatgtattagttatttactattgcataacaaattatgtaaaatgtaccatttcaaaabaacaaatattgatcatctcccacagtttccaattgtcaggaatccaggagaagtttccctgagtgcttcttgctaagggcctctcacaaggttgcagtcc

SEQ ID NO: 23525 - DNA, 201 bp, Homo sapiens
ctccagcctgggtgacagagtgagaccctgtctcaaaaataataataatgatgatgataaatttagagcaaatgcaaattaacatgtaataatacatcctstcttgtgaaaatgtattagttatttactattgcataacaaattatgtaaaatgtaccatttcaaaacaacaaatattgatcatctcccacagtttccaat

SEQ ID NO: 23526 - DNA, 201 bp, Homo sapiens
cctgttccctgcctgcctgtgttcgcagggtaaccagtaagggagctggggtagggaattctttcataggttatctagccagagatatgtttatagacatrttctttcatgtttatattcaggtttgttgtcacatagacatttatccatgcgtgttttatgtttgttactttagaatggctcagtcacaaaatcttaatc

SEQ ID NO: 23527 - DNA, 201 bp, Homo sapiens
ggtgatcatgccactgcactccagcctgggtgacagagtgagaccctgtctcaaaaataataataatgatgatgataaatttagagcaaatgcaaattaayatgtaataatacatcctgtcttgtgaaaatgtattagttatttactattgcataacaaattatgtaaaatgtaccatttcaaaacaacaaatattgatca

SEQ ID NO: 23528 - DNA, 201 bp, Homo sapiens
cagaggaaggcagatttgttgactccagaagttcaagatcagcctgggcaacatggggaaacccccatctctacaaaaaattagaaaattagccaggcatrgtggttcatgattgtactcccagctactcaagaggctgaggtcagagggtcccttgagcccaggaggtctacactgcagtgcatggtgatcatgccactg

SEQ ID NO: 23529 - DNA, 201 bp, Homo sapiens
gcagaggaaggcagatttgttgactccagaagttcaagatcagcctgggcaacatggggaaacccccatctctacaaaaaattagaaaattagccaggcahggtggttcatgattgtactcccagctactcaagaggctgaggtcagagggtcccttgagcccaggaggtctacactgcagtgcatggtgatcatgccact

SEQ ID NO: 23530 - DNA, 201 bp, Homo sapiens
gagttccaggatctgagaggccaggaagcgagggcatcttctctgctgtgtgggtgtctattgctgccataaaaattaccacaaaccaaatggctttaaamagcacctatgtatcatggcacagtcgtgtggattgcaagtccacccagtctcatggggctaagatcaacatacgggaaggtctgcattcctttccataga

SEQ ID NO: 23531 - DNA, 201 bp, Homo sapiens
aatcctagcattgtggaaggcagaggaaggcagatttgttgactccagaagttcaagatcagcctgggcaacatggggaaacccccatctctacaaaaaabtagaaaattagccaggcatggtggttcatgattgtactcccagctactcaagaggctgaggtcagagggtcccttgagcccaggaggtctacactgcagt

SEQ ID NO: 23532 - DNA, 201 bp, Homo sapiens
ccagatttggtggctcgcacctgcaatcctagcattgtggaaggcagaggaaggcagatttgttgactccagaagttcaagatcagcctgggcaacatggrgaaacccccatctctacaaaaaattagaaaattagccaggcatggtggttcatgattgtactcccagctactcaagaggctgaggtcagagggtcccttg

SEQ ID NO: 23533 - DNA, 201 bp, Homo sapiens
tcctatgggcccttctggattcatttattagtgctagccagtttttatctgcttgtgaattctacagacagggtcatgttatctgtgaatagaattgtatrttttcctttttatctggatgcctttaatttttaattttctgccttattgcactggctacaatctccagtataatattaaataaaagtggtgggattggac

SEQ ID NO: 23534 - DNA, 201 bp, Homo sapiens
ataaaatacatccttttcagccacgaaaattctccttaccttttaaaactaagttacatatttatatcttttaattaatttaggccagatttggtggctcrcacctgcaatcctagcattgtggaaggcagaggaaggcagatttgttgactccagaagttcaagatcagcctgggcaacatggggaaacccccatctcta

SEQ ID NO: 23535 - DNA, 201 bp, Homo sapiens
cagttgagcatatttgtgtgttttgctcattttcagttgagttgctcatcttcttacacattgagtttaagaacttgccacattattctggaaacatgttyttcaacacaaatgtaatttgtgataaattgtgaaatattttctccctgtctatggcttgtcttctcattctctcaatgtcttttggagcactcaagtttt

SEQ ID NO: 23536 - DNA, 201 bp, Homo sapiens
tggatcttctttttgtgttcacttgggacacagttgcaaattgaagttcaagtaaagtaatcattgtgaacggtaataaaatacatccttttcagccacgraaattctccttaccttttaaaactaagttacatatttatatcttttaattaatttaggccagatttggtggctcgcacctgcaatcctagcattgtggaa

SEQ ID NO: 23537 - DNA, 201 bp, Homo sapiens
atggtgaaggctggctaactgccatttgtctgtttggttgttcagtgccacatcagacttgggtgttttctgtgggtgtaaacgtgggattcaagctcaayccaggtggaccattttcacttcatgatgaatgctgttgggcctgtgcaatttatgatgttgtgggtcacaaaggcacttggaaccacatagttgcctggt

SEQ ID NO: 23538 - DNA, 201 bp, Homo sapiens
tcttccctgcccagccacctgtcccagagctggagacgcccaggtttaagccagagactttggatactttccttgatggtgacataatttttgtcttcttctctcctggaagagaagccccagaaccatcagagtgatccagtctgcccactcttcttattattctgtctctccaatcactctccctgagctggactctcc

SEQ ID NO: 23539 - DNA, 201 bp, Homo sapiens
ctgtggttgctccattcatgcactcatcctaccaggcctgggctgacccatggtgaaggctggctaactgccatttgtctgtttggttgttcagtgccacwtcagacttgggtgttttctgtgggtgtaaacgtgggattcaagctcaatccaggtggaccattttcacttcatgatgaatgctgttgggcctgtgcaatt

SEQ ID NO: 23540 - DNA, 201 bp, Homo sapiens
gtcttccctgcccagccacctgtcccagagctggagacgcccaggtttaagccagagactttggatactttccttgatggtgacataatttttgtcttcttctctcctggaagagaagccccagaaccatcagagtgatccagtctgcccactcttcttattattctgtctctccaatcactctccctgagctggactctc

SEQ ID NO: 23541 - DNA, 201 bp, Homo sapiens
aagtcagtgctgctggcactcatgcctgccactgtggttgctccattcatgcactcatcctaccaggcctgggctgacccatggtgaaggctggctaactkccatttgtctgtttggttgttcagtgccacatcagacttgggtgttttctgtgggtgtaaacgtgggattcaagctcaatccaggtggaccattttcact

SEQ ID NO: 23542 - DNA, 201 bp, Homo sapiens
ttggacattcagaggtggcagcagctggatctgccttggtagggggaagtcagtgctgctggcactcatgcctgccactgtggttgctccattcatgcacycatcctaccaggcctgggctgacccatggtgaaggctggctaactgccatttgtctgtttggttgttcagtgccacatcagacttgggtgttttctgtgg

SEQ ID NO: 23543 - DNA, 201 bp, Homo sapiens
ggcagaagagccgtgggaggagctgctgagctctccaggccgccctttacctcctgcctccccagcccagttcatcttgatcctctcctcactagcccagktctccccaaggtcagggctcatagagcagcaggagttgggttccgggacgcgggatccggcttctctgggaatcttggattccaggaaggatcctggaga

SEQ ID NO: 23544 - DNA, 201 bp, Homo sapiens
ccactagggcacatcatgggcctaaaatgctgatgagttggacattcagaggtggcagcagctggatctgccttggtagggggaagtcagtgctgctggcmctcatgcctgccactgtggttgctccattcatgcactcatcctaccaggcctgggctgacccatggtgaaggctggctaactgccatttgtctgtttggt

SEQ ID NO: 23545 - DNA, 201 bp, Homo sapiens
ccccatcccgctgccaggtcagtatgatctccgcagggtagaagcccagggcccagcacctcagggtggcctcatagtcaaagacagggtggtgggtcacrtgtgtcttgggggggtctgaaaggaagagtcagaaaactcaagcactttgcatctctcatgggacactccagcagcacctggatgtgaccatcctaagaa

SEQ ID NO: 23546 - DNA, 201 bp, Homo sapiens
gctggatcttctttttgtgttcacttgggacacagttgcaaattgaagttcaagtaaagtaatcattgtgaacggtaataaaatacatccttttcagccabgaaaattctccttaccttttaaaactaagttacatatttatatcttttaattaatttaggccagatttggtggctcgcacctgcaatcctagcattgtgg

SEQ ID NO: 23547 - DNA, 201 bp, Homo sapiens
ggaaggtgaatgaccaggagcttgttgttgaggccatcatagaatcagcctagcaagggctggatcttctttttgtgttcacttgggacacagttgcaaaytgaagttcaagtaaagtaatcattgtgaacggtaataaaatacatccttttcagccacgaaaattctccttaccttttaaaactaagttacatatttata

SEQ ID NO: 23548 - DNA, 201 bp, Homo sapiens
aagcagcataaacccagcctaaagtcaactaattgaggcccttaattatatctgctaaatcccttcacagcagcacctatattagagttggttgaataatdgggggaaggtgaatgaccaggagcttgttgttgaggccatcatagaatcagcctagcaagggctggatcttctttttgtgttcacttgggacacagttgc

SEQ ID NO: 23549 - DNA, 201 bp, Homo sapiens
caagcagcataaacccagcctaaagtcaactaattgaggcccttaattatatctgctaaatcccttcacagcagcacctatattagagttggttgaataabggggggaaggtgaatgaccaggagcttgttgttgaggccatcatagaatcagcctagcaagggctggatcttctttttgtgttcacttgggacacagttg

SEQ ID NO: 23550 - DNA, 201 bp, Homo sapiens
ttagtcacctgaggtgcatatcttggcttcctggccagttttcccaaggcctccactgccaccctgcaccctgggtgccctccacactctccaagtgtccwgatgtgtgtgaggagttaagggcaggaagaactattggatcgtggatttaggtgcctttttccacctctgcaggtggcaaggtgtggattcataagctgg

SEQ ID NO: 23551 - DNA, 201 bp, Homo sapiens
ctcacctgattaggacagtccaagcagcataaacccagcctaaagtcaactaattgaggcccttaattatatctgctaaatcccttcacagcagcacctabattagagttggttgaataatggggggaaggtgaatgaccaggagcttgttgttgaggccatcatagaatcagcctagcaagggctggatcttctttttgt

SEQ ID NO: 23552 - DNA, 201 bp, Homo sapiens
acatgggggtggggtggtctccccacctcctcacattatgcctacacgaacacagacacatgcaggtgcctttgcagaaacaaagtcagggttcttcaagycacaaagggaagggcaggaacaactcttgcctctcagtcccacacaaggcagctgtctcacactatagaaaaaaatattcatgaacaaattcatatctgt

SEQ ID NO: 23553 - DNA, 201 bp, Homo sapiens
cccagtcctttcaaggactcacctgattaggacagtccaagcagcataaacccagcctaaagtcaactaattgaggcccttaattatatctgctaaatccvttcacagcagcacctatattagagttggttgaataatggggggaaggtgaatgaccaggagcttgttgttgaggccatcatagaatcagcctagcaaggg

SEQ ID NO: 23554 - DNA, 201 bp, Homo sapiens
aagcgtgaggtttgggctcagcctattttttttccactgtggttgtccagttgctccagcaccatttgttgggaaagctctccttccttcattgaattgtktttgtgcttttgtaaatgtcagttgagcatatttgtgtgttttgctcattttcagttgagttgctcatcttcttacacattgagtttaagaacttgccac

SEQ ID NO: 23555 - DNA, 201 bp, Homo sapiens
ttccctgtacagccccttcattttcaaagcccacagtggaggaaacccctcatgctgaatccctctcacactgtgaatctctatgctcaggaagaacccartcctttcaaggactcacctgattaggacagtccaagcagcataaacccagcctaaagtcaactaattgaggcccttaattatatctgctaaatcccttca

SEQ ID NO: 23556 - DNA, 201 bp, Homo sapiens
ggctcaatgtttgtaattttaactgtgtgttttacattaaagcctgtgattcattttgagtttttttttttttgtataaagcgtgaggtttgggctcagcytattttttttccactgtggttgtccagttgctccagcaccatttgttgggaaagctctccttccttcattgaattgtgtttgtgcttttgtaaatgtcag

SEQ ID NO: 23557 - DNA, 201 bp, Homo sapiens
gggaaactcctgcagaattctcaggaaaggaaactcttccgagctgggcccttggcttagtttgtcttccctgcccagccacctgtcccagagctggagaygcccaggtttaagccagagactttggatactttccttgatggtgacataatttttgtcttcttctctcctggaagagaagccccagaaccatcagagtga

SEQ ID NO: 23558 - DNA, 201 bp, Homo sapiens
gaagatgaacctctggtccttccaggatggaagtaggtaaatgtagtcaacttcttagttaatgactagtcacctaaagaaatagtgccccactagggcabatcatgggcctaaaatgctgatgagttggacattcagaggtggcagcagctggatctgccttggtagggggaagtcagtgctgctggcactcatgcctgc

SEQ ID NO: 23559 - DNA, 201 bp, Homo sapiens
ttggtgttatgtgtaagaactctttgtctagtcttagttctgatggctttttgttaaaagatttgtaattttaattttttaatgtatttgttatttatttwaaaaaaaatcttgcctaggctggccttgaactcctgggctcaagggatcctcccacctcagtctcctgagtaggtgagagtacaggcctgtgacaccaca

SEQ ID NO: 23560 - DNA, 201 bp, Homo sapiens
gggaggggacagagggacagggaccacgggagggtggcgtggggcggcgtacttggagatatgacctgaggagtctgcagaccccagaccggggcagaagmgccgtgggaggagctgctgagctctccaggccgccctttacctcctgcctccccagcccagttcatcttgatcctctcctcactagcccaggtctcccca

SEQ ID NO: 23561 - DNA, 201 bp, Homo sapiens
cagaaaaccccccctagaataggtacctaaccctgtgaagatgaacctctggtccttccaggatggaagtaggtaaatgtagtcaacttcttagttaatgrctagtcacctaaagaaatagtgccccactagggcacatcatgggcctaaaatgctgatgagttggacattcagaggtggcagcagctggatctgccttgg

SEQ ID NO: 23562 - DNA, 201 bp, Homo sapiens
atgcagtttcttgcagttgtaagactgaggtccgcgttccttgctggctgtcaatgtagagaacagggagggctgcgctcaattcctgatgcccaccagcrttcttccctgtacagccccttcattttcaaagcccacagtggaggaaacccctcatgctgaatccctctcacactgtgaatctctatgctcaggaagaac

SEQ ID NO: 23563 - DNA, 201 bp, Homo sapiens
ggtgtagggggagctggggaggggacagagggacagggaccacgggagggtggcgtggggcggcgtacttggagatatgacctgaggagtctgcagacccbagaccggggcagaagagccgtgggaggagctgctgagctctccaggccgccctttacctcctgcctccccagcccagttcatcttgatcctctcctcact

SEQ ID NO: 23564 - DNA, 201 bp, Homo sapiens
ttccccacttctgtgtatctggcagggggtggtgatttctcatccttgaacctaattgcactgtcagttggcccctcaggcctgggcagatgggatggttmatcccctgccctgcagcaagagggccctgtccaggaggcacccacagcaggggcagtgcaggtctgtggtcgctcctgctctcacctgtggtgtctcctg

SEQ ID NO: 23565 - DNA, 201 bp, Homo sapiens
aatgcagtttcttgcagttgtaagactgaggtccgcgttccttgctggctgtcaatgtagagaacagggagggctgcgctcaattcctgatgcccaccagbgttcttccctgtacagccccttcattttcaaagcccacagtggaggaaacccctcatgctgaatccctctcacactgtgaatctctatgctcaggaagaa

SEQ ID NO: 23566 - DNA, 201 bp, Homo sapiens
ttgtctcatccaaccagtgatataattccttccttgcagaagaataagtgagaaaagacacagtgccaagaaattcagacacaagacctgcggaagtctgygccagtgctctaaagcaagttctgcctaaagcggcagaaacatttttcacattaggaacaggagttgtttgggatcctgtctggggccaggttgagagca

SEQ ID NO: 23567 - DNA, 201 bp, Homo sapiens
aggcagataatgggctaggagcactgcctagcctgcagaccaggaatgtcaacagcacccagagagtggtactggctgtgtctgagagcaggacagaaaamcccccctagaataggtacctaaccctgtgaagatgaacctctggtccttccaggatggaagtaggtaaatgtagtcaacttcttagttaatgactagtca

SEQ ID NO: 23568 - DNA, 201 bp, Homo sapiens
caagtcaggtggacttgaatatgaaccctccaggcctttccaccaactagctatagagccttgggcacatctggcccagagctggccccgacagacacttkcccagtgggtgagtgctcaatgaacccatctgagccaattgtctcatccaaccagtgatataattccttccttgcagaagaataagtgagaaaagacaca

SEQ ID NO: 23569 - DNA, 201 bp, Homo sapiens
ttcccttgccaagtggatccttcaggcagataatgggctaggagcactgcctagcctgcagaccaggaatgtcaacagcacccagagagtggtactggctrtgtctgagagcaggacagaaaaccccccctagaataggtacctaaccctgtgaagatgaacctctggtccttccaggatggaagtaggtaaatgtagtca

SEQ ID NO: 23570 - DNA, 201 bp, Homo sapiens
tgagttttcaagtcaggtggacttgaatatgaaccctccaggcctttccaccaactagctatagagccttgggcacatctggcccagagctggccccgacrgacacttgcccagtgggtgagtgctcaatgaacccatctgagccaattgtctcatccaaccagtgatataattccttccttgcagaagaataagtgagaa

SEQ ID NO: 23571 - DNA, 201 bp, Homo sapiens
aacactgaatctttcccttgccaagtggatccttcaggcagataatgggctaggagcactgcctagcctgcagaccaggaatgtcaacagcacccagagartggtactggctgtgtctgagagcaggacagaaaaccccccctagaataggtacctaaccctgtgaagatgaacctctggtccttccaggatggaagtagg

SEQ ID NO: 23572 - DNA, 201 bp, Homo sapiens
catggaaacactgaatctttcccttgccaagtggatccttcaggcagataatgggctaggagcactgcctagcctgcagaccaggaatgtcaacagcaccyagagagtggtactggctgtgtctgagagcaggacagaaaaccccccctagaataggtacctaaccctgtgaagatgaacctctggtccttccaggatgga

SEQ ID NO: 23573 - DNA, 201 bp, Homo sapiens
ttataaagggggaatcagtacttaagtaaggtcaatatgagttttcaagtcaggtggacttgaatatgaaccctccaggcctttccaccaactagctataragccttgggcacatctggcccagagctggccccgacagacacttgcccagtgggtgagtgctcaatgaacccatctgagccaattgtctcatccaaccag

SEQ ID NO: 23574 - DNA, 201 bp, Homo sapiens
gccatggaaacactgaatctttcccttgccaagtggatccttcaggcagataatgggctaggagcactgcctagcctgcagaccaggaatgtcaacagcabccagagagtggtactggctgtgtctgagagcaggacagaaaaccccccctagaataggtacctaaccctgtgaagatgaacctctggtccttccaggatg

SEQ ID NO: 23575 - DNA, 201 bp, Homo sapiens
gaccctcctcccggcgcggctacccgggtcctgcgtccccgccgggcgggccccttgcttctccccgcagaggcggtttccccacgaccccgcactcaccygcccaggtctgggtcagggccagggcccccaagagtagcaggaggagggttcggggcgccatgacggccatcctcggcgtctggggagaatctgagtccc

SEQ ID NO: 23576 - DNA, 201 bp, Homo sapiens
accgcacgaactgcgtgtcgtccacgtagcccacggcgatgaagcggggctccccgcggccgggccgggacacggatgtggtgaaatacctcatggagtgrgagcctgggggcgaggagtggctgagacccacccgaccctcctcccggcgcggctacccgggtcctgcgtccccgccgggcgggccccttgcttctcccc

SEQ ID NO: 23577 - DNA, 201 bp, Homo sapiens
ggcattccttgtggctggcagcccctggggagagtagctggtgatagggttagtggaagcaacagccatggaaacactgaatctttcccttgccaagtggrtccttcaggcagataatgggctaggagcactgcctagcctgcagaccaggaatgtcaacagcacccagagagtggtactggctgtgtctgagagcaggac

SEQ ID NO: 23578 - DNA, 201 bp, Homo sapiens
gaatggaacaaccacagtggcaggtgtgaggctacatatggggcattccttgtggctggcagcccctggggagagtagctggtgatagggttagtggaagsaacagccatggaaacactgaatctttcccttgccaagtggatccttcaggcagataatgggctaggagcactgcctagcctgcagaccaggaatgtcaac

SEQ ID NO: 23579 - DNA, 201 bp, Homo sapiens
atgtccgccgcggtccaagagcgcaggtcctcgttcaaggcgatgtaatccttgccgtcgtaggcgtcctgccggtacccgcggaggaagcgcccgtccgrccccacgtcgcagccatacatcatctggatggtgtgagaacctggccccgaccccacggtcagcccagtcccccgagccccgtccggccccgaccaaccc

SEQ ID NO: 23580 - DNA, 201 bp, Homo sapiens
gaaaatgatccacctgggttgagcttgaatcccatgttgacacccacagaaaacagccaagtctgaagtgtcattaaacaacgaaacagacaaatggaagytagccagccttcactatgggtcagcccatgcatgataggatgggcacatgaatggaacaaccacagtggcaggtgtgaggctacatatggggcattcctt

SEQ ID NO: 23581 - DNA, 201 bp, Homo sapiens
catcccgctgccaggtcagtgtgatctccgcagggtagaagctcagggcccagcacctcagggtggcttcatggtcagagacagcgtggtgagtcatatgygttttgggggcgtctgtcaggaagagtcagatcattcaggcattttgcatctgtcatgggacactcctccagcacacatgtggctatcttgagaatggac

SEQ ID NO: 23582 - DNA, 201 bp, Homo sapiens
ggtcctccccatcccgctgccaggtcagtgtgatctccgcagggtagaagctcagggcccagcacctcagggtggcttcatggtcagagacagcgtggtgrgtcatatgcgttttgggggcgtctgtcaggaagagtcagatcattcaggcattttgcatctgtcatgggacactcctccagcacacatgtggctatcttg

SEQ ID NO: 23583 - DNA, 201 bp, Homo sapiens
tacacattgagtttaagaacttgccacattattctggaaacatgttcttcaacacaaatgtaatttgtgataaattgtgaaatattttctccctgtctatrgcttgtcttctcattctctcaatgtcttttggagcactcaagttttaaattttaactaagcccaatttctctctctcttttttttttatttgtagatcat

SEQ ID NO: 23584 - DNA, 201 bp, Homo sapiens
tcctgggtctggtcctccccatcccgctgccaggtcagtgtgatctccgcagggtagaagctcagggcccagcacctcagggtggcttcatggtcagagayagcgtggtgagtcatatgcgttttgggggcgtctgtcaggaagagtcagatcattcaggcattttgcatctgtcatgggacactcctccagcacacatgt

SEQ ID NO: 23585 - DNA, 201 bp, Homo sapiens
atcacgggactccaagcaactatgtggttccaagtgcctgtgtgacccagaaagtcatagattgcacaggccaaacagcattcatcatgaggtgaaaatgrtccacctgggttgagcttgaatcccatgttgacacccacagaaaacagccaagtctgaagtgtcattaaacaacgaaacagacaaatggaagctagccag

SEQ ID NO: 23586 - DNA, 201 bp, Homo sapiens
tgcctgtggaagatcacgggactccaagcaactatgtggttccaagtgcctgtgtgacccagaaagtcatagattgcacaggccaaacagcattcatcatraggtgaaaatgatccacctgggttgagcttgaatcccatgttgacacccacagaaaacagccaagtctgaagtgtcattaaacaacgaaacagacaaatg

SEQ ID NO: 23587 - DNA, 201 bp, Homo sapiens
ttcaggcttatacagaggtggcagaatgcagtttcttgcagttgtaagactgaggtccgcgttccttgctggctgtcaatgtagagaacagggagggctgygctcaattcctgatgcccaccagcgttcttccctgtacagccccttcattttcaaagcccacagtggaggaaacccctcatgctgaatccctctcacact

SEQ ID NO: 23588 - DNA, 201 bp, Homo sapiens; identical to SEQ ID NO: 4325

SEQ ID NO: 23589 - DNA, 201 bp, Homo sapiens
ttccgggcttcccaaagctgtgttttcattttgaatcctccttcaggcttatacagaggtggcagaatgcagtttcttgcagttgtaagactgaggtccgbgttccttgctggctgtcaatgtagagaacagggagggctgcgctcaattcctgatgcccaccagcgttcttccctgtacagccccttcattttcaaagcc

SEQ ID NO: 23590 - DNA, 201 bp, Homo sapiens
gttccgggcttcccaaagctgtgttttcattttgaatcctccttcaggcttatacagaggtggcagaatgcagtttcttgcagttgtaagactgaggtccscgttccttgctggctgtcaatgtagagaacagggagggctgcgctcaattcctgatgcccaccagcgttcttccctgtacagccccttcattttcaaagc

SEQ ID NO: 23591 - DNA, 201 bp, Homo sapiens
gtggatggaatctctgttccgggcttcccaaagctgtgttttcattttgaatcctccttcaggcttatacagaggtggcagaatgcagtttcttgcagttstaagactgaggtccgcgttccttgctggctgtcaatgtagagaacagggagggctgcgctcaattcctgatgcccaccagcgttcttccctgtacagccc

SEQ ID NO: 23592 - DNA, 201 bp, Homo sapiens
ggtgtgcattaccacgcctggccaaacaacacccatttatctgtttatagtaccttagtcagaaatctgggcatgatgtggatggaatctctgttccgggmttcccaaagctgtgttttcattttgaatcctccttcaggcttatacagaggtggcagaatgcagtttcttgcagttgtaagactgaggtccgcgttcctt

SEQ ID NO: 23593 - DNA, 201 bp, Homo sapiens
aattatgaataattacttccaggagtattatgaataaagctgcaagagtatttgtatacaggtttttcatgaacataaagttttcccttgtttgaaataartgcctaggagggcaatttctagtcatatggtaaattgcatgttcagtttgaagaaaactgcaatatccatttccagagtggctgtaccattttaaaatcc

SEQ ID NO: 23594 - DNA, 201 bp, Homo sapiens
acatctattcagacactttgtccattttttaattggattatttgtgtttttactgctgagttttttaagttccttgtatattctagatgttagttccttgbtggatgaatacatagcaaatattttctctattcaacaggttgcctcttcattctgttgattgtttcatttgctgtgctgaagctatttagtttaatatag

SEQ ID NO: 23595 - DNA, 201 bp, Homo sapiens
ctcccagctaattaaaaagaaattgtagagatgagtgtctcactgtttgatcttggctggtctcaaactcctggatgcaagtgatcctcctgtgtcaactyctcagatgttaggattgcaggtgtgcattaccacgcctggccaaacaacacccatttatctgtttatagtaccttagtcagaaatctgggcatgatgtgg

SEQ ID NO: 23596 - DNA, 201 bp, Homo sapiens
ccactcccagctaattaaaaagaaattgtagagatgagtgtctcactgtttgatcttggctggtctcaaactcctggatgcaagtgatcctcctgtgtcarctcctcagatgttaggattgcaggtgtgcattaccacgcctggccaaacaacacccatttatctgtttatagtaccttagtcagaaatctgggcatgatg

SEQ ID NO: 23597 - DNA, 201 bp, Homo sapiens
cagagtagctaggactgcaggcaagtgccaccactcccagctaattaaaaagaaattgtagagatgagtgtctcactgtttgatcttggctggtctcaaaktcctggatgcaagtgatcctcctgtgtcaactcctcagatgttaggattgcaggtgtgcattaccacgcctggccaaacaacacccatttatctgtttat

SEQ ID NO: 23598 - DNA, 201 bp, Homo sapiens
tcactgcagcctcaaactcctgggctcaagggatcttcctgcctcagtcttcagagtagctaggactgcaggcaagtgccaccactcccagctaattaaaragaaattgtagagatgagtgtctcactgtttgatcttggctggtctcaaactcctggatgcaagtgatcctcctgtgtcaactcctcagatgttaggatt

SEQ ID NO: 23599 - DNA, 201 bp, Homo sapiens
atcatggctcactgcagcctcaaactcctgggctcaagggatcttcctgcctcagtcttcagagtagctaggactgcaggcaagtgccaccactcccagcwaattaaaaagaaattgtagagatgagtgtctcactgtttgatcttggctggtctcaaactcctggatgcaagtgatcctcctgtgtcaactcctcagatg

SEQ ID NO: 23600 - DNA, 201 bp, Homo sapiens
gctcgcggcgtcgctgtcaaaccgcacgaactgcgtgtcgtccacgtagcccacggcgatgaagcggggctccccgcggccgggccgggacacggatgtgdtgaaatacctcatggagtgggagcctgggggcgaggagtggctgagacccacccgaccctcctcccggcgcggctacccgggtcctgcgtccccgccggg

SEQ ID NO: 23601 - DNA, 201 bp, Homo sapiens
tctggctcgcggcgtcgctgtcaaaccgcacgaactgcgtgtcgtccacgtagcccacggcgatgaagcggggctccccgcggccgggccgggacacggakgtggtgaaatacctcatggagtgggagcctgggggcgaggagtggctgagacccacccgaccctcctcccggcgcggctacccgggtcctgcgtccccgc

SEQ ID NO: 23602 - DNA, 201 bp, Homo sapiens
tttcaaggactcacctgattaggacagtccaagcagcataaacccagcctaaagtcaactaattgaggcccttaattatatctgctaaatcccttcacagyagcacctatattagagttggttgaataatggggggaaggtgaatgaccaggagcttgttgttgaggccatcatagaatcagcctagcaagggctggatct

SEQ ID NO: 23603 - DNA, 201 bp, Homo sapiens
caagtgattctcctgcctcagcctcccaagtagctgggattaccagcatgggccaccatgcctggataattttgtatttttagtagagacggggtttctcygtgttggtcaggctagtctccaactcccaacctcaggtgatccatccacctcagccttccaaagtgctgggattacaggcgtgagccactgcacctggcc

SEQ ID NO: 23604 - DNA, 201 bp, Homo sapiens
caccgtttgatttctggacccacatgttcttcctcttgcgaacacagaactgtagagacgactctgatttaaacaacgcaccatgtcctgaaagatggcaygcaaccctcagagtgcttcctccaggctggcacttagttgtgcctgtggaagatcacgggactccaagcaactatgtggttccaagtgcctgtgtgaccc

SEQ ID NO: 23605 - DNA, 201 bp, Homo sapiens
aacatgtcaaataccccattaggtgaatctaagagattagacatggagccatacctgcttccaccgtttgatttctggacccacatgttcttcctcttgcraacacagaactgtagagacgactctgatttaaacaacgcaccatgtcctgaaagatggcacgcaaccctcagagtgcttcctccaggctggcacttagtt

SEQ ID NO: 23606 - DNA, 201 bp, Homo sapiens
aaggttgagtgtttttcgtatacctgttgaccatttgtatgtctccttttgagaaacatctattcagacactttgtccattttttaattggattatttgtrtttttactgctgagttttttaagttccttgtatattctagatgttagttccttgctggatgaatacatagcaaatattttctctattcaacaggttgcct

SEQ ID NO: 23607 - DNA, 201 bp, Homo sapiens
tcacatgatcatggctcactgcagcctcaaactcctgggctcaagggatcttcctgcctcagtcttcagagtagctaggactgcaggcaagtgccaccacdcccagctaattaaaaagaaattgtagagatgagtgtctcactgtttgatcttggctggtctcaaactcctggatgcaagtgatcctcctgtgtcaactcc

SEQ ID NO: 23608 - DNA, 201 bp, Homo sapiens
agggtgaagtgcagtcacatgatcatggctcactgcagcctcaaactcctgggctcaagggatcttcctgcctcagtcttcagagtagctaggactgcagrcaagtgccaccactcccagctaattaaaaagaaattgtagagatgagtgtctcactgtttgatcttggctggtctcaaactcctggatgcaagtgatcct

SEQ ID NO: 23609 - DNA, 201 bp, Homo sapiens
tgatttgcattttcctgatatttaataaggttgagtgtttttcgtatacctgttgaccatttgtatgtctccttttgagaaacatctattcagacactttrtccattttttaattggattatttgtgtttttactgctgagttttttaagttccttgtatattctagatgttagttccttgctggatgaatacatagcaaa

SEQ ID NO: 23610 - DNA, 201 bp, Homo sapiens
cctctgtcatccagggtgaagtgcagtcacatgatcatggctcactgcagcctcaaactcctgggctcaagggatcttcctgcctcagtcttcagagtagvtaggactgcaggcaagtgccaccactcccagctaattaaaaagaaattgtagagatgagtgtctcactgtttgatcttggctggtctcaaactcctggat

SEQ ID NO: 23611 - DNA, 201 bp, Homo sapiens
tctccctctgtcatccagggtgaagtgcagtcacatgatcatggctcactgcagcctcaaactcctgggctcaagggatcttcctgcctcagtcttcagartagctaggactgcaggcaagtgccaccactcccagctaattaaaaagaaattgtagagatgagtgtctcactgtttgatcttggctggtctcaaactcct

SEQ ID NO: 23612 - DNA, 201 bp, Homo sapiens
ggtggctcatgtctgtaatcccagcactttggaaggccgaagttggtggatcacctgaggtcaggagtttgagaccaacctggacaatatggtgaaacccygtctctactaaaaatacaaaaattacctgggtgtcgtggtggatgcctataattccagctactcaggaggctgaggtaggagaattgcttgaacctggga

SEQ ID NO: 23613 - DNA, 201 bp, Homo sapiens
gcacacaaggtgcattttgaaaaatgacactttaaagatttgtgggccgggaatggtggctcatgtctgtaatcccagcactttggaaggccgaagttggyggatcacctgaggtcaggagtttgagaccaacctggacaatatggtgaaaccccgtctctactaaaaatacaaaaattacctgggtgtcgtggtggatgc

SEQ ID NO: 23614 - DNA, 201 bp, Homo sapiens
catcttaaagtcaactgactggggactttaaatatatctgcaaaacctcttcacagcagcacctgctttagtgtcaactgagtaactggggtaacctgagwaaccaagggtggttattggggtgtcatcatagaatcagcctagcatagcctggatcttcctttcatgtttaaatagaacatacaagttgaagatcaaaaa

SEQ ID NO: 23615 - DNA, 201 bp, Homo sapiens
tgaagcttctagaatgtcaggcacgtgagcatatgagggcatacctggttcatcttaggcactaaattaatttttgttgactgaatgaatgaaatatgaakgtattaaattgcatcacagaaagttataaaatgtaaaacactgaaaaattaagaaatattttatcttatgtaactagtgtgcatatcaattcatccgagt

SEQ ID NO: 23616 - DNA, 201 bp, Homo sapiens
cagtggtcctgctcctgtgagtcagagtgtgtcatttcctcacctaaaacactccagtggctccacctcggtcttgtgaagcttctagaatgtcaggcacrtgagcatatgagggcatacctggttcatcttaggcactaaattaatttttgttgactgaatgaatgaaatatgaatgtattaaattgcatcacagaaagt

SEQ ID NO: 23617 - DNA, 201 bp, Homo sapiens
aggccctcctctccccttagtccccaccaccctgtcacttctaaattgtggctctagcattgtcccattacctgctacgtgactgttctctccacagtggycctgctcctgtgagtcagagtgtgtcatttcctcacctaaaacactccagtggctccacctcggtcttgtgaagcttctagaatgtcaggcacgtgagca

SEQ ID NO: 23618 - DNA, 201 bp, Homo sapiens
gaactttggtattttcttttctctttcatttccaaataatcagtcaggaatggcacacaaggtgcattttgaaaaatgacactttaaagatttgtgggccrggaatggtggctcatgtctgtaatcccagcactttggaaggccgaagttggtggatcacctgaggtcaggagtttgagaccaacctggacaatatggtga

SEQ ID NO: 23619 - DNA, 201 bp, Homo sapiens
tccctctgtccctttcatccctcaggccctcctctccccttagtccccaccaccctgtcacttctaaattgtggctctagcattgtcccattacctgctamgtgactgttctctccacagtggtcctgctcctgtgagtcagagtgtgtcatttcctcacctaaaacactccagtggctccacctcggtcttgtgaagctt

SEQ ID NO: 23620 - DNA, 201 bp, Homo sapiens
catgactctttacaattggctgtggctttgttttaacgtgtgtagttattgctaaggatccttgagatgaactttggtattttcttttctctttcatttccaaataatcagtcaggaatggcacacaaggtgcattttgaaaaatgacactttaaagatttgtgggccgggaatggtggctcatgtctgtaatcccagcac

SEQ ID NO: 23621 - DNA, 201 bp, Homo sapiens
aatgtgtttaaacctaagaattctactgctttccaattccttccctctgctccttttcctaacctcctgcttctccagcccttccctctgtccctttcatscctcaggccctcctctccccttagtccccaccaccctgtcacttctaaattgtggctctagcattgtcccattacctgctacgtgactgttctctccaca

SEQ ID NO: 23622 - DNA, 201 bp, Homo sapiens
tccacggtgcccgcggctccatcctctggctcgcggcgtcgctgtcaaaccgcacgaactgcgtgtcgtccacgtagcccacggcgatgaagcggggctcyccgcggccgggccgggacacggatgtggtgaaatacctcatggagtgggagcctgggggcgaggagtggctgagacccacccgaccctcctcccggcgcg

SEQ ID NO: 23623 - DNA, 201 bp, Homo sapiens
ggaagatgaaattatcttgcacagcagattgaacattgtatcattgaaaatctagagagatgccagggagccaaggatcaaatgacctatttgtagccaakgccattttcatggcatcctggtcctctctgtcacatggctccttacaattctctgtggttttcttccaatgtaagtagttcttgttaagaatctttgcaa

SEQ ID NO: 23624 - DNA, 201 bp, Homo sapiens
aggaggagaatcctcttttcaccaggtggtctctgggcacaaactatcaaaacttctctcgtgacaaccataatgtgtagttcagtgggctgtcttttgtmtccttttaagggtaccctccttggaaaccaggacctcgtaccctgcacagcccagtgttggaagataaaacgtgcaaaataccccattgggtgaatctaa

SEQ ID NO: 23625 - DNA, 201 bp, Homo sapiens
gtgcagatggtgataggattagtggaacccacagccatggaaacactgaaactttcccagccaagtgggtccttcaggcagataatgggctaggagcacckcctagcctgcagatcaggaatgtcaacagcacccggagaggtgctggctgagtttctgagagcaggacatgaaaacacccatggaataggagcctatccc

SEQ ID NO: 23626 - DNA, 201 bp, Homo sapiens
tatccagacagcacaaaagctgcaattataactcctacttggccagacctggagtaatctagttcattctttaggcttcatcaggcttcttcagggacagrttgctggattacgtagagacaatagacagccccaacaccatcccacatccttcagctctgtaatggtgatgtgatccccacaatacttgaagtatcttac

SEQ ID NO: 23627 - DNA, 201 bp, Homo sapiens
tggcaggatcactggattgggaatcccaggagggtggaacgattgttggaattgatgtactacagggtagactccaagcgtggaaagcaagcacatatgcratgagtggtccactgatattacatcacagcatatgataaaatgatagtatctgtgtcctcagagcctgtggccaccttgcaaggggatgagtggaaagat

SEQ ID NO: 23628 - DNA, 201 bp, Homo sapiens
tctctgcttttaatggctcttgtgatttgattgggcccacacagagagtccagcagaatctccctattttaaggtccttaatcttcattacatgagtaatrtcccttttgccacgcaatgcaacctgttcacaggttccaacgattaagactggacatctttggggaccattactcagcccaccacatctgcgtatgttga

SEQ ID NO: 23629 - DNA, 201 bp, Homo sapiens
gagatctgagccgcagtgtccgctgcggtccaggagcgcaggtcctcgttcagggcgaggtaatccttgccatcgtaggcatactgttcatacccgcggakgaggcgtccgtcggaccccaggtcgcagccaatcatccactggagggtgtgagaacctggccccaccccctcggtcagccccgcccaccgagcctcgccc

SEQ ID NO: 23630 - DNA, 201 bp, Homo sapiens
caatgtgtttaaacctaagaattctactgctttccaattccttccctctgctccttttcctaacctcctgcttctccagcccttccctctgtccctttcayccctcaggccctcctctccccttagtccccaccaccctgtcacttctaaattgtggctctagcattgtcccattacctgctacgtgactgttctctccac

SEQ ID NO: 23631 - DNA, 201 bp, Homo sapiens
ggcccccttgcctggctttacttttagactttttataaattgtttcttgctgattttgttatgcatttgcttgctttttccgttaacatggtctatgagakggatcaatgttcacacaaatagttcatttgttttcattgctagatagtattccatgggaggaatatgctacaatttatctcttccccacttcattgacct

SEQ ID NO: 23632 - DNA, 201 bp, Homo sapiens
acacttagtatttttaaaacctgattaattaaaaaaaattagtttctaggcagtcccaaatatagtattaaaggccaactgcaaagaaggaacactaagtrttttttaaaccttattaacataaaaaacattagtttttaggcagtcctacattaggtattaaaggccaactgcaaagaacactgagcgaggctctgtaga

SEQ ID NO: 23633 - DNA, 201 bp, Homo sapiens
actgccaacccccttacccttctgggtctccatggtccatcatttcacactctccttttatgtatataaagagatattaaccaaatacggcagagtggtarcttgaattttactgcaccgttctttcagcttctttgcacatttgaaaatttatacagttataagttggaagaatgagggaaaatagagagcaagacagtg

SEQ ID NO: 23634 - DNA, 201 bp, Homo sapiens
gcaagtgttcaatgcagtcacaatgcccctcagcagtgctcatgtgctgcctgtttttaggaagtattcacgtctaagtggtgtgtatatcttataggaamacttagtatttttaaaacctgattaattaaaaaaaattagtttctaggcagtcccaaatatagtattaaaggccaactgcaaagaaggaacactaagtat

SEQ ID NO: 23635 - DNA, 201 bp, Homo sapiens; identical to SEQ ID NO: 4283

SEQ ID NO: 23636 - DNA, 201 bp, Homo sapiens
attcacctcacagttgcaagtgttcaatgcagtcacaatgcccctcagcagtgctcatgtgctgcctgtttttaggaagtattcacgtctaagtggtgtgwatatcttataggaacacttagtatttttaaaacctgattaattaaaaaaaattagtttctaggcagtcccaaatatagtattaaaggccaactgcaaaga

SEQ ID NO: 23637 - DNA, 201 bp, Homo sapiens
gggtgagtccaagacatctcctcaatataaagtagcacactgcgttactatatgttgcaaccgggagccagtacagactttattcacctcacagttgcaartgttcaatgcagtcacaatgcccctcagcagtgctcatgtgctgcctgtttttaggaagtattcacgtctaagtggtgtgtatatcttataggaacactt

SEQ ID NO: 23638 - DNA, 201 bp, Homo sapiens
aggaatctaatcggtaaaaaatgtaactttggccccttgatatataaatgtgtctgaaagcattacaacaggactcacaaagctactaagtttgactttcscagacaatgtatctgtgactcccgcttgttttttacatttaccttcattccacagccctgagttactgggtgagtccaagacatctcctcaatataaagt

SEQ ID NO: 23639 - DNA, 201 bp, Homo sapiens
ttctgggtctccatggtccatcatttcacactctccttttatgtatataaagagatattaaccaaatacggcagagtggtaacttgaattttactgcaccrttctttcagcttctttgcacatttgaaaatttatacagttataagttggaagaatgagggaaaatagagagcaagacagtgctgaataggaataggctag

SEQ ID NO: 23640 - DNA, 201 bp, Homo sapiens
aggaataggctaggggttgtgtcccactaggaaccataattgatctttgccattttgaaagtgtgtcccctgagcagccttcagagagtcctggaggcagrcttgttttcacagtaataccaagatgccatctgcctgtttcattgtgttgacttttccattagtgctgcaaatgccaaggtcggtagcacacccagcacc

SEQ ID NO: 23641 - DNA, 201 bp, Homo sapiens
ccgggtaacggctcctgggcctctcccgggtaaagggtctccaggttccgctgcctcggcgtggatctcggacccagagactcggggagacccgggcggtycgtgggggatgtagaggggtagtgatctgcgcccccggccggtgtcactcacaggcctcactctggttgtagtagccgctcagggtccgcaggttcactc

SEQ ID NO: 23642 - DNA, 201 bp, Homo sapiens
cccgcgacccggccgggacacggcggtgctgaaataccttatggagtgggtacctgggggcgaggaggggctgagacccgtccgaccctcctccttgcgckgctccccgggtcctgcgccccagtgcgcgggcccctagctcctccccgcagaggccatttccctccggatcccgcactcacccgcccaggtctcggtcag

SEQ ID NO: 23643 - DNA, 201 bp, Homo sapiens
caccaatggaagaaggaaactcagagctcacccctttcctacctgggatcttattcctccacatcacagcagcgaccacagctacagtgattacagcaacdagaagaaccaggccagcaatgatgcccacaacggggatgatgggctgggaagacagctctaagaaaggaggtgaacgtgaggggccctgacccccaggcc

SEQ ID NO: 23644 - DNA, 201 bp, Homo sapiens
gtttgtttgtttgttttgagatggagtatggctctgtcacccaggctggagtgcgatggcaggatctcagctcactgcaacttctgccttccaggttcaarcgattctcctgcatcagccttctgagtagcttggattacagacacgcaccaacacgcccagctaatttttgtatttttagtaaagacgaggtttcaccat

SEQ ID NO: 23645 - DNA, 201 bp, Homo sapiens
atgcacattacgtacaggagttatctgtggtgtgggaggctgtcattcattcattttcactgctgaaggtttacattttatgccacaatttcctattgatrtatatttcctattgatgtatatgtggctgattccagtttttgccataaacatcagtgtgcctgtctcctgggcacataggcaagaaagcccgctagagtg

SEQ ID NO: 23646 - DNA, 201 bp, Homo sapiens
acttcactgcagtggccactcttgaagctctgtaaggttaatcttcaccttctgtagtgcacacgttttgccaaagaattcagcgtactttcctcctcttrctcatccatcccaatctatgtgatattgccaatgaaatgaagagatttagtattctgtgagatgtctgatttgtccagatctcttaaggtgatatttata

SEQ ID NO: 23647 - DNA, 201 bp, Homo sapiens
cagctcaaatcaacaaatatttatcatctcccacagttatccatggtcaggaatccaggagaagtttctctgaatgcttctggctcagggcctctcacaaygttgcagtctagttgtcttccagggctgaatcacctgagggctcaaatggggccagggattcacaagacacaagaatctctcacatggcttttggaagag

SEQ ID NO: 23648 - DNA, 201 bp, Homo sapiens
ctggacaggtctgaaaattagtctcttgataccacaatgagatttgtatgcagggaccaccgtaggtgacatccaagtccctgtgatcacaggtggtggtrggacaaggttctactgaagggccaaggagaatgaaggagcaaagatgacccagctgagcagtgaccacataaagtccatactggcctgagcacccactag

SEQ ID NO: 23649 - DNA, 201 bp, Homo sapiens
cacatatatatatgtatgtgtgtatatatatatatccccaaaacaaatatcagtttgttttgctggtttttaagcttcctgtacagcaagttcctactgcmtttattttcccatgatgcacattatgtgtaggagttatctgtggtgtgggagactgtcattcattcatttttactgctgaaggcttacatatggttatac

SEQ ID NO: 23650 - DNA, 201 bp, Homo sapiens
gcgtggggactttagaaccgggaccgcggcggcaccgattggcttctctagaaacccgacacctagtgggaatgagaactgtgcccgcttcctgagtatcmaggaaaaaggacccgtcgcaggttgtgagaagaagagaaactgcggaggtggcgaatccccaaggcggggcctccccaatccatacaccgccttcggggc

SEQ ID NO: 23651 - DNA, 201 bp, Homo sapiens
ggactttagaaccgggaccgcggcggcaccgattggcttctctagaaacccgacacctagtgggaatgagaactgtgcccgcttcctgagtatccaggaaraaggacccgtcgcaggttgtgagaagaagagaaactgcggaggtggcgaatccccaaggcggggcctccccaatccatacaccgccttcggggcctgaga

SEQ ID NO: 23652 - DNA, 201 bp, Homo sapiens
tgtctctgctgtgaatgacatgaccttactccagaatcccaggcctttcactgtgactttcccactggtgcttggttcagctccatcctgcatctttcccyaccaatggcatcaccagcaccagggggtctgagagatggtggctgctcgcaccatggcctggatctgctgcagggtccttttctgtgtgggccctacttg

SEQ ID NO: 23653 - DNA, 201 bp, Homo sapiens
ttccctaccaatggcatcaccagcaccagggggtctgagagatggtggctgctcgcaccatggcctggatctgctgcagggtccttttctgtgtgggcccyacttgaagctggcctcctcctatgtcacctagagtgtgggccaaagcaacatacctagatgtggaaagtggtgttgtcagaactggaagaggctcatcag

SEQ ID NO: 23654 - DNA, 201 bp, Homo sapiens
tcccaaatgtgttaggttgttccagcatcaactcaaaattctagagtctcatctgagacgcaaggtaaattcttatagctttgagcctgtaaaattttttwaaaaaatgttatttgcatctaaaatattaataaaacagtggaagagacatttcttgtacatttccattccaaaaggtatataaatgggccaaaagaaatg

SEQ ID NO: 23655 - DNA, 201 bp, Homo sapiens
tttctctttgtttattaactacagtgggtagcagaatcttggcaacccctaaatgatcaggaatctaatcggtaaaaaatgtaactttggccccttgatamataaatgtgtctgaaagcattacaacaggactcacaaagctactaagtttgactttcgcagacaatgtatctgtgactcccgcttgttttttacatttac

SEQ ID NO: 23656 - DNA, 201 bp, Homo sapiens
ttttctctttgtttattaactacagtgggtagcagaatcttggcaacccctaaatgatcaggaatctaatcggtaaaaaatgtaactttggccccttgatvtataaatgtgtctgaaagcattacaacaggactcacaaagctactaagtttgactttcgcagacaatgtatctgtgactcccgcttgttttttacattta

SEQ ID NO: 23657 - DNA, 201 bp, Homo sapiens
aagttgtgcctgagtacatgagacagcatagagacaagttttctctttgtttattaactacagtgggtagcagaatcttggcaacccctaaatgatcaggwatctaatcggtaaaaaatgtaactttggccccttgatatataaatgtgtctgaaagcattacaacaggactcacaaagctactaagtttgactttcgcag

SEQ ID NO: 23658 - DNA, 201 bp, Homo sapiens
cccagaactggactccctgcctcccactccttacctatttccctgaactcttctagaaaaaaactcaccccagggagcttggtgacagagagggagctcgmcgccagagaggcagagctcgccctgggaatggaggcgtagagacaggtttttgttttttttttctttaaatccggaaaagttgtgcctgagtacatgaga

SEQ ID NO: 23659 - DNA, 201 bp, Homo sapiens
agcttagttgtgtcccctctgcccaactcctctttcacttcaggccctctaaggtgtcacttttacaagccgtgagagacacatcagagccctgggtactsttcctgtttggggtggaacaaaaacaaaatctggtcagagcccacaggtgatgtgactaaaggaggaattttggggtggctgagctcccccatgggctcc

SEQ ID NO: 23660 - DNA, 201 bp, Homo sapiens
tccccaatcaatacatcgccttcggggcctgaaaccctgagagccacgcctggggccataggacttcgccctgaccccgctcctcctgtgccaagcgctcwgtctcaatgtctccctgagtcttggcccaagagctgtctgagaaaccagggagaaaccctcgtcatgggccccgtccctcttcatttttcatcccggaat

SEQ ID NO: 23661 - DNA, 201 bp, Homo sapiens
tgaaaaattccaaatcaaagaatctccagagcttagttgtgtcccctctgcccaactcctctttcacttcaggccctctaaggtgtcacttttacaagccdtgagagacacatcagagccctgggtactgttcctgtttggggtggaacaaaaacaaaatctggtcagagcccacaggtgatgtgactaaaggaggaattt

SEQ ID NO: 23662 - DNA, 201 bp, Homo sapiens
ttttttgtagagaaagggatttatcatgtttcccagacttgtctggaacgcctggggtcaagcaatctgcccaccttggcctcccaagatgctaggattaygggtataggcccccttgcctggctttacttttagactttttataaattgtttcttgctgattttgttatgcatttgcttgctttttccgttaacatggtc

SEQ ID NO: 23663 - DNA, 201 bp, Homo sapiens
aaaacatagtcataaactaatccaggtcagtcacagtaagttgtgacactgaacagcccaccacaccttgaaaaattccaaatcaaagaatctccagagcytagttgtgtcccctctgcccaactcctctttcacttcaggccctctaaggtgtcacttttacaagccgtgagagacacatcagagccctgggtactgttc

SEQ ID NO: 23664 - DNA, 201 bp, Homo sapiens
gagaaactgcggagatggggaatccccaaccctgggcctccccaatcaatacatcgccttcggggcctgaaaccctgagagccacgcctggggccataggrcttcgccctgaccccgctcctcctgtgccaagcgctctgtctcaatgtctccctgagtcttggcccaagagctgtctgagaaaccagggagaaaccctcg

SEQ ID NO: 23665 - DNA, 201 bp, Homo sapiens
acataagttgggagagggagaagagaaactgcggagatggggaatccccaaccctgggcctccccaatcaatacatcgccttcggggcctgaaaccctgaragccacgcctggggccataggacttcgccctgaccccgctcctcctgtgccaagcgctctgtctcaatgtctccctgagtcttggcccaagagctgtctg

SEQ ID NO: 23666 - DNA, 201 bp, Homo sapiens
caggtcctcgttcaaggcgatgtaatccttgccgtcgtaggcgtcctgccggtacccgcggaggaagcgcccgtccgaccccacgtcgcagccatacatcmtctggatggtgtgagaacctggccccgaccccacggtcagcccagtcccccgagccccgtccggccccgaccaacccggggggatttttggcctaaactg

SEQ ID NO: 23667 - DNA, 201 bp, Homo sapiens
gagtggccactctggaagctttgtaaggtttatcttcaccttctggagtgcccgtgttttgccaagcactacagtgcactttctacctgctgctcatccasccaggtcaacaggaagttgtcaatgatatgagctgatttaatatcctattggatatccagtatgtttagtatagtcttaagactatactatagaggtcag

SEQ ID NO: 23668 - DNA, 201 bp, Homo sapiens
gtccatgagacactgccgagggtgtcaaatgtagccagtcatagctgtcaacaatccgcagattctcattatctttttacacagcatcgatgcagctgagmagtaactagccaaagccactgtctttgtaggtttcttccaaccctgtccttattatgcagggcattctatcactgcatgtgccatagcactccctaacca

SEQ ID NO: 23669 - DNA, 201 bp, Homo sapiens
tcctatgtggtttggaatcctaaattttaagagaccagtcagcgtactgtgtgctgctctccagcctcctgcagctcatgggggcaggctcagcataggcmgaggtggaacccaccagctgtgtagttttgccaggtgagtgtgacaattcaagggagagggaagggagggatggaaattatttaccatagaattcaaaat

SEQ ID NO: 23670 - DNA, 201 bp, Homo sapiens
agacaaggacaagaaacaagttcaaaagagggaaagggaaactacagacgtacctcagagatactgcagatttggtttcagaccatggcaacaaacaagtyacacaaatttttgtttttccagtacatataaaagttatattcacactctactgtagcctattaagtatacaatagcattatgtatgaaagaactatgtac

SEQ ID NO: 23671 - DNA, 201 bp, Homo sapiens
cctcccccagttgctcattagctgagtaccaaggacttacgatcttcccggatgtcacctattggtagtttaagacttcaagtatgttccttagggttttktttttttttgctgcattttgttgcagcccataatgcattgtgattgtctcaggactctttaaacatttgacttatgtccctaatggctgcacttagttga

SEQ ID NO: 23672 - DNA, 201 bp, Homo sapiens
ataaagggggaatcagtacttaagtaaggtcaatatgagttttcaagtcaggtggacttgaatatgaaccctccaggcctttccaccaactagctatagakccttgggcacatctggcccagagctggccccgacagacacttgcccagtgggtgagtgctcaatgaacccatctgagccaattgtctcatccaaccagtg

SEQ ID NO: 23673 - DNA, 201 bp, Homo sapiens
cttggttcagctccatcctgcatctttccccaccactggcaccaccagccccaaggggtctgagggatgctggctgcttgtaccatggcctggatctgctrcagggtcctttcctgtgtgggccccacatgaaggtggcctcctcctatgtcacctagagtgtgggccaaagcaacacacctaaatgtggaatgtggtgtc

SEQ ID NO: 23674 - DNA, 201 bp, Homo sapiens
atgagatgtggtagaagtgatttggacactactacagttctaaatagcactgctattatgtgcttctgaagctttcttttttttttttttttagctgtctkattttgctttccattcatatttgctattccatcactggttgttcctttctactcttttcttgtttcatttattttgatcagtgatgtgtatttccaattc

SEQ ID NO: 23675 - DNA, 201 bp, Homo sapiens
tactacgcccagctaattttttgtatttttagtagaaacggagtttccccatgttgggcagtctggtcttgaactcctgacctcaggtgatccaccctctycggcctcccaaagtgctgggattacaggtgtgagccaccatgccccgccgttgttgctatttctttcatcctttttgcttgagcctcttctcttctttct

SEQ ID NO: 23676 - DNA, 201 bp, Homo sapiens
aaaatgtaaatgtggatatggcttggattactaagtggttttatttcttcattcacctgacatttgttgtgtacctgctgcaagtcaaatacatggtatgrtattgtttccttgttcacaccacagcaaatgagaaaatgagacattatagccaggtgtggcggcacaggcttctcgtcctagctactcagaaggctgagg

SEQ ID NO: 23677 - DNA, 201 bp, Homo sapiens
taaattaatgattaaatgtttgagacatgacagagccttgggtgctgcagggaaaacagtttgagacagagaaaggagaaacaacagtatctctgcgtttytcttgtaaatacctttaataacaatgttcttcaataagttaacacagttgagaacatagagtaactagatcaaatagttccaagacttcagtgccataag

SEQ ID NO: 23678 - DNA, 201 bp, Homo sapiens
ggactagcttgtttaactttattagatgatatgaaattgattttcaaaatggatgttttatattcctataggcaatggaggagagtacagattgttccacwtccttgctagcatttatagttattaatcattttaattttagccattctaatggttgcttagtggtttctcactgtggttttactttgcatttttccctga

SEQ ID NO: 23679 - DNA, 201 bp, Homo sapiens
ctttttaaattaatgattaaatgtttgagacatgacagagccttgggtgctgcagggaaaacagtttgagacagagaaaggagaaacaacagtatctctgmgtttctcttgtaaatacctttaataacaatgttcttcaataagttaacacagttgagaacatagagtaactagatcaaatagttccaagacttcagtgcc

SEQ ID NO: 23680 - DNA, 201 bp, Homo sapiens
ctcatgcctgccactgtggttgctccattcatgcacccatcctaccaggcctgggctgacccatggtgaaggctggctaactgccatttgtctgtttggtwgttcagtgccacatcacacttgggtgttttctgtgggtgtcaacatgggattcaagctcaacccaggtggaccattttcacctgttgatgaatgctgttg

SEQ ID NO: 23681 - DNA, 201 bp, Homo sapiens
attactacaactcagggcaggaagaagagtaggagtgcagaagaggagttccaacagaaagttacctatgatgagaaactatgggaccctgcctcttggcraatttcagaatctggttcctttaaaaagattgcagaaaagatggaaaatacaatgaggaaagagccctgggaagagggcaagagcttgaaagatctgaaa

SEQ ID NO: 23682 - DNA, 201 bp, Homo sapiens
ctgagtgtccaggaagaaggaccctacataagttgggagagggagaagagaaactgcggagatggggaatccccaaccctgggcctccccaatcaatacawcgccttcggggcctgaaaccctgagagccacgcctggggccataggacttcgccctgaccccgctcctcctgtgccaagcgctctgtctcaatgtctccc

SEQ ID NO: 23683 - DNA, 201 bp, Homo sapiens
gtctggggagaatctgagtcccaatgggttcgcggggacttctggaacagggaccccagcgacgccgattggcttcgctagaaacccgacaccaaatgggrgtgagaactgagtccacatcctgagtgtccaggaagaaggaccctacataagttgggagagggagaagagaaactgcggagatggggaatccccaaccct

SEQ ID NO: 23684 - DNA, 201 bp, Homo sapiens
gcccaggtctcggtcagggccagggcccccaagagcagcaggaggagggttcgggacgccatgaccccatcctcggcgtctggggagaatctgagtcccartgggttcgcggggacttctggaacagggaccccagcgacgccgattggcttcgctagaaacccgacaccaaatgggggtgagaactgagtccacatcctg

SEQ ID NO: 23685 - DNA, 201 bp, Homo sapiens
tcacccgcccaggtctcggtcagggccagggcccccaagagcagcaggaggagggttcgggacgccatgaccccatcctcggcgtctggggagaatctgartcccaatgggttcgcggggacttctggaacagggaccccagcgacgccgattggcttcgctagaaacccgacaccaaatgggggtgagaactgagtccac

SEQ ID NO: 23686 - DNA, 201 bp, Homo sapiens
ccgcagaggccatttccctccggatcccgcactcacccgcccaggtctcggtcagggccagggcccccaagagcagcaggaggagggttcgggacgccatraccccatcctcggcgtctggggagaatctgagtcccaatgggttcgcggggacttctggaacagggaccccagcgacgccgattggcttcgctagaaacc

SEQ ID NO: 23687 - DNA, 201 bp, Homo sapiens
ctcctccccgcagaggccatttccctccggatcccgcactcacccgcccaggtctcggtcagggccagggcccccaagagcagcaggaggagggttcgggwcgccatgaccccatcctcggcgtctggggagaatctgagtcccaatgggttcgcggggacttctggaacagggaccccagcgacgccgattggcttcgct

SEQ ID NO: 23688 - DNA, 201 bp, Homo sapiens
ctagctcctccccgcagaggccatttccctccggatcccgcactcacccgcccaggtctcggtcagggccagggcccccaagagcagcaggaggagggttygggacgccatgaccccatcctcggcgtctggggagaatctgagtcccaatgggttcgcggggacttctggaacagggaccccagcgacgccgattggctt

SEQ ID NO: 23689 - DNA, 201 bp, Homo sapiens
ccagtgcgcgggcccctagctcctccccgcagaggccatttccctccggatcccgcactcacccgcccaggtctcggtcagggccagggcccccaagagcrgcaggaggagggttcgggacgccatgaccccatcctcggcgtctggggagaatctgagtcccaatgggttcgcggggacttctggaacagggaccccagc

SEQ ID NO: 23690 - DNA, 201 bp, Homo sapiens
gggggcgaggaggggctgagacccgtccgaccctcctccttgcgctgctccccgggtcctgcgccccagtgcgcgggcccctagctcctccccgcagaggycatttccctccggatcccgcactcacccgcccaggtctcggtcagggccagggcccccaagagcagcaggaggagggttcgggacgccatgaccccatcc

SEQ ID NO: 23691 - DNA, 201 bp, Homo sapiens
agagtgataacttgaattttactgcactattctttcagcttctttgcacatttgaaaatatatacaattataagttggaagaatgagggaaaaaaaagagygagagagagtgctgaatctgaataggctaggggttgggtctcactaggaactataattgatctctgccattttgaaagtgtggccccctgagctgccttc

SEQ ID NO: 23692 - DNA, 201 bp, Homo sapiens
ttataaacattggcttatcatgggttattttattatttattgtgtattttgatttcactttactggcaacacaataaacaatgacatgatgaccctagcartcacatcctctttcttgtgtcaaaaagcaccttccaggaacgtgagaaggagacagttttcgctacagttgattaagggagagcccgctaggctgggcag

SEQ ID NO: 23693 - DNA, 201 bp, Homo sapiens
ataatatgccaatgcttctttactgttataatccttttcgtatgaaaaatatgtggtcaaagaaaagggggtaatatgagttatcacaaaaacatttagtyttgtccctggtttctcctaaaaaccttagaatctcttgagtgattagagtgtctttagaatactgaggaaaggactcttggctgagtggatcctggatac

SEQ ID NO: 23694 - DNA, 201 bp, Homo sapiens
atggtgaaggctggctaactgccatttgtctgtttggttgttcagtgccacatcacacttgggtgttttctgtgggtgtcaacatgggattcaagctcaayccaggtggaccattttcacctgttgatgaatgctgttgggcctgtgcaatttatgactttgtgggtcacacagccacttggaaccacattgttgtttggt

SEQ ID NO: 23695 - DNA, 201 bp, Homo sapiens
cccacttgcgctgggtgatctgagccgccatgtccgccgcggtccaagagcgcaggtcctcgttcaaggcgatgtaatccttgccgtcgtaggcgtcctgscggtacccgcggaggaagcgcccgtccgaccccacgtcgcagccatacatcatctggatggtgtgagaacctggccccgaccccacggtcagcccagtcc

SEQ ID NO: 23696 - DNA, 201 bp, Homo sapiens
atatgaattttcaaatttttttttctaattctgtgataagcttctctttttaaattaatgattaaatgtttgagacatgacagagccttgggtgctgcagrgaaaacagtttgagacagagaaaggagaaacaacagtatctctgcgtttctcttgtaaatacctttaataacaatgttcttcaataagttaacacagttg

SEQ ID NO: 23697 - DNA, 201 bp, Homo sapiens
tgccttcatttcatctggcaaagtcgggattaactgtaagtagagctacgtagactggtggtcagatagcctgcactagttcctaacctatgtaacctacygtctatgatcaagagtagattaagagaagacatggtagaatactattgctgcatgcagtctaggccagcacagcagccaaacctaatgtcacttctagaa

SEQ ID NO: 23698 - DNA, 201 bp, Homo sapiens
aaaatgcacacatcaacacctggttgaattttaaagaaaaaaaaatgcagagaagaaagaaatatcacccaggcttcccctccaaagaaccactgctatcrtattattgaaacttcctggactgcagtgtgaatggtcatccctggagctatcttctgcagtgatgctgacttccattcttttgttttctatgtatatatt

SEQ ID NO: 23699 - DNA, 201 bp, Homo sapiens
catgtggatcactgggcagcacatgcatgtgggagtcacagcaggggcaggtggtggagacagggtggagtagacaagaaactggtgtgagtggagaagartgagctaggctgagagtaatgggatgaggccaaagtggccagaggggaccctgtgataaggagtgcataggaaatggtgggaaactggggtttccttgtg

SEQ ID NO: 23700 - DNA, 201 bp, Homo sapiens
tttctgaacacttgaccatgggacatttaagcagggaccttaatggtgtgaggagtgagccatgtggatcactgggcagcacatgcatgtgggagtcacarcaggggcaggtggtggagacagggtggagtagacaagaaactggtgtgagtggagaagaatgagctaggctgagagtaatgggatgaggccaaagtggcc

SEQ ID NO: 23701 - DNA, 201 bp, Homo sapiens
ttatggagtgggtacctgggggcgaggaggggctgagacccgtccgaccctcctccttgcgctgctccccgggtcctgcgccccagtgcgcgggcccctasctcctccccgcagaggccatttccctccggatcccgcactcacccgcccaggtctcggtcagggccagggcccccaagagcagcaggaggagggttcggg

SEQ ID NO: 23702 - DNA, 201 bp, Homo sapiens
ctccccgcgacccggccgggacacggcggtgctgaaataccttatggagtgggtacctgggggcgaggaggggctgagacccgtccgaccctcctccttgmgctgctccccgggtcctgcgccccagtgcgcgggcccctagctcctccccgcagaggccatttccctccggatcccgcactcacccgcccaggtctcggt

SEQ ID NO: 23703 - DNA, 201 bp, Homo sapiens
tgggttagaagattggtggcggtggtgggaatggcaggggatagatttcagaagaggtcactggacaagacatttctgaacacttgaccatgggacatttragcagggaccttaatggtgtgaggagtgagccatgtggatcactgggcagcacatgcatgtgggagtcacagcaggggcaggtggtggagacagggtgga

SEQ ID NO: 23704 - DNA, 201 bp, Homo sapiens
cactgcgatgtaccggggctccccgcgacccggccgggacacggcggtgctgaaataccttatggagtgggtacctgggggcgaggaggggctgagacccrtccgaccctcctccttgcgctgctccccgggtcctgcgccccagtgcgcgggcccctagctcctccccgcagaggccatttccctccggatcccgcactc

SEQ ID NO: 23705 - DNA, 201 bp, Homo sapiens
tatctattatctatctatcatctatgtacctatgctattggttctttctttcttggtaaccttaataaatcaacagacaataaacaaataaaacctgtcayagtatcactgataattgccattaagaaaaatatgcttgggttagaagattggtggcggtggtgggaatggcaggggatagatttcagaagaggtcactgg

SEQ ID NO: 23706 - DNA, 201 bp, Homo sapiens
cgcacgaactgcgtgtcgtccacgtagcccactgcgatgtaccggggctccccgcgacccggccgggacacggcggtgctgaaataccttatggagtgggwacctgggggcgaggaggggctgagacccgtccgaccctcctccttgcgctgctccccgggtcctgcgccccagtgcgcgggcccctagctcctccccgca

SEQ ID NO: 23707 - DNA, 201 bp, Homo sapiens
ccgcgtcgctgtcgaaccgcacgaactgcgtgtcgtccacgtagcccactgcgatgtaccggggctccccgcgacccggccgggacacggcggtgctgaamtaccttatggagtgggtacctgggggcgaggaggggctgagacccgtccgaccctcctccttgcgctgctccccgggtcctgcgccccagtgcgcgggcc

SEQ ID NO: 23708 - DNA, 201 bp, Homo sapiens
cgcggcatgggcaggttcactcttgtcagtctgtgcgcgggcctgatgttccgtgtgctccggtcccaatactccggtccctcctgctccaaccacggcgmctgcggctacatcctcggagtcgccgcgtcgctgtcgaaccgcacgaactgcgtgtcgtccacgtagcccactgcgatgtaccggggctccccgcgaccc

SEQ ID NO: 23709 - DNA, 201 bp, Homo sapiens
gcggcgcggcatgggcaggttcactcttgtcagtctgtgcgcgggcctgatgttccgtgtgctccggtcccaatactccggtccctcctgctccaaccackgcgcctgcggctacatcctcggagtcgccgcgtcgctgtcgaaccgcacgaactgcgtgtcgtccacgtagcccactgcgatgtaccggggctccccgcg

SEQ ID NO: 23710 - DNA, 201 bp, Homo sapiens
agctctggtggtagtagcggcgcggcatgggcaggttcactcttgtcagtctgtgcgcgggcctgatgttccgtgtgctccggtcccaatactccggtccmtcctgctccaaccacggcgcctgcggctacatcctcggagtcgccgcgtcgctgtcgaaccgcacgaactgcgtgtcgtccacgtagcccactgcgatgt

SEQ ID NO: 23711 - DNA, 201 bp, Homo sapiens
cgccccaggccggggtcattcaccggcctagctctggtggtagtagcggcgcggcatgggcaggttcactcttgtcagtctgtgcgcgggcctgatgttcsgtgtgctccggtcccaatactccggtccctcctgctccaaccacggcgcctgcggctacatcctcggagtcgccgcgtcgctgtcgaaccgcacgaactg

SEQ ID NO: 23712 - DNA, 201 bp, Homo sapiens
gcggggattttggcctaaacggaaaatgaaacctggtaaaggcgcctgggcctctcccgggtcgaggatctggcgggtcccgcagcctcggggtggatctyggagccggagactcgcgggggggacccgggacgtccgtgggggatgaggaggggtcgtgaccttcgccccaggccggggtcattcaccggcctagctctg

SEQ ID NO: 23713 - DNA, 201 bp, Homo sapiens
ttgatcattcatagctggcaagccagactaatgccagcaaccccaaaggagctgccaatggatcttgacagggaagtcactgactctggattgggctatgwtcaaccaggggtagatgtcaatgcttcaaaggctatacaagaaccagaaaaatggagattacaccaatttggactgttgagtcacatttctttacacaag

SEQ ID NO: 23714 - DNA, 201 bp, Homo sapiens
agtcagtttcagcaatttctatctttgtataaatctgtccattttatctaagtggtctaactgattggcttcaggtttttcagagtattaacttataatgwtttttaacttctaaagggtcattagtgatactctctcttgtgttcacaattttggtaatttatctcatttctcatactgtctgttttgacttttggtcaa

SEQ ID NO: 23715 - DNA, 201 bp, Homo sapiens
ttaaattcctagaagaagagaagtgagtaaatggaaagaggcattccagaaagaggttatcttaaaatattaaggaaatgtattattgtaaataaagtctygatgccacaaagaaatagcactcaaatataaaattttctttttttcttctcagcaaggcaattacttctatacaagggtgtgccctcacagatggagcaa

SEQ ID NO: 23716 - DNA, 201 bp, Homo sapiens
tgatagaattcaccagtgaagatatctgggctttggcatttctttgtgagaaggttttaaaattactgtcttagtgtacagttctcttcagattttctatytatttttgagtcagtttcagcaatttctatctttgtataaatctgtccattttatctaagtggtctaactgattggcttcaggtttttcagagtattaac

SEQ ID NO: 23717 - DNA, 201 bp, Homo sapiens
gtgagttttaggttctacacccagagttacaaaccattatgtcagcattattctataagttagaagttatattagtccattctcacactgctatgaagaartacctgagactgggtaatttataaaggaaagaggtttaattgactcacagttctgcatggctgaggagcctgccccaggaaacttacagtcatgacagaa

SEQ ID NO: 23718 - DNA, 201 bp, Homo sapiens
gaagccgcagtgagttttaggttctacacccagagttacaaaccattatgtcagcattattctataagttagaagttatattagtccattctcacactgcyatgaagaaatacctgagactgggtaatttataaaggaaagaggtttaattgactcacagttctgcatggctgaggagcctgccccaggaaacttacagtc

SEQ ID NO: 23719 - DNA, 201 bp, Homo sapiens
taaatttattcctatttctctctttttgtaactactgtgataggaaagtttagattttaattgcttgtatagagaaatatgttaataatttttaatttgaktttatatcctatgggagcttctggattcattttttagtgctagcaggcttttatctgcttgtgaattctacagacaaggtcatgttatctgtgaatagag

SEQ ID NO: 23720 - DNA, 201 bp, Homo sapiens
cccgaccacaatatcccaaggatctcagggatcagcccacttcatacttacttgcagcttcagagtagctcactctatctgtgggaagaaaatgtcctatragaggccagaaaggagtcagggccatacggccctaaacaaaccccctagcctttgatcccagagaagtttcctgaaagtgtaactgctgatctaggacag

SEQ ID NO: 23721 - DNA, 201 bp, Homo sapiens
aatgcctgctggggttttgatagagattgtacagaacctatagatctcttggtggagaattgtcatcttaacaatattattgagctttccaaccgcatctmtccatgaatttagacctttaatttctctcagtaatgttttgtagttttcaacaaactctgctgtcttcctaaatttattcctatttctctctttttgtaa

SEQ ID NO: 23722 - DNA, 201 bp, Homo sapiens
aggaggctgagatcagtgggtcccttgaacccaggaggtcgacactgcagtgcatggtgatcatgccactgcactccagcctgggtgacagagcgagaccrtgtctcaaaaataataatgatgacgatgatacatttaaagcaaatgcaatttaatgtgtaataatacatcctctcttgtgaaaatgtgttatttatttac

SEQ ID NO: 23723 - DNA, 201 bp, Homo sapiens
caggaggctgagatcagtgggtcccttgaacccaggaggtcgacactgcagtgcatggtgatcatgccactgcactccagcctgggtgacagagcgagachatgtctcaaaaataataatgatgacgatgatacatttaaagcaaatgcaatttaatgtgtaataatacatcctctcttgtgaaaatgtgttatttattta

SEQ ID NO: 23724 - DNA, 201 bp, Homo sapiens
aaatacatcctcttcagccatggaaattctccttaccttttaaaactaagttacatgtttaatatcttataattaatttacgccaggtatggtggctcacrcctgccatcctagcactgtggaaggcagaggaaggcagatttgttgactccagaagttcaagatcagcctgggcaaaacccccatctatacaaaaaatta

SEQ ID NO: 23725 - DNA, 201 bp, Homo sapiens
agctgactgattcacccctctgccacccccaattgaaggaaggagctgtattcttatcttggcccatccatcaactgaatgccgctggacatggaacattrcaagtgtgaagcttccagggttctcagttgctcttcctgctgttgtggagactccattggtgtggctcacatccaggcaggcctgcaggaagctgtttcc

SEQ ID NO: 23726 - DNA, 201 bp, Homo sapiens
ttgcctacatagaccacatgttcttcatctattcatgtgttgatgggtgctttgtttgcttccttgtcttggctatggtgagtaatgttgctgtgaatacrggtatgcaatgtttttcttttttacagcctccctcatttcagtggaattaatgttttagtagctacttctgatagcacatatttaaagtatttttgcatg

SEQ ID NO: 23727 - DNA, 201 bp, Homo sapiens
gttggaataagagttattgatatgcagatggaaataatttttagtccaagtccttcaaggagcagatgccaagatgagcttaaagtctgcgacatcttatraggggacacacccgtaagggaatatgggaagtgagccagaaatccctggaaaaggcggcagaccacgatgcaagtgtgaccccaagtgctggacagaagg

SEQ ID NO: 23728 - DNA, 201 bp, Homo sapiens
taagggaatatgggaagtgagccagaaatccctggaaaaggcggcagaccacgatgcaagtgtgaccccaagtgctggacagaaggagagaaagtttgtthgacgcatcctagagcacaggcaatctaaggagagttgagcaaggccgtggaggagccttccagctacagttggccatcagaggagtcccgtgtctcccag

SEQ ID NO: 23729 - DNA, 201 bp, Homo sapiens
ctcagtgtcaataatctgaccagttctgcatctttcctttcgccagtgtacaatctcctgagtaaatggctataggttcctttgctgaaggactgagggamttgtgccagcatttacttccacggagttgcagggtattcctcctagggatatggactcctcctctgtcactgggatctgaatctgaactttggctgaggt

SEQ ID NO: 23730 - DNA, 201 bp, Homo sapiens
atggtgatcatgccactgcattccagcctgggtgacagagcaagaccctgtctcaaaaataataatgatgatgatgacacatttagagcaaatgcaatttratgtgtaataatacatcctctcttgtgaaaatatattatttactgttgcataacaaattacgtaaaacttagctcgaaacaacaaatgtttctcatctcc

SEQ ID NO: 23731 - DNA, 201 bp, Homo sapiens
gccttccaaagtgctgggattacaggcgtgagccactgcacctggccgagtggccactctggaagctttgtaaggtttatcttcaccttctggagtgcccktgttttgccaagcactacagtgcactttctacctgctgctcatccagccaggtcaacaggaagttgtcaatgatatgagctgatttaatatcctattgga

SEQ ID NO: 23732 - DNA, 201 bp, Homo sapiens
acatacatttttaggattaaattgtcaattttccataaaatgcctgctggggttttgatagagattgtacagaacctatagatctcttggtggagaattgycatcttaacaatattattgagctttccaaccgcatctctccatgaatttagacctttaatttctctcagtaatgttttgtagttttcaacaaactctgct

SEQ ID NO: 23733 - DNA, 201 bp, Homo sapiens
cgttggcttttctgcatcctctgcattttcacatacatttttaggattaaattgtcaattttccataaaatgcctgctggggttttgatagagattgtacwgaacctatagatctcttggtggagaattgtcatcttaacaatattattgagctttccaaccgcatctctccatgaatttagacctttaatttctctcagt

SEQ ID NO: 23734 - DNA, 201 bp, Homo sapiens
aatagacatacagaaaagcctggaggagaaactgggtgagtgagatgggaatatgggttttgaaaagcttccatatccctgggaatctgtatagcctcctbcatgaccagtatgtcgcacagactcacaaagcacctgagaatgccctgtgttcacacctcttgctaactttcaatatctgcacaagtaggaaatgaaggc

SEQ ID NO: 23735 - DNA, 201 bp, Homo sapiens
atgttttttgtattttatgtaagaatcttttgcctaactactcaatgtcacaaaaattttctcctatattttcttttagaaattttatggttttaacttayaaattttagctgtttaggtctctaatttgtttgagcttatattttatatggcgataagtgtcacatcatattacctatgcaacttcattgaagatcaatt

SEQ ID NO: 23736 - DNA, 201 bp, Homo sapiens
aagaatacagtctatacaaaaatagtttagaaaacatgattttcaaagtcaccacatgttagtattcaaaataaaaatgaggtatgcaattaaactagacrgtaagacccattctcaagaaaaaagaggaattgacagaaactgttcctgagaaaggccattgaacatacttactggacaaacaactttgaattgactgct

SEQ ID NO: 23737 - DNA, 201 bp, Homo sapiens
aaaggaaactatgggcaaaaaactaaaggaaatcagaagaactatcttaactcaaatagagaacatcaataaaaagatagaaagtttaaaaagaaaccaartagaaattttggagctgaaaagtgcaataactgaaatgaaaaatttactagagtaattttactattttttactatattttactagagtaaatttactatt

SEQ ID NO: 23738 - DNA, 201 bp, Homo sapiens
aggcgttgggatgacaaatttaaagctgagaaagtaaaaggactatcaaccaagaattgtatgtctgcaaaactctccttcagaaatgatggagaaatcahgacattcacaggttaaaaaaagctgactgagattgtctcaaccctacaagacatatatatatacacacacacatatatatatttgtaattcctctcttgt

SEQ ID NO: 23739 - DNA, 201 bp, Homo sapiens
tttcaccatgttagccaggatggtctcgatctcctgacctcatgatccgcccgcctcagcctcccaaagtgctgggattacaggcgtgaggcaccgcaccyggcccacagccctttcattttcaaagcccatgctggaggaaacccctcatgctgagtccctctcacactgtgagtctctatgctcaggaagaacccagtc

SEQ ID NO: 23740 - DNA, 201 bp, Homo sapiens
tgggactacaggcacccgccactacgcttggctaatttttttttttttttttgtattcttagtagagacagggtttcaccatgttagccaggatggtctcratctcctgacctcatgatccgcccgcctcagcctcccaaagtgctgggattacaggcgtgaggcaccgcacccggcccacagccctttcattttcaaagc

SEQ ID NO: 23741 - DNA, 201 bp, Homo sapiens
tggccggatctcggctcactgccagctatggctcccaggttcacgccattctcctgtctcagcctcccaagcagctgggactacaggcacccgccactacrcttggctaatttttttttttttttttgtattcttagtagagacagggtttcaccatgttagccaggatggtctcgatctcctgacctcatgatccgcccg

SEQ ID NO: 23742 - DNA, 201 bp, Homo sapiens
cttaatgggcttcccagttaggagctgcctgctcagggctggaagtggaggagcactgagctgcaggtggagggcagaaccacagtgtttagggcctgccyttgtgtgcaggtgtctctacaggtgaggtgggactggggactgaggaagagaaggactgtgcgtgtgacccagcccagtcctggaaggacatggagccag

SEQ ID NO: 23743 - DNA, 201 bp, Homo sapiens
gggtgcagtggccggatctcggctcactgccagctatggctcccaggttcacgccattctcctgtctcagcctcccaagcagctgggactacaggcacccrccactacgcttggctaatttttttttttttttttgtattcttagtagagacagggtttcaccatgttagccaggatggtctcgatctcctgacctcatga

SEQ ID NO: 23744 - DNA, 201 bp, Homo sapiens
gggggtcagggtaggcagggcctccttgagcaagggggttcccagggtcaggtcagctgcagaccccatagcagctacatgtttccatgctgggcctgccrtgctgatgggattcttaatgggcttcccagttaggagctgcctgctcagggctggaagtggaggagcactgagctgcaggtggagggcagaaccacagtg

SEQ ID NO: 23745 - DNA, 201 bp, Homo sapiens
ttttattttatttatttattttttggagatggagtcttgctctgtagcccaggcttgggtgcagtggccggatctcggctcactgccagctatggctcccrggttcacgccattctcctgtctcagcctcccaagcagctgggactacaggcacccgccactacgcttggctaatttttttttttttttttgtattcttag

SEQ ID NO: 23746 - DNA, 201 bp, Homo sapiens
cagagactcggggagacccgggcggtccgtgggggatgtagaggggtagtgatctgcgcccccggccggtgtcactcacaggcctcactctggttgtagtrgccgctcagggtccgcaggttcactcggtaaaactgtgctttggccttggcggtccctgtctcctcttcccaatattccggcccctccggctccatcctg

SEQ ID NO: 23747 - DNA, 201 bp, Homo sapiens
cctgctaggaacaggagagaaaggcctttcagcctccccaagcagcagccctggggagaagctgtgcttccagggatgagtggaccaggctggagcaagcwtggcccaagtgcaggtcatgggcctgggggtcagggtaggcagggcctccttgagcaagggggttcccagggtcaggtcagctgcagaccccatagcagc

SEQ ID NO: 23748 - DNA, 201 bp, Homo sapiens
aatgcctccaagttctttgccaatgcataacaaaagtgacctttcctctaggtcccaataagttcctcatctccatgtgagaccttatcagcctggactchattgtccatatcactatcagcattttggtcacaacagcttaacaaatctctaggaagttgcaaattttcccccattttcttgtcttctgaactctccaaa

SEQ ID NO: 23749 - DNA, 201 bp, Homo sapiens
tcaagttcaaagttctacagatccctagggagggggaacaatgcctccaagttctttgccaatgcataacaaaagtgacctttcctctaggtcccaataarttcctcatctccatgtgagaccttatcagcctggactctattgtccatatcactatcagcattttggtcacaacagcttaacaaatctctaggaagttgc

SEQ ID NO: 23750 - DNA, 201 bp, Homo sapiens
ttggctcaggattctgatgtctggaaatgtttgagcatttagcgagggcctcaggctgcttccactcatggcagaaggcaaaggggagctggtatgtgcaraagtcacgtggtaagagaggaacagagggagtaggaaggtgcgagactcttttaacaactagctcttttggaaactaatagggcaacaattcattgactc

SEQ ID NO: 23751 - DNA, 201 bp, Homo sapiens
tctttgatggagcagtaaaaaatttatgtggattaaagtttgatccttgagtatacgtctttaatattctttgtgagaaaatgggaaatatgcataagacmcttactgcacagagaagcaggatggtagccttgagaaagggcacttgtgtgactcagttatgatttcaaccagcagatctcactcacctacggaaagaca

SEQ ID NO: 23752 - DNA, 201 bp, Homo sapiens
tcggaccccaggtcgcagccaatcatccactggagggtgtgagaacctggccccaccccctcggtcagccccgcccaccgagcctcgccctcgcccggacmcacccgcggggattttggtaaaggcgccttggggttctcccaggtagagggtctgggcgggtcccgcggcctcggggtggatcccagacccggagactcg

SEQ ID NO: 23753 - DNA, 201 bp, Homo sapiens
gtgtctttgatggagcagtaaaaaatttatgtggattaaagtttgatccttgagtatacgtctttaatattctttgtgagaaaatgggaaatatgcataaracccttactgcacagagaagcaggatggtagccttgagaaagggcacttgtgtgactcagttatgatttcaaccagcagatctcactcacctacggaaag

SEQ ID NO: 23754 - DNA, 201 bp, Homo sapiens
taaaaggactatcaaccaagaattgtatgtctgcaaaactctccttcagaaatgatggagaaatcacgacattcacaggttaaaaaaagctgactgagatdgtctcaaccctacaagacatatatatatacacacacacatatatatatttgtaattcctctcttgtttttcctatttgatttaaaagaaaatgtccatcg

SEQ ID NO: 23755 - DNA, 201 bp, Homo sapiens
gtcggtagcacacccagcacctcagcagaaccaggcagtggctccaaactgcagtcccatttaagagtgtctttgatggagcagtaaaaaatttatgtggrttaaagtttgatccttgagtatacgtctttaatattctttgtgagaaaatgggaaatatgcataagacccttactgcacagagaagcaggatggtagcct

SEQ ID NO: 23756 - DNA, 201 bp, Homo sapiens
atttaaaagaaaatgtccatcgaccaatgaatggagaaacaacatatagttttttcctacaatagaatattatttggtcataaaatgaataaagcactggyatatgctaaaacattgctgaatcttgaaaacaagacaagtgaaggaagccagtcacaggaggctacgtaacttatgagcccatttttgtgaaatattcat

SEQ ID NO: 23757 - DNA, 201 bp, Homo sapiens
ttacccttctgggtctccatggtccatcatttcacactctccttttatgtatataaagagatattaaccaaatacggcagagtggtaacttgaattttacygcaccgttctttcagcttctttgcacatttgaaaatttatacagttataagttggaagaatgagggaaaatagagagcaagacagtgctgaataggaata

SEQ ID NO: 23758 - DNA, 201 bp, Homo sapiens
agaatgaagaatcggcaagcttaaaggtaagacaattgaaattatccagtttgaggtgcagaaataaaaaaaaattatgaagaaaaatgaacagaacttawgaaaactgtgagacaacaccaagcatatgcattttgggaatcctcaaagaaaggagagagaaaaagaagaatggctatttggaggaataataacttcaaa

SEQ ID NO: 23759 - DNA, 201 bp, Homo sapiens
atattatttggtcataaaatgaataaagcactggcatatgctaaaacattgctgaatcttgaaaacaagacaagtgaaggaagccagtcacaggaggctamgtaacttatgagcccatttttgtgaaatattcataagaggcaagtcgatagagaaagaagtggatttgtggcgacagggtctgctggcaggtggaaatgg

SEQ ID NO: 23760 - DNA, 201 bp, Homo sapiens
cacacacaggcacacacacacattcacacacatgctatacaaacatgtctacctgtatctataaagagacatgttatgttattttattttttatttcttarattcatatatattcatgaggcacaagtgcaattttgctacattgctatattggttgtggtaaagtcagggccttcagagcatccagcactggagacaagc

SEQ ID NO: 23761 - DNA, 201 bp, Homo sapiens
ctctctacacggacacacacacacaggcggacacacacacaggcacacacacacattcacacacatgctatacaaacatgtctacctgtatctataaagaracatgttatgttattttattttttatttcttaaattcatatatattcatgaggcacaagtgcaattttgctacattgctatattggttgtggtaaagtca

SEQ ID NO: 23762 - DNA, 201 bp, Homo sapiens
cagggagggctgtgctcgattcctggtcctcaccagcattctttcctacacagccccttcattttttattttatttatttattttttggagatggagtctygctctgtagcccaggcttgggtgcagtggccggatctcggctcactgccagctatggctcccaggttcacgccattctcctgtctcagcctcccaagcag

SEQ ID NO: 23763 - DNA, 201 bp, Homo sapiens
tcaatgtagagaacagggagggctgtgctcgattcctggtcctcaccagcattctttcctacacagccccttcattttttattttatttatttattttttkgagatggagtcttgctctgtagcccaggcttgggtgcagtggccggatctcggctcactgccagctatggctcccaggttcacgccattctcctgtctca

SEQ ID NO: 23764 - DNA, 201 bp, Homo sapiens
atggagggtgactgcttaatgggtgcagagttccccctgaggtgataaaaacactctggaactagagagtgatgatggttacataacattgtgaacatacraattgtcactgcattgtgcactttaaatggttacggtggtatcctttgtgtttatgtgtattttaccacaatgaaaaagaggctgaggaaggtattccaa

SEQ ID NO: 23765 - DNA, 201 bp, Homo sapiens
ccatgtgtgttttatgtttaagttactttggaatagctcagtcacaaaatcttaatctcttaatttgtgctgcctctctacacggacacacacacacagghggacacacacacaggcacacacacacattcacacacatgctatacaaacatgtctacctgtatctataaagagacatgttatgttattttattttttatt

SEQ ID NO: 23766 - DNA, 201 bp, Homo sapiens
gtccctgttccttgctggctgtcaatgtagagaacagggagggctgtgctcgattcctggtcctcaccagcattctttcctacacagccccttcatttttwattttatttatttattttttggagatggagtcttgctctgtagcccaggcttgggtgcagtggccggatctcggctcactgccagctatggctcccaggt

SEQ ID NO: 23767 - DNA, 201 bp, Homo sapiens
acagacacatttatccatgtgtgttttatgtttaagttactttggaatagctcagtcacaaaatcttaatctcttaatttgtgctgcctctctacacggamacacacacacaggcggacacacacacaggcacacacacacattcacacacatgctatacaaacatgtctacctgtatctataaagagacatgttatgtta

SEQ ID NO: 23768 - DNA, 201 bp, Homo sapiens
aatgcagtttctggcagttgtaagactgaggtccctgttccttgctggctgtcaatgtagagaacagggagggctgtgctcgattcctggtcctcaccagyattctttcctacacagccccttcattttttattttatttatttattttttggagatggagtcttgctctgtagcccaggcttgggtgcagtggccggatc

SEQ ID NO: 23769 - DNA, 201 bp, Homo sapiens
ggcttatacagaggtggcagaatgcagtttctggcagttgtaagactgaggtccctgttccttgctggctgtcaatgtagagaacagggagggctgtgctygattcctggtcctcaccagcattctttcctacacagccccttcattttttattttatttatttattttttggagatggagtcttgctctgtagcccaggc

SEQ ID NO: 23770 - DNA, 201 bp, Homo sapiens
gggcttccaaaagctgtgttttcattttgaatcctccttcaggcttatacagaggtggcagaatgcagtttctggcagttgtaagactgaggtccctgttycttgctggctgtcaatgtagagaacagggagggctgtgctcgattcctggtcctcaccagcattctttcctacacagccccttcattttttattttattt

SEQ ID NO: 23771 - DNA, 201 bp, Homo sapiens
acccatttatctgcttatagttccttgatcagaaatctgggcaaaattgtggatggaatctctcttctgggcttccaaaagctgtgttttcattttgaatvctccttcaggcttatacagaggtggcagaatgcagtttctggcagttgtaagactgaggtccctgttccttgctggctgtcaatgtagagaacagggagg

SEQ ID NO: 23772 - DNA, 201 bp, Homo sapiens
gcaggtcctcgttcaaggcgatgtaatccttgccgtcgtaggcgtcctgccggtacccgcggaggaagcgcccgtccgaccccacgtcgcagccatacatyatctggatggtgtgagaacctggccccgaccccacggtcagcccagtcccccgagccccgtccggccccgaccaacccggggggatttttggcctaaact

SEQ ID NO: 23773 - DNA, 201 bp, Homo sapiens
cagataattataaagtgcaaaacacggaaaaagttcagaaaatttttattttatgtaactagtgtgcatatcaattcatcaattcattcgtgcactaccaygcctggcgaaacaacacccatttatctgcttatagttccttgatcagaaatctgggcaaaattgtggatggaatctctcttctgggcttccaaaagctgt

SEQ ID NO: 23774 - DNA, 201 bp, Homo sapiens
agagcgcaggtcctcgttcaaggcgatgtaatccttgccgtcgtaggcgtcctgccggtacccgcggaggaagcgcccgtccgaccccacgtcgcagccawacatcatctggatggtgtgagaacctggccccgaccccacggtcagcccagtcccccgagccccgtccggccccgaccaacccggggggatttttggcct

SEQ ID NO: 23775 - DNA, 201 bp, Homo sapiens
gacaggatttcattcttttttatggctgaattgcattccattgtgtatatatataccaccatttattcattcacccattgatgaattcacccattgatttvataacttcgctactgtgaatagtgcttcaataaacctgggggtgcaggtagtcttttgatatattgatttcttttcctttatataaatacccatgagtgg

SEQ ID NO: 23776 - DNA, 201 bp, Homo sapiens
aaccataaggtctccaagtggatctcttatttccacacacacatctcctgccctccttgtgtgatagcagccctgcctcctcctcttctcacctgcttgtrtctggacacatactattcaaacatccctgggggcagccataatgtgtatttccatggactctcatttaaatgtctccttgccagggtgccccctttggga

SEQ ID NO: 23777 - DNA, 201 bp, Homo sapiens
tgggtctggtcctccccatcccgctgccaggtcagtgtgatctccgcagggtagaagctcagggcccagcacctcagggtggcttcatggtcagagacagsgtggtgagtcatatgcgttttgggggcgtctgtcaggaagagtcagatcattcaggcattttgcatctgtcatgggacactcctccagcacacatgtggc

SEQ ID NO: 23778 - DNA, 201 bp, Homo sapiens
ccctgaccctgctaaaggtcagagaggctcctgctttccctaaaagacatgacacccccgtctccctccttaccccatctcagggtgaggggcttgggcaraccctcatgctgcacatggcaggtgtatctctgctcctgtccagaaggcaccaccacagccgcccacttctggaaggttccatcccctgcaggcctggtc

SEQ ID NO: 23779 - DNA, 201 bp, Homo sapiens
agtatatacctaggagtggaaatggtagctgtagaggactagcttgtttaactttattagatgatatgaaattgattttcaaaatggatgttttatattcytataggcaatggaggagagtacagattgttccacatccttgctagcatttatagttattaatcattttaattttagccattctaatggttgcttagtggt

SEQ ID NO: 23780 - DNA, 201 bp, Homo sapiens
aatgtttgccattttaactctgtgctttacatgaaagcttgtgactcattttgagttatttttgtatgaagcatgaggttttggctcaggttattttttttccactgtggttgtccagttgttccatcaccatttgatgggaaagctctccttccttcattgaattgcttttgtgcttttgtaaaagtcagttgagcatgt

SEQ ID NO: 23781 - DNA, 201 bp, Homo sapiens
ttctggtctgcgttttatttcaagtgtctgggaagggatagtgtgaggttcaggagagaaggagaggtctgtctccatgctttgacacagcataaagaaabctcccctcctcccccacatctccccaccagttctcagtgagggacagattcacagcaacaccgaaagggctgggaagggatggggggacatttgcagcca

SEQ ID NO: 23782 - DNA, 201 bp, Homo sapiens
ccggcccctcctgctctatccacggtgcccgcggctccatcctctggctcgcggcgtcgctgtcaaaccgcacgaactgcgtgtcgtccacgtagcccackgcgatgaagcggggctccccgcggccgggccgggacacggatgtggtgaaatacctcatggagtgggagcctgggggcgaggagtggctgagacccaccc

SEQ ID NO: 23783 - DNA, 201 bp, Homo sapiens
ctggttgtagtagccgctcagggtccgcaggttcactcggtaaaactgtgctttggccttggcggtccctgtctcctcttcccaatattccggcccctcckgctccatcctgggactcgtggcgtcgctgtcgagccgcacgcactgcgtgtcgtccacgtcgcccacggagaggaagcggggatccgcgcggccgggccg

SEQ ID NO: 23784 - DNA, 201 bp, Homo sapiens
ctcgctctggttgtagtagccgcgcagggtccccaggttcgctcggtcagtctgtgactgggccttcacattccgtgtctgcaggtcccaatactccggcycctcctgctctatccacggtgcccgcggctccatcctctggctcgcggcgtcgctgtcaaaccgcacgaactgcgtgtcgtccacgtagcccacggcgat

SEQ ID NO: 23785 - DNA, 201 bp, Homo sapiens
cctcgctctggttgtagtagccgcgcagggtccccaggttcgctcggtcagtctgtgactgggccttcacattccgtgtctgcaggtcccaatactccggmccctcctgctctatccacggtgcccgcggctccatcctctggctcgcggcgtcgctgtcaaaccgcacgaactgcgtgtcgtccacgtagcccacggcga

SEQ ID NO: 23786 - DNA, 201 bp, Homo sapiens
ctgattcacccctctgccacccccaattgaaggaaggagctgtattcttatcttggcccatccatcaactgaatgccgctggacatggaacattacaagtrtgaagcttccagggttctcagttgctcttcctgctgttgtggagactccattggtgtggctcacatccaggcaggcctgcaggaagctgtttcctaattc

SEQ ID NO: 23787 - DNA, 201 bp, Homo sapiens
cggcctcgctctggttgtagtagccgcgcagggtccccaggttcgctcggtcagtctgtgactgggccttcacattccgtgtctgcaggtcccaatactcmggcccctcctgctctatccacggtgcccgcggctccatcctctggctcgcggcgtcgctgtcaaaccgcacgaactgcgtgtcgtccacgtagcccacgg

SEQ ID NO: 23788 - DNA, 201 bp, Homo sapiens
tagctgggactacaggtgcccaccacagtgttcagccacttttcattgttattttacttcaaatgttttattttgaatgttaaaaatacatgtttctacaytagaaatatgaaaatgtatttgattacagaagaatttaaaatgcacacatcaacacctggttgaattttaaagaaaaaaaaatgcagagaagaaagaaat

SEQ ID NO: 23789 - DNA, 201 bp, Homo sapiens
gtaggaaatgaaggccaaagcagtattgtaaactgcccagcagagtgttgagggcatgccccaaaacacacagagagcccagataaaaagattgaattttyttttcttatttctttttggctgaagatgtttcaggaaatatctatcaaatcatgagttgaccactaagcttacagaatagagacttcagtgatgacacac

SEQ ID NO: 23790 - DNA, 201 bp, Homo sapiens
cggggtcactcaccggcctcgctctggttgtagtagccgcgcagggtccccaggttcgctcggtcagtctgtgactgggccttcacattccgtgtctgcasgtcccaatactccggcccctcctgctctatccacggtgcccgcggctccatcctctggctcgcggcgtcgctgtcaaaccgcacgaactgcgtgtcgtcc

SEQ ID NO: 23791 - DNA, 201 bp, Homo sapiens
gggaggcagaggttgcagttagccgggatcatgccattgcactccaccctgggcaacaagagcaaaactccatcaaaaaaaaaaaaaaaaaaattccctcrgagagctgttaaagcaagaattcctggacctaccaccagatattctgattgggttgataaagaatcaactgcattggaaccctgaaaaatcatcaaaggt

SEQ ID NO: 23792 - DNA, 201 bp, Homo sapiens
tggtctgcgttttatttcaagtgtctgggaagggatagtgtgaggttcaggagagaaggagaggtctgtctccatgctttgacacagcataaagaaaccthccctcctcccccacatctccccaccagttctcagtgagggacagattcacagcaacaccgaaagggctgggaagggatggggggacatttgcagccagtg

SEQ ID NO: 23793 - DNA, 201 bp, Homo sapiens
gttcagccacttttcattgttattttacttcaaatgttttattttgaatgttaaaaatacatgtttctacattagaaatatgaaaatgtatttgattacasaagaatttaaaatgcacacatcaacacctggttgaattttaaagaaaaaaaaatgcagagaagaaagaaatatcacccaggcttcccctccaaagaacca

SEQ ID NO: 23794 - DNA, 201 bp, Homo sapiens
ctttcatcttgtcttttggtaaagaatattttgacaagcatgtttgtacatgaagattcttctatggttgtgattttaaaaattcatagaacactcaggayggacatggtggctcatgcctgtacttccagcactttgggaggctcaggctggcagattgcttgagcccctgagtttgtgaccagcctaggcaacatagag

SEQ ID NO: 23795 - DNA, 201 bp, Homo sapiens
ggactaaattaatttttgtcgactgaatgaatgaaatatgagtgtattaaattgcattacagataattataaagtgcaaaacacggaaaaagttcagaaartttttattttatgtaactagtgtgcatatcaattcatcaattcattcgtgcactaccatgcctggcgaaacaacacccatttatctgcttatagttcctt

SEQ ID NO: 23796 - DNA, 201 bp, Homo sapiens
agcatatgaggggatatctggtttatcgtagggactaaattaatttttgtcgactgaatgaatgaaatatgagtgtattaaattgcattacagataattabaaagtgcaaaacacggaaaaagttcagaaaatttttattttatgtaactagtgtgcatatcaattcatcaattcattcgtgcactaccatgcctggcgaa

SEQ ID NO: 23797 - DNA, 201 bp, Homo sapiens
tagtccccaccacactgtcacttgtgagttgtgacactagcactgtcccatgacctgttacgtgactgttcttttcacagtggtcctgctcctgggagtcrgagtgtgtcatctctccacttaaaacactccagtgtctccacctcggtcttgagaaacttctggagtgtcaggcacgtgagcatatgaggggatatctgg

SEQ ID NO: 23798 - DNA, 201 bp, Homo sapiens
ctccgtccttttcatccttcaggccctcctgtccccttagtccccaccacactgtcacttgtgagttgtgacactagcactgtcccatgacctgttacgtractgttcttttcacagtggtcctgctcctgggagtcggagtgtgtcatctctccacttaaaacactccagtgtctccacctcggtcttgagaaacttctg

SEQ ID NO: 23799 - DNA, 201 bp, Homo sapiens
ctccttttcttcacctcctgcttctccagcccttctctccgtccttttcatccttcaggccctcctgtccccttagtccccaccacactgtcacttgtgarttgtgacactagcactgtcccatgacctgttacgtgactgttcttttcacagtggtcctgctcctgggagtcggagtgtgtcatctctccacttaaaaca

SEQ ID NO: 23800 - DNA, 201 bp, Homo sapiens
atagagcacagtacccagaataaggtaggtgcttaatgatgtttaccatttgaatgagtttcctggaagtacttagcagatcaggaattctgatgcataarcacaattcaaaggtggctgaggagtgacatcagagaacatagtggcataggaactccaagggccacctctgcacagagacaatgtgcttgtaaaacatca

SEQ ID NO: 23801 - DNA, 201 bp, Homo sapiens
acttctatgaagtccaaggaagtttgattcttttatctgaggctcaactccatagagcacagtacccagaataaggtaggtgcttaatgatgtttaccatwtgaatgagtttcctggaagtacttagcagatcaggaattctgatgcataagcacaattcaaaggtggctgaggagtgacatcagagaacatagtggcata

SEQ ID NO: 23802 - DNA, 201 bp, Homo sapiens
aaacctaagaattctgctgctttcgaattctttcctctgctccttttcttcacctcctgcttctccagcccttctctccgtccttttcatccttcaggccstcctgtccccttagtccccaccacactgtcacttgtgagttgtgacactagcactgtcccatgacctgttacgtgactgttcttttcacagtggtcctgc

SEQ ID NO: 23803 - DNA, 201 bp, Homo sapiens
taaaacaatgtatttaaacctaagaattctgctgctttcgaattctttcctctgctccttttcttcacctcctgcttctccagcccttctctccgtccttytcatccttcaggccctcctgtccccttagtccccaccacactgtcacttgtgagttgtgacactagcactgtcccatgacctgttacgtgactgttcttt

SEQ ID NO: 23804 - DNA, 201 bp, Homo sapiens
attaaaatccataaaacaatgtatttaaacctaagaattctgctgctttcgaattctttcctctgctccttttcttcacctcctgcttctccagcccttcyctccgtccttttcatccttcaggccctcctgtccccttagtccccaccacactgtcacttgtgagttgtgacactagcactgtcccatgacctgttacgt

SEQ ID NO: 23805 - DNA, 201 bp, Homo sapiens
tttcatccaagctggcactaagttgtgtctgtagagacctgtccatgactctgtgtggctggcagcccctgggaggtgcaggtggtgataagaccaggggrtgccatggtcatggaccacgcttcatcccctttcctctgaggtgtgtcccgcgggcagataatgtactgaaattctgagccagtggctcaggaatgccaa

SEQ ID NO: 23806 - DNA, 201 bp, Homo sapiens
gctaagtgttgtgtatattttataggaacacttagtaatttttaaacctgattaacattaaaaaattagtttttaggcagacccacatgaggtattaaagrccaactgccaaggacaccctgctaggctctgtagatggatgtattaaaatccataaaacaatgtatttaaacctaagaattctgctgctttcgaattctt

SEQ ID NO: 23807 - DNA, 201 bp, Homo sapiens
gaggctcctgctttccctaacagacatgatgcctccatctccctccttactccatctcagcatgaggggctccggcagcccctcatgctgcacatggcacrtgtatctctgctcctctccagaaggcaccaccacagctgcccacttctggaaggttccatcccctgcaggcctggtctccacgagctccacgtcctgggt

SEQ ID NO: 23808 - DNA, 201 bp, Homo sapiens
agaggctcctgctttccctaacagacatgatgcctccatctccctccttactccatctcagcatgaggggctccggcagcccctcatgctgcacatggcaygtgtatctctgctcctctccagaaggcaccaccacagctgcccacttctggaaggttccatcccctgcaggcctggtctccacgagctccacgtcctggg

SEQ ID NO: 23809 - DNA, 201 bp, Homo sapiens
ccggggtcactcaccggcctcgctctggttgtagtagccgcgcagggtccccaggttcgctcggtcagtctgtgactgggccttcacattccgtgtctgcyggtcccaatactccggcccctcctgctctatccacggtgcccgcggctccatcctctggctcgcggcgtcgctgtcaaaccgcacgaactgcgtgtcgtc

SEQ ID NO: 23810 - DNA, 201 bp, Homo sapiens
cgggccggggtcactcaccggcctcgctctggttgtagtagccgcgcagggtccccaggttcgctcggtcagtctgtgactgggccttcacattccgtgtstgcaggtcccaatactccggcccctcctgctctatccacggtgcccgcggctccatcctctggctcgcggcgtcgctgtcaaaccgcacgaactgcgtgt

SEQ ID NO: 23811 - DNA, 201 bp, Homo sapiens
gccccgggccggggtcactcaccggcctcgctctggttgtagtagccgcgcagggtccccaggttcgctcggtcagtctgtgactgggccttcacattccstgtctgcaggtcccaatactccggcccctcctgctctatccacggtgcccgcggctccatcctctggctcgcggcgtcgctgtcaaaccgcacgaactgc

SEQ ID NO: 23812 - DNA, 201 bp, Homo sapiens
cctgcgccccgggccggggtcactcaccggcctcgctctggttgtagtagccgcgcagggtccccaggttcgctcggtcagtctgtgactgggccttcacwttccgtgtctgcaggtcccaatactccggcccctcctgctctatccacggtgcccgcggctccatcctctggctcgcggcgtcgctgtcaaaccgcacga

SEQ ID NO: 23813 - DNA, 201 bp, Homo sapiens
acctgcgccccgggccggggtcactcaccggcctcgctctggttgtagtagccgcgcagggtccccaggttcgctcggtcagtctgtgactgggccttcayattccgtgtctgcaggtcccaatactccggcccctcctgctctatccacggtgcccgcggctccatcctctggctcgcggcgtcgctgtcaaaccgcacg

SEQ ID NO: 23814 - DNA, 201 bp, Homo sapiens
taatttgtaatctttggtatatgtaactcagtactgtcataaaatattaataatgtagctttcaaagaaaaaagtcatgtaaaatacataacatgctgtgytataatttctttatttatcttcccacccccacctttgacttctatgaagtccaaggaagtttgattcttttatctgaggctcaactccatagagcacagt

SEQ ID NO: 23815 - DNA, 201 bp, Homo sapiens
ggcaggaaaggttttctcgtaggtcactgggacattggccagaaaaaggcatgaaaattacatgttagtttctcaaaattcctgctttaagtattggtgtvcatcaacataatttcagctggataatcttaataggatttcccccaatactgatgttgtaaaggatgttgaatagaacaggaagtcaaatttggggcttcg

SEQ ID NO: 23816 - DNA, 201 bp, Homo sapiens
ttgctcctgctctcacctgcggtgtctcctatagagggattgtcagttctggttccctgtaggcaggaaaggttttctcgtaggtcactgggacattggcbagaaaaaggcatgaaaattacatgttagtttctcaaaattcctgctttaagtattggtgtccatcaacataatttcagctggataatcttaataggattt

SEQ ID NO: 23817 - DNA, 201 bp, Homo sapiens
caaccacagcacgggcagtgcaggtctgtggttgctcctgctctcacctgcggtgtctcctatagagggattgtcagttctggttccctgtaggcaggaawggttttctcgtaggtcactgggacattggccagaaaaaggcatgaaaattacatgttagtttctcaaaattcctgctttaagtattggtgtccatcaaca

SEQ ID NO: 23818 - DNA, 201 bp, Homo sapiens
accaccgaccctgttaaaggtcttcagagaggctcctgctttccctaacagacatgatgcctccatctccctccttactccatctcagcatgaggggctcyggcagcccctcatgctgcacatggcacgtgtatctctgctcctctccagaaggcaccaccacagctgcccacttctggaaggttccatcccctgcaggcc

SEQ ID NO: 23819 - DNA, 201 bp, Homo sapiens
tctatggcttctgcgaggagccaggacatccagatagaatgggccacatgaatcaattggtacgtgtttctcctttcaggcagagtctcactcacttcacrcaagcacagagatccccatataggcaactagattatgagaaacaaacgcacccatccaaacccaaagaatggactctgagacccagagaacagcaaaagt

SEQ ID NO: 23820 - DNA, 201 bp, Homo sapiens
gaagtatccactgctaagtgttgtgtatattttataggaacacttagtaatttttaaacctgattaacattaaaaaattagtttttaggcagacccacatraggtattaaaggccaactgccaaggacaccctgctaggctctgtagatggatgtattaaaatccataaaacaatgtatttaaacctaagaattctgctgc

SEQ ID NO: 23821 - DNA, 201 bp, Homo sapiens
tttattcacctcaaagttgcaactgttcaatgtagtcacaatgcccctcactagtgctcatgcactgcctgtttttaggaagtatccactgctaagtgttrtgtatattttataggaacacttagtaatttttaaacctgattaacattaaaaaattagtttttaggcagacccacatgaggtattaaaggccaactgcca

SEQ ID NO: 23822 - DNA, 201 bp, Homo sapiens
cagtacaggctttattcacctcaaagttgcaactgttcaatgtagtcacaatgcccctcactagtgctcatgcactgcctgtttttaggaagtatccactkctaagtgttgtgtatattttataggaacacttagtaatttttaaacctgattaacattaaaaaattagtttttaggcagacccacatgaggtattaaagg

SEQ ID NO: 23823 - DNA, 201 bp, Homo sapiens
agtcagtacaggctttattcacctcaaagttgcaactgttcaatgtagtcacaatgcccctcactagtgctcatgcactgcctgtttttaggaagtatccrctgctaagtgttgtgtatattttataggaacacttagtaatttttaaacctgattaacattaaaaaattagtttttaggcagacccacatgaggtattaa

SEQ ID NO: 23824 - DNA, 201 bp, Homo sapiens
aggtcggccggattccgcacccctgcctccaaccaccgcccatgggcggggaggagagactaccggccgcaagcagaacgcagaacgagaagagcggtccygttagccatgaatgtgtccctcatctgtaccgcctccggccccgcccgggagaacgcgacgtcaccacatccatcacttgttctctttcactcttcccgt

SEQ ID NO: 23825 - DNA, 201 bp, Homo sapiens
ggcaccggagggacaacctggagggctccgggagcaccgcaaaggtccaagcggagccaatcctcacaagcccagggaagggcaacgtgacaggccggcgsgacagccccaccgccgcgaagaggggctgcccaaaaggcaacagccataggagatgagcaggggtgcctgctgcgtcggagaactcatctccccaacccc

SEQ ID NO: 23826 - DNA, 201 bp, Homo sapiens
ttctctgtttctgcctttctagggagcaaccactttcaagtttcagctgattcttttgactttactttcacatatctaagcaccaaagcaccatttctttrttaacattgcttgatttttcagttgcagccattgactattgcactgcacgatggtggaatcaatagttaagattacttgttctctttctttttgtatttt

SEQ ID NO: 23827 - DNA, 201 bp, Homo sapiens
atacaaagtagcacactgtgtactttgcaaccaggtacgttgcaaccaggagtcagtacaggctttattcacctcaaagttgcaactgttcaatgtagtcrcaatgcccctcactagtgctcatgcactgcctgtttttaggaagtatccactgctaagtgttgtgtatattttataggaacacttagtaatttttaaacc

SEQ ID NO: 23828 - DNA, 201 bp, Homo sapiens
tctcctcaatacaaagtagcacactgtgtactttgcaaccaggtacgttgcaaccaggagtcagtacaggctttattcacctcaaagttgcaactgttcartgtagtcacaatgcccctcactagtgctcatgcactgcctgtttttaggaagtatccactgctaagtgttgtgtatattttataggaacacttagtaatt

SEQ ID NO: 23829 - DNA, 201 bp, Homo sapiens
aagcgttacaacaggactcacaaagcttctaagtttcacttttgcagtgtacctgtgactcccgcttgtcatattttaaatttgccatcattccatagctytgagtttctgtgtgagtccaggatatctcctcaatacaaagtagcacactgtgtactttgcaaccaggtacgttgcaaccaggagtcagtacaggcttta

SEQ ID NO: 23830 - DNA, 201 bp, Homo sapiens
gtgcatgagacagaatagagaccagtttatttatttatttgtttattaaatacattggatagcagaaccttggtaacccctgaatgatcaggaatctaatmggtaaaaaatgtgactttggccccatgatgtataaatgtgcccaaaagcgttacaacaggactcacaaagcttctaagtttcacttttgcagtgtacctg

SEQ ID NO: 23831 - DNA, 201 bp, Homo sapiens
tgacctgcgccccgggccggggtcactcaccggcctcgctctggttgtagtagccgcgcagggtccccaggttcgctcggtcagtctgtgactgggccttsacattccgtgtctgcaggtcccaatactccggcccctcctgctctatccacggtgcccgcggctccatcctctggctcgcggcgtcgctgtcaaaccgca

SEQ ID NO: 23832 - DNA, 201 bp, Homo sapiens
ggaaaggcacgctctctctgttgtgtgggtgatggacagtgggcatgagagtcagcaggcagcccagctggaaggcccttccggttttctatcctagtgakgatggttctggggtggaggtggcagaggagtgagaagtgattggatttggtgttgatatatatttttaaaattgtggtaaaacacacatactatacgatt

SEQ ID NO: 23833 - DNA, 201 bp, Homo sapiens
gagaggtcgtgacctgcgccccgggccggggtcactcaccggcctcgctctggttgtagtagccgcgcagggtccccaggttcgctcggtcagtctgtgastgggccttcacattccgtgtctgcaggtcccaatactccggcccctcctgctctatccacggtgcccgcggctccatcctctggctcgcggcgtcgctgt

SEQ ID NO: 23834 - DNA, 201 bp, Homo sapiens
tgagaggtcgtgacctgcgccccgggccggggtcactcaccggcctcgctctggttgtagtagccgcgcagggtccccaggttcgctcggtcagtctgtgmctgggccttcacattccgtgtctgcaggtcccaatactccggcccctcctgctctatccacggtgcccgcggctccatcctctggctcgcggcgtcgctg

SEQ ID NO: 23835 - DNA, 201 bp, Homo sapiens
tgggggatgagaggtcgtgacctgcgccccgggccggggtcactcaccggcctcgctctggttgtagtagccgcgcagggtccccaggttcgctcggtcartctgtgactgggccttcacattccgtgtctgcaggtcccaatactccggcccctcctgctctatccacggtgcccgcggctccatcctctggctcgcggc

SEQ ID NO: 23836 - DNA, 201 bp, Homo sapiens
cgtgggggatgagaggtcgtgacctgcgccccgggccggggtcactcaccggcctcgctctggttgtagtagccgcgcagggtccccaggttcgctcggtsagtctgtgactgggccttcacattccgtgtctgcaggtcccaatactccggcccctcctgctctatccacggtgcccgcggctccatcctctggctcgcg

SEQ ID NO: 23837 - DNA, 201 bp, Homo sapiens
catcagaactcaaagaggctcatcaggcagtgtgcttccttccttctggtgaggatgcaagatgaaacagtttgtcttttaccttggaggggacacacctrcattcccctaaacacttggcacttgttcacccataaaacttcacttcagtggccactcttgaagctctgtaaggtttaccttcaccttctggagtgtgct

SEQ ID NO: 23838 - DNA, 201 bp, Homo sapiens
gcccgtccgtgggggatgagaggtcgtgacctgcgccccgggccggggtcactcaccggcctcgctctggttgtagtagccgcgcagggtccccaggttcdctcggtcagtctgtgactgggccttcacattccgtgtctgcaggtcccaatactccggcccctcctgctctatccacggtgcccgcggctccatcctctg

SEQ ID NO: 23839 - DNA, 201 bp, Homo sapiens
ggcccagctgttttctctttatctctttgtcttgtgcttttatttattacaatctctcatctccgcacacggggagaaaacccgctaagccccgtagggcyggatcatacagccaaggacaacggagcagcaaagatgacccagctgagcagtgaccacataaagcgcacggtggcctgagcacccactgggcacagcccc

SEQ ID NO: 23840 - DNA, 201 bp, Homo sapiens
cggagtttggtgacagagagtgagcttgctctgggaatggaggtgtagaaactgttttttgttttcctttttttttttttttttattgggaaaagttgtghctgagtgcatgagacagaatagagaccagtttatttatttatttgtttattaaatacattggatagcagaaccttggtaacccctgaatgatcaggaatc

SEQ ID NO: 23841 - DNA, 201 bp, Homo sapiens
agaagaaaagtcacccacggagtttggtgacagagagtgagcttgctctgggaatggaggtgtagaaactgttttttgttttcctttttttttttttttttattgggaaaagttgtgcctgagtgcatgagacagaatagagaccagtttatttatttatttgtttattaaatacattggatagcagaaccttggtaaccc

SEQ ID NO: 23842 - DNA, 201 bp, Homo sapiens
cgatgagatccgccatcactggggagacagtgtcctgggtctcaagtatgtggtttgcattgccaagctcaaaaaggcaaagggtaaagaacatgccactraattgggtgaaatgtatgctgttgagttttctgtatgtaaaaataattaaaataatataaattttccttcaaaaaacaaaaacaaaacaaaaacagaaaa

SEQ ID NO: 23843 - DNA, 201 bp, Homo sapiens
aagttacaattgcacataattgaaagagtaaatatttgcgcaggacttcctgagaaaaacgagtcttctctgcctttctagggagagtcctctcttctctrtttctgcctttctagggagcaaccactttcaagtttcagctgattcttttgactttactttcacatatctaagcaccaaagcaccatttctttgttaaca

SEQ ID NO: 23844 - DNA, 201 bp, Homo sapiens
tagaagaaaagtcacccacggagtttggtgacagagagtgagcttgctctgggaatggaggtgtagaaactgttttttgttttcctttttttttttttttttattgggaaaagttgtgcctgagtgcatgagacagaatagagaccagtttatttatttatttgtttattaaatacattggatagcagaaccttggtaacc

SEQ ID NO: 23845 - DNA, 201 bp, Homo sapiens
tgtggtcgctcctgctctcacctgtggtgtctcctgaagagggattgtcagttctggttccccgtgggcgggaacggttgccttgtaggttactggggcaytggccaggaaaggggtgtgaaagttatgtgctaatttctcaaaattcctgctttaaatgctgatgtccaataaagatgttcgtagtttcagctgggtctt

SEQ ID NO: 23846 - DNA, 201 bp, Homo sapiens
catccaggaatctccgtccctgaactggactccctgtccacctggactcttctagaagaaaagtcacccacggagtttggtgacagagagtgagcttgcthtgggaatggaggtgtagaaactgttttttgttttcctttttttttttttttttattgggaaaagttgtgcctgagtgcatgagacagaatagagaccagt

SEQ ID NO: 23847 - DNA, 201 bp, Homo sapiens
ccggtgggtgcgtggggactttagaaccgggaccgcggcggcaccgattggcttctctagaaacccgacacctagtgggaatgagaactgtgcccgcttcstgagtatccaggaaaaaggacccgtcgcaggttgtgagaagaagagaaactgcggaggtggcgaatccccaaggcggggcctccccaatccatacaccgc

SEQ ID NO: 23848 - DNA, 201 bp, Homo sapiens
cttccctgcccagccacctgtcccagagctggagacgcccaggtttaagccagagactttggatactttccttgatggtgacataatttttgtcttcttctctcctggaagagaagccccagaaccatcagagtgatccagtctgcccactcttcttattattctgtctctccaatcactctccctgagctggactctcca

SEQ ID NO: 23849 - DNA, 201 bp, Homo sapiens
ccctgcgcggctccctgggtcctgcgcccccgccgggcgggcccctcgctcctcccgaccatttccctgcagaccctgcactcacgcgcccaggtctgggycagggccagggcccctgagagcagcaggaggagggttcggggcgccatgagcaccatcctcggcgtctggggagaatctgagtcccggtgggtgcgtggg

SEQ ID NO: 23850 - DNA, 201 bp, Homo sapiens
ctcggtaaaactgtgctttggccttggcggtccctgtctcctcttcccaatattccggcccctccggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtgga

SEQ ID NO: 23851 - DNA, 201 bp, Homo sapiens
tggcttagagctccctactgtaaattattgggagttagttcattttggagtttataacttaaagcagaaattcagatggttgaaatgtcattttcatgaasgtttgttattagtgtatcatttagattgttttgcaaaagtctcattttttttctaaagggttgccaatcttgttttaaatttacaaaggttgttaattta

SEQ ID NO: 23852 - DNA, 201 bp, Homo sapiens
acagtgaggtggttgggtcttagtgctgtggggaacttttcttgacctcctgatgactggatggagtgtctgagggaggaagggtcttacaggattgactyatgaccctgagggatgtgctcactccaggtctcaggtctgtcctgacacctttatttgtggcttagagctccctactgtaaattattgggagttagttca

SEQ ID NO: 23853 - DNA, 201 bp, Homo sapiens
tgcccagagcagcacagtccagagtccttgaacaggaattccccctcatctaacagttaatcatttattagtggggacagacatctggttgtctctttccrgtgaccccatatcctcattcaaggcatccagatatagcccctgagccagggatctgtatctgccctccagaggcctatgcccaagacaggttgctccctg

SEQ ID NO: 23854 - DNA, 201 bp, Homo sapiens
agtatgtgggggacccagtgtgactgacacaaacagggacagagcatgatgagctcagtccaggtgcactccaggccgacgatggtgctgagcctgtgggrgatgcgggaggaggagcaggggtggctttcacctgggctctgtccatggaggtgaggacagtgaggtggttgggtcttagtgctgtggggaacttttctt

SEQ ID NO: 23855 - DNA, 201 bp, Homo sapiens
actgccacaatgatccagtggggagagaggaaaaaggttgacgataaagataaaaatggtattaattgatgaactgacacctttaagtagatgataagggrtggcaattggggcaccagaagagggtctggctctggctgggagcagaagggttaacccacaacagtccctcacatggtaaaacgcctgacatgtggtgca

SEQ ID NO: 23856 - DNA, 201 bp, Homo sapiens
cggcccgtccgtgggggatgagaggtcgtgacctgcgccccgggccggggtcactcaccggcctcgctctggttgtagtagccgcgcagggtccccaggtycgctcggtcagtctgtgactgggccttcacattccgtgtctgcaggtcccaatactccggcccctcctgctctatccacggtgcccgcggctccatcctc

SEQ ID NO: 23857 - DNA, 201 bp, Homo sapiens
tgggacaggagaccaccagggcagtgcacagctgagatctcagtctctggtgtcagctcctgggttcgctggctccactgagggcaactagactctgcagycaggcgatctggattcaactccttgcctaggcctcaccagcatgttctctctttgtgcctcattttcctcatctatgacatggggaaactacgagcattt

SEQ ID NO: 23858 - DNA, 201 bp, Homo sapiens
ccatgggacatttaagcagggaccttaatggtgtgaggagtgagccatgtggatcactgggcagcacatgcatgtgggagtcacagcaggggcaggtggtrgagacagggtggagtagacaagaaactggtgtgagtggagaagaatgagctaggctgagagtaatgggatgaggccaaagtggccagaggggaccctgtg

SEQ ID NO: 23859 - DNA, 201 bp, Homo sapiens
gcgacccggcccgtccgtgggggatgagaggtcgtgacctgcgccccgggccggggtcactcaccggcctcgctctggttgtagtagccgcgcagggtccscaggttcgctcggtcagtctgtgactgggccttcacattccgtgtctgcaggtcccaatactccggcccctcctgctctatccacggtgcccgcggctcc

SEQ ID NO: 23860 - DNA, 201 bp, Homo sapiens
aaccttaataaatcaacagacaataaacaaataaaacctgtcatagtatcactgataattgccattaagaaaaatatgcttgggttagaagattggtggcrgtggtgggaatggcaggggatagatttcagaagaggtcactggacaagacatttctgaacacttgaccatgggacatttaagcagggaccttaatggtgt

SEQ ID NO: 23861 - DNA, 201 bp, Homo sapiens
gcagccacagtccaatcacctagtggcccagatagaacagaaaggtagatagaagtaaaatttctctctgtctctgtctctctgtctctctctgtctctgwctctctctctggaactggggctgggacacccttcttctcctgccttggacatcaaaactccaggttcgatgatctttggactctgacttttgcaccagtg

SEQ ID NO: 23862 - DNA, 201 bp, Homo sapiens
ccccgagagcagcaggaagagggttcggggcgccatgaccaccatccttggcgtctggggagaatgagtccgggtgggtgagcgaggactttagaaccagraccgcggcgacgctgattggcttctctaaaaacctgtcacctaatgggagtgagaactggggccgcccggtgagtatccaggaagaaggacccgacacag

SEQ ID NO: 23863 - DNA, 201 bp, Homo sapiens
gcttcggggtggatctcggacccggagactgtgggcgacccggcccgtccgtgggggatgagaggtcgtgacctgcgccccgggccggggtcactcaccgkcctcgctctggttgtagtagccgcgcagggtccccaggttcgctcggtcagtctgtgactgggccttcacattccgtgtctgcaggtcccaatactccgg

SEQ ID NO: 23864 - DNA, 201 bp, Homo sapiens
cttccttaccctgccccttgtcttgtatgcaataaatatcagcgagcccagctgttcggggccactaccggtctccgcatcttgatggtagtggtcccccsggcccagctgttttctctttatctctttgtcttgtgcttttatttattacaatctctcatctccgcacacggggagaaaacccgctaagccccgtagggc

SEQ ID NO: 23865 - DNA, 201 bp, Homo sapiens
ccattcctccctgttcaagtcagtagtgatcttgaagacagcagcctggttccttagtgtgggctccaatgccagtgggagccgagtggaccatgttctcraagtgttgtggttgtctaccttttcctgttgggtgactccgtgaaggatgataagaaatggcttacattgggctgggcatggtgactcatgcctgtaatc

SEQ ID NO: 23866 - DNA, 201 bp, Homo sapiens
aaaaaaataaattatagactactcaaattgtaagtattaaaccagtgtctgtgagagtttttctggaagggatgtgagtgggtggactggtggggaagatsctctctcactgtgggcagccacagtccaatcacctagtggcccagatagaacagaaaggtagatagaagtaaaatttctctctgtctctgtctctctgtc

SEQ ID NO: 23867 - DNA, 201 bp, Homo sapiens
ggggatgagggcctattacctgggcctggagagaaggacactcctcttctcacgatgtggtctctgggaacatgctctccaaacttctctggtgactaaartaatgtgtagttcaatgggctctcttttgtctacttttaagggtaccctcctttggaaaccaggacctcctaacccgcacagcccattgttgggagataa

SEQ ID NO: 23868 - DNA, 201 bp, Homo sapiens
accgtgcccggccagctgcggctttgttttactacgagtagttatcgcaaaggatgcttgtgatgaactttggcattttcttttctctttcatttccaaahaatcaatcaggaatggcacacaaggtgcattttgaaaaataccactttaaagatttgtgggccaggagtggtggctcatgcctgtaatctcagcaatttg

SEQ ID NO: 23869 - DNA, 201 bp, Homo sapiens
ttccggtcccaatactccggcccctcccgctccatccacggcgcccgcggctccatcctctggctcgcggcgtcgctgtcgaaccgcacgaactgcgtatmgtccacgtagccgacggagatgaagcggggctccccgcggccgggccgggacatggtggtgtagaaatacctcatggagtgggagcctgggagcgaggag

SEQ ID NO: 23870 - DNA, 201 bp, Homo sapiens
gaggggataaaaagtgctctggggtttcctgattatgaagggtaggggtcagtctgcttctaggagatgtggactgaattagtgaaaaataaatgcacagkgaatgaggatgagtaaagcaagcatcagcatctcccgccatcagttcagactgattcggaggtggggaggtgggatagttcctgaccctgttgcaaggtt

SEQ ID NO: 23871 - DNA, 201 bp, Homo sapiens
agtctgtgcctgggccttgcagatctgtgtgttccggtcccaatactccggcccctcccgctccatccacggcgcccgcggctccatcctctggctcgcgkcgtcgctgtcgaaccgcacgaactgcgtatcgtccacgtagccgacggagatgaagcggggctccccgcggccgggccgggacatggtggtgtagaaata

SEQ ID NO: 23872 - DNA, 201 bp, Homo sapiens
cttaatgtcacaaagaggaggcatgaacaaatcttgcatctcagtccctcacaaggcaatcttagaaaaaacatagtcataaactaatccaggtcagtcayagtaagttgtgacactgaacagcccaccacaccttgaaaaattccaaatcaaagaatctccagagcttagttgtgtcccctctgcccaactcctctttca

SEQ ID NO: 23873 - DNA, 201 bp, Homo sapiens
aagtgctaggatcacagaagtgagccaccgtgcccggccagctgcggctttgttttactacgagtagttatcgcaaaggatgcttgtgatgaactttggcrttttcttttctctttcatttccaaataatcaatcaggaatggcacacaaggtgcattttgaaaaataccactttaaagatttgtgggccaggagtggtgg

SEQ ID NO: 23874 - DNA, 201 bp, Homo sapiens
cgcaccaacacgcccagctaatttttgtatttttagtaaagacgaggtttcaccatgttggtcaggctggtctcgaactcctgatctcgtgatccacaggyctcgacttcccaaagtgctaggatcacagaagtgagccaccgtgcccggccagctgcggctttgttttactacgagtagttatcgcaaaggatgcttgtg

SEQ ID NO: 23875 - DNA, 201 bp, Homo sapiens
ctcgttcagtctgtgcctgggccttgcagatctgtgtgttccggtcccaatactccggcccctcccgctccatccacggcgcccgcggctccatcctctgrctcgcggcgtcgctgtcgaaccgcacgaactgcgtatcgtccacgtagccgacggagatgaagcggggctccccgcggccgggccgggacatggtggtgt

SEQ ID NO: 23876 - DNA, 201 bp, Homo sapiens
cagttcttgccataaacattagtgtgcatgtctcctgggcacataggcaagaaagcccgcagagtgtatgattaggagtgggatgattggatgatatgttrtatggcctttaaccatactagataataataatatgatttccaaagtgattgtgccaacttaaacttatttatttatttatttatttatttatttatttat

SEQ ID NO: 23877 - DNA, 201 bp, Homo sapiens
atgggatggtctccatgatacaatggtaagggaaaacagcaaggtacagaaaagcatatatagtttgctaaaatttgtgtgcaaagggagaaagaacatayacatatacatttatatttgcttgcacagtcacaaaatacctttgaaagaataagcactacctgatgagtttggagtgagagatggtcaggatgatttccc

SEQ ID NO: 23878 - DNA, 201 bp, Homo sapiens
atcagccttctgagtagcttggattacagacacgcaccaacacgcccagctaatttttgtatttttagtaaagacgaggtttcaccatgttggtcaggctsgtctcgaactcctgatctcgtgatccacaggcctcgacttcccaaagtgctaggatcacagaagtgagccaccgtgcccggccagctgcggctttgtttt

SEQ ID NO: 23879 - DNA, 201 bp, Homo sapiens
aaaaacatttagttttgtccctggtttctcctaaaaaccttagaatctcttgagtgattagagtgtctttagaatactgaggaaaggactcttggctgagwggatcctggataccttgagaatgggggctggctgccacagacacatacctatgatgagagggttgtcttattccgttttgtgttgctataaagaaatgtc

SEQ ID NO: 23880 - DNA, 201 bp, Homo sapiens
gaggggtcgtgacctgcgccccgggccggggtcactcaccgccctcgctctggttgtagtagcggagcgcgatccgcaggttctctcgttcagtctgtgcytgggccttgcagatctgtgtgttccggtcccaatactccggcccctcccgctccatccacggcgcccgcggctccatcctctggctcgcggcgtcgctgt

SEQ ID NO: 23881 - DNA, 201 bp, Homo sapiens
atggggaggggtcgtgacctgcgccccgggccggggtcactcaccgccctcgctctggttgtagtagcggagcgcgatccgcaggttctctcgttcagtcygtgcctgggccttgcagatctgtgtgttccggtcccaatactccggcccctcccgctccatccacggcgcccgcggctccatcctctggctcgcggcgtc

SEQ ID NO: 23882 - DNA, 201 bp, Homo sapiens
cagtagtcgggggaaattctctcaatcccaccctgcattaccctcacctctgcagctttttgcctatttccaactctcagctccttccacccccaccccarcccagccctcagggctccctctctccagccctccctctgcccagagcagcacagtccagagtccttgaacaggaattccccctcatctaacagttaatca

SEQ ID NO: 23883 - DNA, 201 bp, Homo sapiens
gggagatgagggaggaggagcaggggtggctctcacctgggctctgtccgtggaggtgaggacaatgaggtggttgggtctcagtgctgtgtggaactttyttttgacctccttatgagtggatggtctgtctgagatagaacgggtcttagaggatttactcattaccctgagagagggggcgtgttcattccaggtttc

SEQ ID NO: 23884 - DNA, 201 bp, Homo sapiens
tcaaaaataataatgatgacgatgatacatttaaagcaaatgcaatttaatgtgtaataatacatcctctcttgtgaaaatgtgttatttatttactattrcataacaaattatgtaaaacttagcttaaaacaacaaatattcctcatctgccacagtttccaatggtcaggagtccaggagaggtttccctgagtgctt

SEQ ID NO: 23885 - DNA, 201 bp, Homo sapiens
tgatatgttgtttggactttagccagcactgttgtaaaacacagaacctgtaaactaccctgggctgctgcccattcacatcccccaaaaggagactccahcctgagtcttgtgattattattcctttatttagatgtgtggtcttatttctgagttctctgttctgttccattggtctatgtgcctgtttttgtaccagt

SEQ ID NO: 23886 - DNA, 201 bp, Homo sapiens
aaaccaagcatattttactttgaaaaaatctgtttaaggaattaggaatttaagtcaattctttcaactcaatgttttcagaacacatcatcaacatcaartattacacatttattttaaaagttccattttaaaagggaatggatgatatgttgtttggactttagccagcactgttgtaaaacacagaacctgtaaact

SEQ ID NO: 23887 - DNA, 201 bp, Homo sapiens
gtgctctggggtttcctgattatgaagggtaggggtcagtctgcttctaggagatgtggactgaattagtgaaaaataaatgcacagggaatgaggatgartaaagcaagcatcagcatctcccgccatcagttcagactgattcggaggtggggaggtgggatagttcctgaccctgttgcaaggtttcttttgactttc

SEQ ID NO: 23888 - DNA, 201 bp, Homo sapiens
cctatttgtagccaaagccattttcatggcctcgtggtcctctctgtcacatggctccttacaattctgtgtggttttgttccaatgtaagtagttcttgbtaaggatgcttgcaatgaactttggtattcttttctctttcatttttataaaaaccaagcatattttactttgaaaaaatctgtttaaggaattaggaat

SEQ ID NO: 23889 - DNA, 201 bp, Homo sapiens
gacccacatgttcttcctcttgcgaacacagaactgtagagacgactctgatttaaacaacgcaccatgtcctgaaagatggcacgcaaccctcagagtgyttcctccaggctggcacttagttgtgcctgtggaagatcacgggactccaagcaactatgtggttccaagtgcctgtgtgacccagaaagtcatagattg

SEQ ID NO: 23890 - DNA, 201 bp, Homo sapiens
attgcatcacagataattataaactgtaaaacacggaaaaagttcagaaagattttattttatgcaactagtgtgtatatcaattcatcagttcatttgcwcactaccacgcctggcaaaacaacacccatttatctgcttataattccttggtcagaaatctgggcaagatgtggatagaatctctgttctgggcttcca

SEQ ID NO: 23891 - DNA, 201 bp, Homo sapiens
cagccagcttcccccagggctcatgattccagagaaagaaagaaccaaagtagaaacttcagtgagtcttatgttctacacccagaatcacaaactattawgtcagcattactctatcagttagaagtgagtcattaagtccaggccacacgaacagggagggaatgaagctgcacttctggaaaggaggagtatcaaaga

SEQ ID NO: 23892 - DNA, 201 bp, Homo sapiens
tctttcctctgctccttttcctcacctcctgcttctccagcccttccctccatccttctcatccttcaggccctcctctccccttagtccccaccacactstcactcgtgaattgtgacactagcactgtcccatgacctgctacgtaactgttcttttcacagtggtcctgctcctgtgagtcagagtgtcatttctcca

SEQ ID NO: 23893 - DNA, 201 bp, Homo sapiens
tggagggtgtgagaacctggccccaccccctcggtcagccccgcccaccgagcctcgccctcgcccggacccacccgcggggattttggtaaaggcgcctkggggttctcccaggtagagggtctgggcgggtcccgcggcctcggggtggatcccagacccggagactcgggagtacccggggcgtccgtggggcatgga

SEQ ID NO: 23894 - DNA, 201 bp, Homo sapiens
gtcctccttctctggctcaaaagagaaccacatgtaacagaaaccaagggctacaattctcatagaacccagaaaactggactaggggcctagagagtcahgtgcctgccattgttccaccgcttacgtgctgtgtgacctcaggagaagctctctgctctttgaatcatctgtgaatcatggacaaacacctccatgcta

SEQ ID NO: 23895 - DNA, 201 bp, Homo sapiens
aaagtagaaacttcagtgagtcttatgttctacacccagaatcacaaactattatgtcagcattactctatcagttagaagtgagtcattaagtccaggcyacacgaacagggagggaatgaagctgcacttctggaaaggaggagtatcaaagaatttataaacatgttaaaagcaaaattaacattattgtttcagggt

SEQ ID NO: 23896 - DNA, 201 bp, Homo sapiens
aatttttaaacctgattaacataaaaaattaggttttaggcagacccacatgaggtattaaaagacaactgccaaggacaccctgctaggctctgtagatkgatgtattaaaatccataaaacaatgtatttaaacctaagaattctgctgctttcaaattctttcctctgctccttttcctcacctcctgcttctccagc

SEQ ID NO: 23897 - DNA, 201 bp, Homo sapiens
ctgtggttgctccattcatgcacccatcctaccaggcctgggctgacccatggtgaaggctggctaactgccatttgtctgtttggttgttcagtgccacwtcacacttgggtgttttctgtgggtgtcaacatgggattcaagctcaacccaggtggaccattttcacctgttgatgaatgctgttgggcctgtgcaatt

SEQ ID NO: 23898 - DNA, 201 bp, Homo sapiens
gtatattttataggaacacttagtaatttttaaacctgattaacataaaaaattaggttttaggcagacccacatgaggtattaaaagacaactgccaagracaccctgctaggctctgtagatggatgtattaaaatccataaaacaatgtatttaaacctaagaattctgctgctttcaaattctttcctctgctcctt

SEQ ID NO: 23899 - DNA, 201 bp, Homo sapiens
ttacataacattgtgaacatacgaattgtcactgcattgtgcactttaaatggttacggtggtatcctttgtgtttatgtgtattttaccacaatgaaaamgaggctgaggaaggtattccaaaatcttttgtatagtaaactcctgagtttgcttgagaatctgcctatctgtcttttcttctcaggacatcatctccta

SEQ ID NO: 23900 - DNA, 201 bp, Homo sapiens
tcattctggcttaagctcacactcctccaggaagtcagttactgtgaaggtcactaacatgctcagtattgtcatgtctccacctgtctttacttctctgyagctttcctcacactcaacgactcctttttattttgctcaatttctgtggattcacttcacaaattttattataaggtagttctagctagaagaaaaaat

SEQ ID NO: 23901 - DNA, 201 bp, Homo sapiens
cttctaagtgttgtgtatattttataggaacacttagtaatttttaaacctgattaacataaaaaattaggttttaggcagacccacatgaggtattaaargacaactgccaaggacaccctgctaggctctgtagatggatgtattaaaatccataaaacaatgtatttaaacctaagaattctgctgctttcaaattct

SEQ ID NO: 23902 - DNA, 201 bp, Homo sapiens
gggaggctcaggctggcagattgcttgagcccctgagtttgtgaccagcctaggcaacatagagaaaccctgtctctacaaaaaattcaaaagaattagcygggcttggtggcacatgcctgtagtcccagctacttgggtgtctgaggtgggagggttgcttaagcctggaagattcaggctgcagtgagccatgaacaa

SEQ ID NO: 23903 - DNA, 201 bp, Homo sapiens
caagggtctcggggtcccgcggtttcggggaggatctcggacccagagactcgaggcgacccggccctccgtgggggatggggaggggtcgtgacctgcgycccgggccggggtcactcaccgccctcgctctggttgtagtagcggagcgcgatccgcaggttctctcgttcagtctgtgcctgggccttgcagatctgt

SEQ ID NO: 23904 - DNA, 201 bp, Homo sapiens
ttttctattctgtaaaagtttaattcacttgtatgtgtggtaaaatgtgagcaacatatcaaattctcaaattctttgcaagatactattgccttacctahcagattgaacactgtgtatcagaaaatgtagagagttgccaactagccaaggatcaaatgacctatttgtagccaaggctgtttttcatggcatcctggt

SEQ ID NO: 23905 - DNA, 201 bp, Homo sapiens
gcccgtcgggccccacgtcgcagccatacatcacctgcatggtgtgagaacctggccccgcccccgcggtcagcccggtcccccgagccccgccctgcccsgaccaacccgcggggattttggcctaaactgaaaatgaaaccgggtaaaggcgcctgggcctctcccaggtcaagggtctcggggtcccgcggtttcggg

SEQ ID NO: 23906 - DNA, 201 bp, Homo sapiens
aaatctaagccaggacttggggctctggcactttcttctcactgtgcgtcctccttctctggctcaaaagagaaccacatgtaacagaaaccaagggctabaattctcatagaacccagaaaactggactaggggcctagagagtcatgtgcctgccattgttccaccgcttacgtgctgtgtgacctcaggagaagctct

SEQ ID NO: 23907 - DNA, 201 bp, Homo sapiens
gagcgatgtaatccttgccgtcgtaggcgtgctgttcatacccgcggaggaagcgcccgtcgggccccacgtcgcagccatacatcacctgcatggtgtgrgaacctggccccgcccccgcggtcagcccggtcccccgagccccgccctgccccgaccaacccgcggggattttggcctaaactgaaaatgaaaccgggt

SEQ ID NO: 23908 - DNA, 201 bp, Homo sapiens
ttggtgatctgagctgccatgtccgccgcggtccaggagcgcaggtcctcgttcagagcgatgtaatccttgccgtcgtaggcgtgctgttcatacccgcrgaggaagcgcccgtcgggccccacgtcgcagccatacatcacctgcatggtgtgagaacctggccccgcccccgcggtcagcccggtcccccgagccccg

SEQ ID NO: 23909 - DNA, 201 bp, Homo sapiens
gcccgacgggccgcctcccacttgcgcttggtgatctgagctgccatgtccgccgcggtccaggagcgcaggtcctcgttcagagcgatgtaatccttgcygtcgtaggcgtgctgttcatacccgcggaggaagcgcccgtcgggccccacgtcgcagccatacatcacctgcatggtgtgagaacctggccccgccccc

SEQ ID NO: 23910 - DNA, 201 bp, Homo sapiens
ctggtacccgcgcgctgcagcgtctccttcccgttctccaggtatctgcggagccactccacgaactcgccctccaggtaggctctcagctgctccgcccsacgggccgcctcccacttgcgcttggtgatctgagctgccatgtccgccgcggtccaggagcgcaggtcctcgttcagagcgatgtaatccttgccgtcg

SEQ ID NO: 23911 - DNA, 201 bp, Homo sapiens
ttgaacccaggaggtcgacactgcagtgcatggtgatcatgccactgcactccagcctgggtgacagagcgagaccatgtctcaaaaataataatgatgabgatgatacatttaaagcaaatgcaatttaatgtgtaataatacatcctctcttgtgaaaatgtgttatttatttactattgcataacaaattatgtaaaa

SEQ ID NO: 23912 - DNA, 201 bp, Homo sapiens
cctggtacccgcgcgctgcagcgtctccttcccgttctccaggtatctgcggagccactccacgaactcgccctccaggtaggctctcagctgctccgcchgacgggccgcctcccacttgcgcttggtgatctgagctgccatgtccgccgcggtccaggagcgcaggtcctcgttcagagcgatgtaatccttgccgtc

SEQ ID NO: 23913 - DNA, 201 bp, Homo sapiens
tttaatatcttataattaatttacgccaggtatggtggctcacgcctgccatcctagcactgtggaaggcagaggaaggcagatttgttgactccagaagdtcaagatcagcctgggcaaaacccccatctatacaaaaaattagaaaattagccaggcatagtagttcatgatggtagtcccagctactcaggaggctga

SEQ ID NO: 23914 - DNA, 201 bp, Homo sapiens
aggagcgtctctccccggccgccccgtctgagaggtgaggagcccctccgcccagcagccaccccgtctgggaagtgaggagtgtctctgcccggcagccrccccgtccaggagggaggtggggggcagcccccgcccggccagccacctcgtccaggaggtggggggcgcctctgcccggccaccccgtctgggaagtga

SEQ ID NO: 23915 - DNA, 201 bp, Homo sapiens
ggagcgcctctgccccgccgccctgtctgggatgtgaggagcccctccgcccagcagccaccccgtctgggaggtaaggagcgtctctccccggccgcccygtctgagaggtgaggagcccctccgcccagcagccaccccgtctgggaagtgaggagtgtctctgcccggcagccgccccgtccaggagggaggtggggg

SEQ ID NO: 23916 - DNA, 201 bp, Homo sapiens
tctataccctgcaggtctggtccccacaagctctgcgtcctaaatttggtcctccccatcccacagttgggtcactgtgatttccacatggtagaagcccrggacccagcacctcagggcggcctcatggtccgagatggggtagtggatcacacatgtattctgggattctgaagggaagagtaagaaaattgaggcact

SEQ ID NO: 23917 - DNA, 201 bp, Homo sapiens
ccccatgattcgatcacctcccatgaagtccctccgccaatatgtggggattagaattcgcatgacaattcaaaatgagatttgggtgggaacacagagabaggccatatcagaagtgcatcattaagtccaagccacacttaagagagggaattaagctgcacctctgaaagagagctgtactaaaggacttacgtatat

SEQ ID NO: 23918 - DNA, 201 bp, Homo sapiens
caaaaaaaagaaagacatagtgtagttcttgatatttcttcatgggatggtctccatgatacaatggtaagggaaaacagcaaggtacagaaaagcatatrtagtttgctaaaatttgtgtgcaaagggagaaagaacatatacatatacatttatatttgcttgcacagtcacaaaatacctttgaaagaataagcacta

SEQ ID NO: 23919 - DNA, 201 bp, Homo sapiens
taaaaaatgcatgcctatacaatggattgccaagaaatttttgaacaaaaaaaagaaagacatagtgtagttcttgatatttcttcatgggatggtctccrtgatacaatggtaagggaaaacagcaaggtacagaaaagcatatatagtttgctaaaatttgtgtgcaaagggagaaagaacatatacatatacatttat

SEQ ID NO: 23920 - DNA, 201 bp, Homo sapiens
ggtaaaaaatgtgactttggccccttgatgtataaatgtgtccaaaagccttacaacaggactcacaaagctactaagttgcattttcccagacaatgtayctgtgactcctgcttgtagtattttaaatttaccatcattccatagctctgagtttctgtgtgagtccaggacatctcctcaatacaaagtagcgactgt

SEQ ID NO: 23921 - DNA, 201 bp, Homo sapiens
tgatcaggaatctaataggtaaaaaatgtgactttggccccttgatgtataaatgtgtccaaaagccttacaacaggactcacaaagctactaagttgcaytttcccagacaatgtatctgtgactcctgcttgtagtattttaaatttaccatcattccatagctctgagtttctgtgtgagtccaggacatctcctcaa

SEQ ID NO: 23922 - DNA, 201 bp, Homo sapiens
gaatgatcaggaatctaataggtaaaaaatgtgactttggccccttgatgtataaatgtgtccaaaagccttacaacaggactcacaaagctactaagttkcattttcccagacaatgtatctgtgactcctgcttgtagtattttaaatttaccatcattccatagctctgagtttctgtgtgagtccaggacatctcct

SEQ ID NO: 23923 - DNA, 201 bp, Homo sapiens
attagatgtggtagaagtgatttggactccagtatgattctgaaaaacactgttattttgtgcttctaatgttgctttaaaagcagctctttcgtgtttthcattcttattgctatttcatcactagttattcatttatgtcttttcatttaatttattttgctcaacaatgctttttttctattctgtaaaagtttaatt

SEQ ID NO: 23924 - DNA, 201 bp, Homo sapiens
aagaaaaatcatcccatggagtttggtgccagagagtaagcttgctctgggaatggaggtgtagatttttgttgttgttgtttttgtttttaatcgggaaragttgcgcctgagtgcatgagacagaatagagaccaatttgctctttgtttattaactacagtgggtagcagaatcttggtaacccctgaatgatcagga

SEQ ID NO: 23925 - DNA, 201 bp, Homo sapiens
tggtaggtggaaatggttaaattcaatctaggaacaagatttttcagtaactggctattcagtgggcatcctgtgatcagtttaacatctttcactgtggbttttaattagatgtggtagaagtgatttggactccagtatgattctgaaaaacactgttattttgtgcttctaatgttgctttaaaagcagctctttcgt

SEQ ID NO: 23926 - DNA, 201 bp, Homo sapiens
ctgtccctgaactggactccctgactcccactccttacctgtccacctggactcttctagaagaaaaatcatcccatggagtttggtgccagagagtaagmttgctctgggaatggaggtgtagatttttgttgttgttgtttttgtttttaatcgggaagagttgcgcctgagtgcatgagacagaatagagaccaattt

SEQ ID NO: 23927 - DNA, 201 bp, Homo sapiens
ctctcctttcacttttcatcccgtaatctctgtccctgaactggactccctgactcccactccttacctgtccacctggactcttctagaagaaaaatcaycccatggagtttggtgccagagagtaagcttgctctgggaatggaggtgtagatttttgttgttgttgtttttgtttttaatcgggaagagttgcgcctg

SEQ ID NO: 23928 - DNA, 201 bp, Homo sapiens
tgtagaaagaagcagacataggagactccattttgttctgtactaagaaaaattcttctgccttgggatgctgttaatctataaccttacccgcaaccccstgctctctgaaacatgtgctgtgtccactcagggttaaatggattaagggcggtgcaagatgtgctttgttaaacagatgcttgaaggcaaaaaaaaaaa

SEQ ID NO: 23929 - DNA, 201 bp, Homo sapiens
aggcttcccctccaaagaaccactgctatcatattattgaaacttcctggactgcagtgtgaatggtcatccctggagctatcttctgcagtgatgctgayttccattcttttgttttctatgtatatatttttatatatgctttcattgtagaaagttgcattcataagttttggggttttttttaagatggagtctcac

SEQ ID NO: 23930 - DNA, 201 bp, Homo sapiens
gcgctctgtctcaatgtctccctgagtcttggcccaagagctgtctgagaaacaagggagaaaccctcggcatgggccccgtccctctcctttcacttttyatcccgtaatctctgtccctgaactggactccctgactcccactccttacctgtccacctggactcttctagaagaaaaatcatcccatggagtttggtg

SEQ ID NO: 23931 - DNA, 201 bp, Homo sapiens
ttattttacttcaaatgttttattttgaatgttaaaaatacatgtttctacattagaaatatgaaaatgtatttgattacagaagaatttaaaatgcacayatcaacacctggttgaattttaaagaaaaaaaaatgcagagaagaaagaaatatcacccaggcttcccctccaaagaaccactgctatcatattattgaa

SEQ ID NO: 23932 - DNA, 201 bp, Homo sapiens
gagcaacacagacaggtctggaaagggatggggggacatctgaagcaaatgttcagggcctgaagctgtgagagtacacctgccctacagagttggagccytcatgtgatgatgcagagctgaagtgttatattctggaggggataaaaagtgctctggggtttcctgattatgaagggtaggggtcagtctgcttctagg

SEQ ID NO: 23933 - DNA, 201 bp, Homo sapiens
cgccctgtggcccctggtacccgcgcgctgcagcgtctccttcccgttctccaggtatctgcggagccactccacgaactcgccctccaggtaggctctcmgctgctccgcccgacgggccgcctcccacttgcgcttggtgatctgagctgccatgtccgccgcggtccaggagcgcaggtcctcgttcagagcgatgta

SEQ ID NO: 23934 - DNA, 201 bp, Homo sapiens
gaacttctttttattattattattttaaatatgaggtctcactatgttctccaggctggagagcagtgactattcacaggtgtgaccatagcctcaaattygtgagctcgagccattctcctatctcagcctcctgagtagctgggactacaggtgcccaccacagtgttcagccacttttcattgttattttacttcaaa

SEQ ID NO: 23935 - DNA, 201 bp, Homo sapiens
ggactccccaatccatacaccgccttcggggcctgagaccctgagagccacgcctggggccctgggacttcgccctgacccctctgcttctgtgccaagckctctgtctcaatgtctccctgagtcttggcccaagagctgtctgagaaacaagggagaaaccctcggcatgggccccgtccctctcctttcacttttcat

SEQ ID NO: 23936 - DNA, 201 bp, Homo sapiens
gggaggcgccctgtggcccctggtacccgcgcgctgcagcgtctccttcccgttctccaggtatctgcggagccactccacgaactcgccctccaggtagrctctcagctgctccgcccgacgggccgcctcccacttgcgcttggtgatctgagctgccatgtccgccgcggtccaggagcgcaggtcctcgttcagagc

SEQ ID NO: 23937 - DNA, 201 bp, Homo sapiens
tccccaaggctgggactccccaatccatacaccgccttcggggcctgagaccctgagagccacgcctggggccctgggacttcgccctgacccctctgctyctgtgccaagcgctctgtctcaatgtctccctgagtcttggcccaagagctgtctgagaaacaagggagaaaccctcggcatgggccccgtccctctcct

SEQ ID NO: 23938 - DNA, 201 bp, Homo sapiens
ctgcctcccagctgcctgccttggcctcccaaagtgccaagatcgcagcctctgcccggccgccatccggtctaggaagtgaggagcgtctctgcccggcygcccatcatctgagatgtggggagcgcctctgccccgccgccctgtctgggatgtgaggagcccctccgcccagcagccaccccgtctgggaggtaagga

SEQ ID NO: 23939 - DNA, 201 bp, Homo sapiens
aggattcttctccctcaggaccagagggagggcgatattatagtgttggtcccatttgtctccctttcttgtgggaggccagccccggagatctacaggcsatccgggaggcgccctgtggcccctggtacccgcgcgctgcagcgtctccttcccgttctccaggtatctgcggagccactccacgaactcgccctccag

SEQ ID NO: 23940 - DNA, 201 bp, Homo sapiens
cattattgtcacctgacacaaatgtgatggtcaagccctgtgccacctggaaggggatagagggtaggataggactagaagacccaaagagggaagactcycagagggaaggatgaggatgtaaagtgtgaaaagatacagaaagtaaggaggtgggagagtgggtgtccctctgggtgtggggcttaactgctgcaggta

SEQ ID NO: 23941 - DNA, 201 bp, Homo sapiens
tcacaatcaaggtgataaatttgtccttcaatttcacaggtgctttacaaaagagtgagagttgacagggcatctgaacagggtaaatgtgtgtggagatrgtgtctcacaactaggcaggaaatgagccaacttccatctggagcttgaaatccacgaatggaagaagaaatcttggaactcacccctttcctacctggg

SEQ ID NO: 23942 - DNA, 201 bp, Homo sapiens
gcaagaataactccactaggtagcatcctctcttttacctgatggatcaggacgatgctgttacgacgatacatacaattcttctgaaggggagaggatgytggaataaagactacacttcacctcaaatttattttttcatatgttatgccatagtaccaggaatagggatgtaaataaaagtgccagaaacaggaatta

SEQ ID NO: 23943 - DNA, 201 bp, Homo sapiens
atcgtctgagggcttcactggggctagggattcacgtgaaacatggcttagtcacatggctgttggaaaagcctagttccttgctgtctggtcccaggggrcctcagttcttagccacatggaccttcctgcagggctgcttatggcacagcagctgggtccccaagagctcatgatcccagagacagagagagagaaggt

SEQ ID NO: 23944 - DNA, 201 bp, Homo sapiens
gagtagctgggactagaggttcgcgccaccatgcctggctaatttctgtattttttgtagagaaagggatttatcatgtttcccagacttgtctggaacgyctggggtcaagcaatctgcccaccttggcctcccaagatgctaggattatgggtataggcccccttgcctggctttacttttagactttttataaattgt

SEQ ID NO: 23945 - DNA, 201 bp, Homo sapiens
ttcagcctctacctgccaggcttaagcaattcctcccttctaggcctcttgagtagctgggactagaggttcgcgccaccatgcctggctaatttctgtawtttttgtagagaaagggatttatcatgtttcccagacttgtctggaacgcctggggtcaagcaatctgcccaccttggcctcccaagatgctaggattat

SEQ ID NO: 23946 - DNA, 201 bp, Homo sapiens
aagtctggagtaattccattcattctttagccatatcaggcttctgcaggtacagattgctgagttatatggagataacaggcaatcccaacaccaccccrcatcgttcaggtctgtaatggcagtgccacccctataatacctgcagtaccctccacaagacccaccctggggcacaatattgcttctggtttggcttgg

SEQ ID NO: 23947 - DNA, 201 bp, Homo sapiens
tctcttcagaagtttctaattcggtttaagaatgcccaaaatgccaattttcttactcaagcatctacaaaaatatttgcctaatcagggtgctttgcagytagaaaaatgtgaatctcacacctctgtctatacactagcttagcatcatgacaataatttgtttggctagggtaggcagaaattgtttactccaatcta

SEQ ID NO: 23948 - DNA, 201 bp, Homo sapiens
gacgacactgattggcttctctggaaacccgacacccaatgggagtgagaactgggtccgcgtcgtgagtatccaggaagaaggaccctacataggttggsagagggagaaaagaaactgcggagttggggaatccccaaggctgggactccccaatccatacaccgccttcggggcctgagaccctgagagccacgcctg

SEQ ID NO: 23949 - DNA, 201 bp, Homo sapiens
agggccagggcccccaagagtagcaggaggagggttcggggcgccatgacggccatcctcggcgtctggggagaatctgagtcccggtgggtgcgtgcggrctttagaaccgcgaccgcgacgacactgattggcttctctggaaacccgacacccaatgggagtgagaactgggtccgcgtcgtgagtatccaggaagaa

SEQ ID NO: 23950 - DNA, 201 bp, Homo sapiens
cgcagaggcggtttccccacgaccccgcactcacccgcccaggtctgggtcagggccagggcccccaagagtagcaggaggagggttcggggcgccatgayggccatcctcggcgtctggggagaatctgagtcccggtgggtgcgtgcggactttagaaccgcgaccgcgacgacactgattggcttctctggaaacccg

SEQ ID NO: 23951 - DNA, 201 bp, Homo sapiens
ggatcaaatgacctatttgtagccaaggctgtttttcatggcatcctggtcctctcacatggctccttaaaattggctgtggcttgttttttgtggttgtytgtttgtttgttttgagatggagtatggctctgtcacccaggctggagtgcgatggcaggatctcagctcactgcaacttctgccttccaggttcaagcg

SEQ ID NO: 23952 - DNA, 201 bp, Homo sapiens
tctccccgcagaggcggtttccccacgaccccgcactcacccgcccaggtctgggtcagggccagggcccccaagagtagcaggaggagggttcggggcgscatgacggccatcctcggcgtctggggagaatctgagtcccggtgggtgcgtgcggactttagaaccgcgaccgcgacgacactgattggcttctctgga

SEQ ID NO: 23953 - DNA, 201 bp, Homo sapiens
ctcctggccacaggcacctgggataatctcctattccttggaaagttagtgtctgaggcgttgaataatttagagtctgcagagtgcctgggattgcaggmgcgcaccaccatgcctgactggttttcgtatttttttggtggagacggggtttcactgtgttggccaggctggtctccagctcctaactgggagtgatct

SEQ ID NO: 23954 - DNA, 201 bp, Homo sapiens
ccatatggacttcaaatgagaaatttgttttaggttgagattggaaggagatctgaacttctttttattattattattttaaatatgaggtctcactatgwtctccaggctggagagcagtgactattcacaggtgtgaccatagcctcaaattcgtgagctcgagccattctcctatctcagcctcctgagtagctggga

SEQ ID NO: 23955 - DNA, 201 bp, Homo sapiens
cttctccccgcagaggcggtttccccacgaccccgcactcacccgcccaggtctgggtcagggccagggcccccaagagtagcaggaggagggttcggggmgccatgacggccatcctcggcgtctggggagaatctgagtcccggtgggtgcgtgcggactttagaaccgcgaccgcgacgacactgattggcttctctg

SEQ ID NO: 23956 - DNA, 201 bp, Homo sapiens
atggtaattatatatattataatataatatatatatacataattataatttatatatctataaaagagataatcagtattccataaattgatgatattctyagtgttgacttcattgcccaggtgaacactgtaacagaaggatgagtcatggattgtagaggaacaatattttttttactctctggaggagccatcagta

SEQ ID NO: 23957 - DNA, 201 bp, Homo sapiens
aaaccctaggttctcagggactcagattttcatctgtggaagaaaagaatccatctcactctctcaggtgtgatggtaattatatatattataatataatrtatatatacataattataatttatatatctataaaagagataatcagtattccataaattgatgatattctcagtgttgacttcattgcccaggtgaaca

SEQ ID NO: 23958 - DNA, 201 bp, Homo sapiens
tgtattctgggattctgaagggaagagtaagaaaattgaggcactttgcattcctcatgggacactccagcagcacccatgtgaccatcctgagaatggahaggacatctggggtggggaagggagcacagaacccagacacctcctggccacaggcacctgggataatctcctattccttggaaagttagtgtctgaggc

SEQ ID NO: 23959 - DNA, 201 bp, Homo sapiens
ggcccaaggctgctgccagtgtcaaagggaaccactcatcagtattccagggattgtcttcccttcatttcctcagagatttcatcccttaattgtgtcaragagcacggcggaccctcagagtcactctctggaaacccaggaggattcttctccctcaggaccagagggagggcgatattatagtgttggtcccatttg

SEQ ID NO: 23960 - DNA, 201 bp, Homo sapiens
gggtcctgcgtccccgccgggcgggccccttgcttctccccgcagaggcggtttccccacgaccccgcactcacccgcccaggtctgggtcagggccaggrcccccaagagtagcaggaggagggttcggggcgccatgacggccatcctcggcgtctggggagaatctgagtcccggtgggtgcgtgcggactttagaac

SEQ ID NO: 23961 - DNA, 201 bp, Homo sapiens
agatgcattgacatagcacaaagaaatctcccctcctccctgatatctccccgccagttctcagggaaggacagattcagagcaacacagacaggtctggraagggatggggggacatctgaagcaaatgttcagggcctgaagctgtgagagtacacctgccctacagagttggagccctcatgtgatgatgcagagctg

SEQ ID NO: 23962 - DNA, 201 bp, Homo sapiens
tcccacagttgggtcactgtgatttccacatggtagaagcccgggacccagcacctcagggcggcctcatggtccgagatggggtagtggatcacacatgbattctgggattctgaagggaagagtaagaaaattgaggcactttgcattcctcatgggacactccagcagcacccatgtgaccatcctgagaatggatag

SEQ ID NO: 23963 - DNA, 201 bp, Homo sapiens
gggactcagaagagctggactcagacccccaggcacattgagtgtgaagcagagaacaaggcctgagaggaaaagtcacggggcccaaggctgctgccagygtcaaagggaaccactcatcagtattccagggattgtcttcccttcatttcctcagagatttcatcccttaattgtgtcagagagcacggcggaccctca

SEQ ID NO: 23964 - DNA, 201 bp, Homo sapiens
ctgcgtcctaaatttggtcctccccatcccacagttgggtcactgtgatttccacatggtagaagcccgggacccagcacctcagggcggcctcatggtchgagatggggtagtggatcacacatgtattctgggattctgaagggaagagtaagaaaattgaggcactttgcattcctcatgggacactccagcagcacc

SEQ ID NO: 23965 - DNA, 201 bp, Homo sapiens
aaatgcatcctcttcagccatggacattctccttaccttttaaaactaagttacatgtgtaatgtcttataattaatttaggccaggtgtggtggctcacrcctgtgattctagcaccgtggaaggcagaggaaggcagatttgttgactccagatgttgaagatcagcctgggcaacatggagaaacccccatctctaca

SEQ ID NO: 23966 - DNA, 201 bp, Homo sapiens
tgtgatctccgcagggtagaagcccagggcccagcacctcagggtggcctcatggtcagagatggggtggtgggtcatatgtgtcttgggggggtctgacrggaagagtcagaaaattcaggcattttgcatctgtcatgggacactccaccagcacgcatgtggccatcttgagaatggacaggacgcctggggtgggga

SEQ ID NO: 23967 - DNA, 201 bp, Homo sapiens
aaggttccatcccctgcaggcctggtctccacgagctccgtgtgtgggtctggtcctccccatcccgctgccaggtcagtgtgatctccgcagggtagaarcccagggcccagcacctcagggtggcctcatggtcagagatggggtggtgggtcatatgtgtcttgggggggtctgacgggaagagtcagaaaattcagg

SEQ ID NO: 23968 - DNA, 201 bp, Homo sapiens
gacctatttgtagccaaggctgtttttcatggcatcctggtcctctcacatggctccttaaaattggctgtggcttgttttttgtggttgtttgtttgttygttttgagatggagtatggctctgtcacccaggctggagtgcgatggcaggatctcagctcactgcaacttctgccttccaggttcaagcgattctcctg

SEQ ID NO: 23969 - DNA, 201 bp, Homo sapiens
ttccaggttcaagcgattctcctgcatcagccttctgagtagcttggattacagacacgcaccaacacgcccagctaatttttgtatttttagtaaagacraggtttcaccatgttggtcaggctggtctcgaactcctgatctcgtgatccacaggcctcgacttcccaaagtgctaggatcacagaagtgagccaccgt

SEQ ID NO: 23970 - DNA, 201 bp, Homo sapiens
ctgtctcagtgtttccctgagtcttggcccaggagctgtctgagaaaccaggaagaaaccctcggcatgggccctgtccctctcccttcacttttcatccmggaatctccgtccctgaactggactccctgtccacctggactcttctagaagaaaagtcacccacggagtttggtgacagagagtgagcttgctctggga

SEQ ID NO: 23971 - DNA, 201 bp, Homo sapiens
tgagaactgtgcccgcttcctgagtatccaggaaaaaggacccgtcgcaggttgtgagaagaagagaaactgcggaggtggcgaatccccaaggcggggcmtccccaatccatacaccgccttcggggcctgagaccctgagagccacgcctggggccctgggacttcgccctgaccccgctcctcctgtgccaagcgctc

SEQ ID NO: 23972 - DNA, 201 bp, Homo sapiens
gtcttttcatttaatttattttgctcaacaatgctttttttttttactgtgtaaaagtttaatccacttgtatgtgtggtaaaatgtgagcaacatatcamattctcaaattctttgcaagatacaattgccttgcacatcagattgaacactgtatgccagacaatgtagagagttgccaattagcccagggtcaaatga

SEQ ID NO: 23973 - DNA, 201 bp, Homo sapiens
tagtctccaactcccaacctcaggtgatccatccacctcagccttccaaagtgctgggattacaggcgtgagccactgcacctggccgagtggccactctkgaagctttgtaaggtttatcttcaccttctggagtgcccgtgttttgccaagcactacagtgcactttctacctgctgctcatccagccaggtcaacagg

SEQ ID NO: 23974 - DNA, 201 bp, Homo sapiens
cacagcatcgatgcagctgagaagtaactagccaaagccactgtctttgtaggtttcttccaaccctgtccttattatgcagggcattctatcactgcatstgccatagcactccctaaccaaggcaacttctcagctcagcactggtgagacccccagctgctcagctgcaccttgtgccatggactttctgtgtctgcc

SEQ ID NO: 23975 - DNA, 201 bp, Homo sapiens
ttgaatgtattattatgaaagtagttttccatgtcataaagtctgcataaaatttacacacttctagaagctgcatcccatctcaaacaaggagaagtcascagggttcttttagatccatgtgctttcatcttgtcttttggtaaagaatattttgacaagcatgtttgtacatgaagattcttctatggttgtgatttt

SEQ ID NO: 23976 - DNA, 201 bp, Homo sapiens
ggaggagccaagcttcgggtttggctgcctctgggacatttcatgctagaaaaaccccaacatgtgtagataaatggtatagaggacaccagccacccttygatggagctctgcccagtagtgtcccctcacttccactcagagacaacatgcccatttcactaaattcatgaggacatggccaacataagtaagagaaca

SEQ ID NO: 23977 - DNA, 201 bp, Homo sapiens
ccctcattcatctccttagcccatctcagtgtgaggggctctggcagtgcctcctgctgcacatggcatgtgtatctctacttgtctctagaagacagcaycacagctgcccacttctggaaggttctataccctgcaggtctggtccccacaagctctgcgtcctaaatttggtcctccccatcccacagttgggtcact

SEQ ID NO: 23978 - DNA, 201 bp, Homo sapiens
tgggctgggaagatggccctaagaaaggaggggaacgtgaggggtcctgacccccaggcctcagccctgaccctgctgaaggcctccagaagggctcctghtttccctgagaagagacatggcccctcattcatctccttagcccatctcagtgtgaggggctctggcagtgcctcctgctgcacatggcatgtgtatctc

SEQ ID NO: 23979 - DNA, 201 bp, Homo sapiens
acggtgcccgcggctccatcctctggctcgcggcgtcgctgtcaaaccgcacgaactgcgtgtcgtccacgtagcccacggcgatgaagcggggctccccrcggccgggccgggacacggatgtggtgaaatacctcatggagtgggagcctgggggcgaggagtggctgagacccacccgaccctcctcccggcgcggct

SEQ ID NO: 23980 - DNA, 201 bp, Homo sapiens
tgttgtggagactccattggtgtggctcacatccaggcaggcctgcaggaagctgtttcctaattctcaaggccaacattttcagtgaacccataccaaamccctaggttctcagggactcagattttcatctgtggaagaaaagaatccatctcactctctcaggtgtgatggtaattatatatattataatataatata

SEQ ID NO: 23981 - DNA, 201 bp, Homo sapiens
cttggcccatccatcaactgaatgccgctggacatggaacattacaagtgtgaagcttccagggttctcagttgctcttcctgctgttgtggagactccaytggtgtggctcacatccaggcaggcctgcaggaagctgtttcctaattctcaaggccaacattttcagtgaacccataccaaaaccctaggttctcaggg

SEQ ID NO: 23982 - DNA, 201 bp, Homo sapiens
ggggtggaacaaaaacaaagtctggtcagagcccacaggtgatgtgactaaaggaggaattgtggggtggtgacctcccccatgggctcctgtctacactrttccaaggatctcaggaatcactctcccacccctaccacacttacttgaagcctgagcatagctgactccttttccatatgaggaaagaaaacaaactgt

SEQ ID NO: 23983 - DNA, 201 bp, Homo sapiens
tgtattcttatcttggcccatccatcaactgaatgccgctggacatggaacattacaagtgtgaagcttccagggttctcagttgctcttcctgctgttgyggagactccattggtgtggctcacatccaggcaggcctgcaggaagctgtttcctaattctcaaggccaacattttcagtgaacccataccaaaacccta

SEQ ID NO: 23984 - DNA, 201 bp, Homo sapiens
gtctgcaggtcccaatactccggcccctcctgctctatccacggtgcccgcggctccatcctctggctcgcggcgtcgctgtcaaaccgcacgaactgcgwgtcgtccacgtagcccacggcgatgaagcggggctccccgcggccgggccgggacacggatgtggtgaaatacctcatggagtgggagcctgggggcgag

SEQ ID NO: 23985 - DNA, 201 bp, Homo sapiens
tatactatagatatttagcttttaaatagacatttctggtctgtgttttatttcaagtgtctgggaacggatagagttgaggttcaagggagaatgagagytctgtctagatgcattgacatagcacaaagaaatctcccctcctccctgatatctccccgccagttctcagggaaggacagattcagagcaacacagaca

SEQ ID NO: 23986 - DNA, 201 bp, Homo sapiens
cttcacattccgtgtctgcaggtcccaatactccggcccctcctgctctatccacggtgcccgcggctccatcctctggctcgcggcgtcgctgtcaaacygcacgaactgcgtgtcgtccacgtagcccacggcgatgaagcggggctccccgcggccgggccgggacacggatgtggtgaaatacctcatggagtggga

SEQ ID NO: 23987 - DNA, 201 bp, Homo sapiens
ttgagagacacatcagagccctgggtactgttcctgtttggggtggaacaaaaacaaagtctggtcagagcccacaggtgatgtgactaaaggaggaattktggggtggtgacctcccccatgggctcctgtctacactattccaaggatctcaggaatcactctcccacccctaccacacttacttgaagcctgagcata

SEQ ID NO: 23988 - DNA, 201 bp, Homo sapiens; identical to SEQ ID NO: 4336

SEQ ID NO: 23989 - DNA, 201 bp, Homo sapiens
tcgctctggttgtagtagccgcgcagggtccccaggttcgctcggtcagtctgtgactgggccttcacattccgtgtctgcaggtcccaatactccggccyctcctgctctatccacggtgcccgcggctccatcctctggctcgcggcgtcgctgtcaaaccgcacgaactgcgtgtcgtccacgtagcccacggcgatg

SEQ ID NO: 23990 - DNA, 201 bp, Homo sapiens; identical to SEQ ID NO: 4339

SEQ ID NO: 23991 - DNA, 201 bp, Homo sapiens; identical to SEQ ID NO: 4340

SEQ ID NO: 23992 - DNA, 201 bp, Homo sapiens; identical to SEQ ID NO: 4342

SEQ ID NO: 23993 - DNA, 201 bp, Homo sapiens; identical to SEQ ID NO: 4345

SEQ ID NO: 23994 - DNA, 201 bp, Homo sapiens; identical to SEQ ID NO: 4347

SEQ ID NO: 23995 - DNA, 201 bp, Homo sapiens; identical to SEQ ID NO: 4351

SEQ ID NO: 23996 - DNA, 201 bp, Homo sapiens
cccgccgggccggcccctccctcctccgcgcaggggccgtttccctcctgaccccgcactcacccgcccaggtctcggtcagggtcagggcccccgagagyagcaggaagagggttcggggcgccatgaccaccatccttggcgtctggggagaatgagtccgggtgggtgagcgaggactttagaaccaggaccgcggcg

SEQ ID NO: 23997 - DNA, 201 bp, Homo sapiens
cgggccgggacacggcggcgctgaaatacctcatggagtgggagcctgggggcgaggaggggttgagacccgcccgaccctcctcccggcgcggctgccgrgtcctgcgcccccgccgggccggcccctccctcctccgcgcaggggccgtttccctcctgaccccgcactcacccgcccaggtctcggtcagggtcaggg

SEQ ID NO: 23998 - DNA, 201 bp, Homo sapiens
caggtcgcagccaatcatccactggagggtgtgagaacctggccccaccccctcggtcagccccgcccaccgagcctcgccctcgcccggacccacccgcrgggattttggtaaaggcgccttggggttctcccaggtagagggtctgggcgggtcccgcggcctcggggtggatcccagacccggagactcgggagtacc

SEQ ID NO: 23999 - DNA, 201 bp, Homo sapiens
catcgtaggcatactgttcatacccgcggaggaggcgtccgtcggaccccaggtcgcagccaatcatccactggagggtgtgagaacctggccccaccccytcggtcagccccgcccaccgagcctcgccctcgcccggacccacccgcggggattttggtaaaggcgccttggggttctcccaggtagagggtctgggcg

SEQ ID NO: 24000 - DNA, 201 bp, Homo sapiens
tccgtggaggtgaggacaatgaggtggttgggtctcagtgctgtgtggaactttcttttgacctccttatgagtggatggtctgtctgagatagaacgggycttagaggatttactcattaccctgagagagggggcgtgttcattccaggtttcaggtctgccctgacacctttcttggtggcttagacctccctactgt

SEQ ID NO: 24001 - DNA, 201 bp, Homo sapiens
tcagggcgaggtaatccttgccatcgtaggcatactgttcatacccgcggaggaggcgtccgtcggaccccaggtcgcagccaatcatccactggagggtrtgagaacctggccccaccccctcggtcagccccgcccaccgagcctcgccctcgcccggacccacccgcggggattttggtaaaggcgccttggggttct

SEQ ID NO: 24002 - DNA, 201 bp, Homo sapiens
ttcaaatgttttattttgaatgttaaaaatacatgtttctacattagaaatatgaaaatgtatttgattacagaagaatttaaaatgcacacatcaacacstggttgaattttaaagaaaaaaaaatgcagagaagaaagaaatatcacccaggcttcccctccaaagaaccactgctatcatattattgaaacttcctgg

SEQ ID NO: 24003 - DNA, 201 bp, Homo sapiens
ctggaacagaagatgttaaagagaaacagatatcttaaaatttgccacaggagaaacacagatcctctaagaagcaactggttaaaatgtaactgactatyccctgtcagccacagcagccagaagcaacataatcatcaaagatctgagagaaaaccaatgtcaaactagaaatttgcagctgacaaatctctctttgat

SEQ ID NO: 24004 - DNA, 201 bp, Homo sapiens
attaatttttgttgactgaatgaatgaaatatgaatgtattaaattgcatcacagaaagttataaaatgtaaaacactgaaaaattaagaaatattttatyttatgtaactagtgtgcatatcaattcatccgagtctgttgagcctgtgtatgaattttataagattgcataacaaattatcacaaacattgactttaaa

SEQ ID NO: 24005 - DNA, 201 bp, Homo sapiens
gactacacttcacctcaaatttattttttcatatgttatgccatagtaccaggaatagggatgtaaataaaagtgccagaaacaggaattatccctaagcsaaaaaccataactatatttttacacctttatgtaagaattctcaagtattcatttcatctgaaaagttaggattaacagtaagtagagttatatagcctg

SEQ ID NO: 24006 - DNA, 201 bp, Homo sapiens
cattcagatgccttggcagaaagagaaaacagaggcccttgaagtctcaaagtggagccatgaacaaatcttgcatctcagtccctcacaaggcagtcttrgaaagaaaatagtcgtgaacaaattcaagtcagtcatggtaagtggtgacactgaacagcccaccacacattgaaaaattccaaatcaaagactctctag

SEQ ID NO: 24007 - DNA, 201 bp, Homo sapiens
gccgccatgtccgccgcggtccaagagcgcaggtcctcgttcaaggcgatgtaatccttgccgtcgtaggcgtcctgccggtacccgcggaggaagcgccmgtccgaccccacgtcgcagccatacatcatctggatggtgtgagaacctggccccgaccccacggtcagcccagtcccccgagccccgtccggccccgac

SEQ ID NO: 24008 - DNA, 201 bp, Homo sapiens
aaggatctcaggaatcactctcccacccctaccacacttacttgaagcctgagcatagctgactccttttccatatgaggaaagaaaacaaactgtgagasgccagggaagaggcagggccatgagatcctagaggagtttccagaactgtgactgcagacccaggtcaggatcagaaaacccgagggaagaggatgtgtt

SEQ ID NO: 24009 - DNA, 201 bp, Homo sapiens
gaaaaattccaaatcaaagactctctagagcctagttgtgtcccatctgccccaactcctccttcacttcaggccctctaaggtgtcacttttacaagacdtgagagacacatcagagccctgggtactgttcctgtttggggtggaacaaaaacaaagtctggtcagagcccacaggtgatgtgactaaaggaggaattg

SEQ ID NO: 24010 - DNA, 201 bp, Homo sapiens
cccctaccacacttacttgaagcctgagcatagctgactccttttccatatgaggaaagaaaacaaactgtgagaggccagggaagaggcagggccatgaratcctagaggagtttccagaactgtgactgcagacccaggtcaggatcagaaaacccgagggaagaggatgtgttgaagctgaaccaaatgtccttttga

SEQ ID NO: 24011 - DNA, 201 bp, Homo sapiens
atctgagccgccatgtccgccgcggtccaagagcgcaggtcctcgttcaaggcgatgtaatccttgccgtcgtaggcgtcctgccggtacccgcggaggargcgcccgtccgaccccacgtcgcagccatacatcatctggatggtgtgagaacctggccccgaccccacggtcagcccagtcccccgagccccgtccggc

SEQ ID NO: 24012 - DNA, 201 bp, Homo sapiens
aaaagtaaatgtttactcagattctaattttaagagggaagtaagaagttacagctcagtgcacataaagttgagaaaaagatggagacatctcagcccckcctctctggaacaggaaagatgattggggagggaacacagatcagcgtggggaagagggtcatggtggacatgagggtgggttggtctcccctcctccac

SEQ ID NO: 24013 - DNA, 201 bp, Homo sapiens
ccacttgcgctgggtgatctgagccgccatgtccgccgcggtccaagagcgcaggtcctcgttcaaggcgatgtaatccttgccgtcgtaggcgtcctgcyggtacccgcggaggaagcgcccgtccgaccccacgtcgcagccatacatcatctggatggtgtgagaacctggccccgaccccacggtcagcccagtccc

SEQ ID NO: 24014 - DNA, 201 bp, Homo sapiens
gttttgcttaagtcagcaaagtcctttgctttcctaaaaaggatcctgcttaccagtgagtacagagtttttgtacatttgaggtggagttctcagcagartaattaaagatatctgtagaaacaccacacacattatgtgtagctgactgattcacccctctgccacccccaattgaaggaaggagctgtattcttatct

SEQ ID NO: 24015 - DNA, 201 bp, Homo sapiens
ggacaggttgctggattacgtagagacaatagacagccccaacaccatcccacatccttcagctctgtaatggtgatgtgatccccacaatacttgaagtrtcttacacaagacccaccctgggacacactatgatttttgatttggccaggatgggggcagtgtcagaggtttccctttggctttcagcacaatgaaagt

SEQ ID NO: 24016 - DNA, 201 bp, Homo sapiens
taggctctcaactgctccgccacacgggccgcctcccacttgcgctgggtgatctgagccgccatgtccgccgcggtccaagagcgcaggtcctcgttcarggcgatgtaatccttgccgtcgtaggcgtcctgccggtacccgcggaggaagcgcccgtccgaccccacgtcgcagccatacatcatctggatggtgtga

SEQ ID NO: 24017 - DNA, 201 bp, Homo sapiens
tatccaatcaggataattcatttggagagaaaatgttttgcttaagtcagcaaagtcctttgctttcctaaaaaggatcctgcttaccagtgagtacagastttttgtacatttgaggtggagttctcagcagagtaattaaagatatctgtagaaacaccacacacattatgtgtagctgactgattcacccctctgcca

SEQ ID NO: 24018 - DNA, 201 bp, Homo sapiens; identical to SEQ ID NO: 4270

SEQ ID NO: 24019 - DNA, 201 bp, Homo sapiens
ttggcagaaagagaaaacagaggcccttgaagtctcaaagtggagccatgaacaaatcttgcatctcagtccctcacaaggcagtcttggaaagaaaataktcgtgaacaaattcaagtcagtcatggtaagtggtgacactgaacagcccaccacacattgaaaaattccaaatcaaagactctctagagcctagttgtg

SEQ ID NO: 24020 - DNA, 201 bp, Homo sapiens; identical to SEQ ID NO: 4274

SEQ ID NO: 24021 - DNA, 201 bp, Homo sapiens; identical to SEQ ID NO: 4273

SEQ ID NO: 24022 - DNA, 201 bp, Homo sapiens
tattatttggtcataaaatgaataaagcactggcatatgctaaaacattgctgaatcttgaaaacaagacaagtgaaggaagccagtcacaggaggctacrtaacttatgagcccatttttgtgaaatattcataagaggcaagtcgatagagaaagaagtggatttgtggcgacagggtctgctggcaggtggaaatgga

SEQ ID NO: 24023 - DNA, 201 bp, Homo sapiens
gcattaccccattctactctgtcttcatattttatactatagatatttagcttttaaatagacatttctggtctgtgttttatttcaagtgtctgggaacrgatagagttgaggttcaagggagaatgagagctctgtctagatgcattgacatagcacaaagaaatctcccctcctccctgatatctccccgccagttct

SEQ ID NO: 24024 - DNA, 201 bp, Homo sapiens; identical to SEQ ID NO: 4276

SEQ ID NO: 24025 - DNA, 201 bp, Homo sapiens; identical to SEQ ID NO: 4275

SEQ ID NO: 24026 - DNA, 201 bp, Homo sapiens
ctatttggaggaataataacttcaaatctcctaaatttgatgaaaaatataattttactcatccaacaaacttgatacattttaagcagcaagaattttaraagtccacactgagagacgttataatcaaccagtctacaccaatgacaaacagaccatcttgaaagcaataacagagaaggaacttttcaggtacaatgg

SEQ ID NO: 24027 - DNA, 201 bp, Homo sapiens; identical to SEQ ID NO: 4278

SEQ ID NO: 24028 - DNA, 201 bp, Homo sapiens; identical to SEQ ID NO: 4277

SEQ ID NO: 24029 - DNA, 201 bp, Homo sapiens
actatttacttttttacaaaagcaactttcactatgcagaatgaagaatcggcaagcttaaaggtaagacaattgaaattatccagtttgaggtgcagaartaaaaaaaaattatgaagaaaaatgaacagaacttaagaaaactgtgagacaacaccaagcatatgcattttgggaatcctcaaagaaaggagagagaaa

SEQ ID NO: 24030 - DNA, 201 bp, Homo sapiens; identical to SEQ ID NO: 4280

SEQ ID NO: 24031 - DNA, 201 bp, Homo sapiens; identical to SEQ ID NO: 4279

SEQ ID NO: 24032 - DNA, 201 bp, Homo sapiens
gggcgggatggctggggtggaacgtcatcttgtcctttagtcctggggcattttcactcctcacatggtgggtgctgggcatctggcaggtactgatgttkatggagtcgagggagggtactggccggaactgggaaaaacagggttggggagataattaaggtgaacattattttttctgagtgtaagtcatggcttgaa

SEQ ID NO: 24033 - DNA, 201 bp, Homo sapiens
caactttcctggcacgttgaggtcccctcgccctgtcacactctcctgcattaccccattctactctgtcttcatattttatactatagatatttagcttytaaatagacatttctggtctgtgttttatttcaagtgtctgggaacggatagagttgaggttcaagggagaatgagagctctgtctagatgcattgacat

SEQ ID NO: 24034 - DNA, 201 bp, Homo sapiens
ctctaccatttagtagtcctggcaggggtcctgttgctgcagctccgctaagaattttcctgggtattaaatttccccatttaaatatcagttccagtttygggtcatttctttgctcacacatatgcacataggctattacaggcagccagaccaaatcctgaattctatgctactgagaaatttcttccatcagatacc

SEQ ID NO: 24035 - DNA, 201 bp, Homo sapiens
aatattctttgtgagaaaatgggaaatatgcataagacccttactgcacagagaagcaggatggtagccttgagaaagggcacttgtgtgactcagttatkatttcaaccagcagatctcactcacctacggaaagacagttgtattaattcctgtttgggggtatcatgaataaagctgcaagagtatttgtgcacagga

SEQ ID NO: 24036 - DNA, 201 bp, Homo sapiens
tggctttgttttaacgtgtgtagttattgctaaggatccttgagatgaactttggtattttcttttctctttcatttccaaataatcagtcaggaatggcrcacaaggtgcattttgaaaaatgacactttaaagatttgtgggccgggaatggtggctcatgtctgtaatcccagcactttggaaggccgaagttggtgg

SEQ ID NO: 24037 - DNA, 201 bp, Homo sapiens
ccgagccccgccctcgccaggaccaacctgcggggattttggctgaaaatgaaaccgggtaacggctcctgggcctctcccgggtaaagggtctccaggtbccgctgcctcggcgtggatctcggacccagagactcggggagacccgggcggtccgtgggggatgtagaggggtagtgatctgcgcccccggccggtgtc

SEQ ID NO: 24038 - DNA, 201 bp, Homo sapiens
aggcgcccgtccgaccccacgtcgcagacagacatcctctagatgggtgtgagaccctggccccgcccccgcggccagccccgcccaccgagccccgccchcgccaggaccaacctgcggggattttggctgaaaatgaaaccgggtaacggctcctgggcctctcccgggtaaagggtctccaggttccgctgcctcggc

SEQ ID NO: 24039 - DNA, 201 bp, Homo sapiens
cattatatcccatagtaaccgattgcgacaatggggttttaccatgttagccagactggtcttgaactcctgacctcaggtggtccacccacctcagcctmccaaagtgctgggattacaggcgtgaaccaccacgcctggcttaaacttttgaaataagtgcgtaatacttgatgttgatgatgtgttctgaaaacactg

SEQ ID NO: 24040 - DNA, 201 bp, Homo sapiens
gagccgcagtgtccgctgcggtccaggagcgcaggtcctcgttcagggcgaggtaatccttgccatcgtaggcatactgttcatacccgcggaggaggcgwccgtcggaccccaggtcgcagccaatcatccactggagggtgtgagaacctggccccaccccctcggtcagccccgcccaccgagcctcgccctcgcccg

SEQ ID NO: 24041 - DNA, 201 bp, Homo sapiens
tctggaaacccaggaggattcctctccctcaggaccagagggagggcgatattctagtgttggtcccattttcctcctctccttgtgctaggccaggctgrgaggtctacaggagatcagggaggcgccccactgcccctggtacccgcgcgctgcagcatctccttcccgttctccaggtatctgtggagccactccacg

SEQ ID NO: 24042 - DNA, 201 bp, Homo sapiens
cccacacacattgagtgtaaagcagagagcaaggcctgagaggaaaagtaacggggcccaaggctgctgccagtgtcaaagggaacccctcatcagtattycagggattgtcttcccttcatttcctcagagatttcatcccttaattgtatcagagagcagggcagaccctcagagtcactctcttgtacaggatctgga

SEQ ID NO: 24043 - DNA, 201 bp, Homo sapiens
gggattaccggcatgagccaccgcgcccggcctattttgtcaattttctataaaatccctgctgggattttgatagggattgtgttgaacctatagatctrctgggggagaattgccatcttaacagtattatcgagctttccaactcgcatctctccatttatttagacctttaatttctctgaggaatgtttttttatt

SEQ ID NO: 24044 - DNA, 201 bp, Homo sapiens
gaggctcactagtccaacagagcttggtaccagtgtcatatgccaggagccaaggttacaaggatgcaaagttcccagacctaccagagaaggcaaacccytgcagcatgcagggctagacaggggcaagaaacaaggtcattccgggccagcaggaagagggaaagggaaactacagacgtacctcagagacactgcaga

SEQ ID NO: 24045 - DNA, 201 bp, Homo sapiens
tggctcacacatgcacggtgcatgcacagagctttggttctagttcaggaggtgtgtggggaggaggctcactagtccaacagagcttggtaccagtgtcrtatgccaggagccaaggttacaaggatgcaaagttcccagacctaccagagaaggcaaacccctgcagcatgcagggctagacaggggcaagaaacaagg

SEQ ID NO: 24046 - DNA, 201 bp, Homo sapiens
cttcttgtccccagatgatcaaaaccggggccatccactcccttctgagccacctctgcctggggggcccgtggctgtgtcctccagtcacaacagaacaytccttcagaacactcgcaggaagacaacatcttgtcattggctcacacatgcacggtgcatgcacagagctttggttctagttcaggaggtgtgtgggga

SEQ ID NO: 24047 - DNA, 201 bp, Homo sapiens
gtctcgggcagttttgttttccaaaacatgggtttttatctcaggaccttcttgtccccagatgatcaaaaccggggccatccactcccttctgagccacytctgcctggggggcccgtggctgtgtcctccagtcacaacagaacactccttcagaacactcgcaggaagacaacatcttgtcattggctcacacatgca

SEQ ID NO: 24048 - DNA, 201 bp, Homo sapiens
acccgtgcgctgcagcgtctccttcccgttctccaggtatctgcggagccactccacgcacgtgccctccaggtaggctctcaactgctccgccacacggrccgcctcccacttgcgctgggtgatctgagccgccatgtccgccgcggtccaagagcgcaggtcctcgttcaaggcgatgtaatccttgccgtcgtaggc

SEQ ID NO: 24049 - DNA, 201 bp, Homo sapiens
tggtgatcatgccactgcactccagcctgggtgacagagcaagaccctgtctcaaaaatagtaatatgatgatgataaatttagagcaaatgcaaattaaygtgtaataatacatcctctcttgtgaaaatgtattagttatttactattgtgtaacaaattatgtaaaacttagcagctcaaaacagcaaatattcatca

SEQ ID NO: 24050 - DNA, 201 bp, Homo sapiens
attataattcctgcttggccaggcctggagtaatctcattcattctttagtcctcatcaggcttcctcagggacaggttgctggattatgtagagacaatrgacaaccccaacaccatcccacatccttcagctctctaatggtggtgtgacccccacattactttcagtgtcttcctcaagacacaccctgggacacact

SEQ ID NO: 24051 - DNA, 201 bp, Homo sapiens
ctactcaagaggctgagatcagaggatcccttgagcccaggaggtcgacactgcagtgcatggtgatcatgccactgcactccagcctgggtgacagagcragaccctgtctcaaaaatagtaatatgatgatgataaatttagagcaaatgcaaattaacgtgtaataatacatcctctcttgtgaaaatgtattagtta

SEQ ID NO: 24052 - DNA, 201 bp, Homo sapiens
gtccgctgcggtccaggagcgcaggtcctcgttcagggcgaggtaatccttgccatcgtaggcatactgttcatacccgcggaggaggcgtccgtcggacmccaggtcgcagccaatcatccactggagggtgtgagaacctggccccaccccctcggtcagccccgcccaccgagcctcgccctcgcccggacccacccg

SEQ ID NO: 24053 - DNA, 201 bp, Homo sapiens
ggtacccgtgcgctgcagcgtctccttcccgttctccaggtatctgcggagccactccacgcacgtgccctccaggtaggctctcaactgctccgccacaygggccgcctcccacttgcgctgggtgatctgagccgccatgtccgccgcggtccaagagcgcaggtcctcgttcaaggcgatgtaatccttgccgtcgta

SEQ ID NO: 24054 - DNA, 201 bp, Homo sapiens
gcacatcagattgaacactgtatgccagacaatgtagagagttgccaattagcccagggtcaaatgacctctttctagccaaggctatttttcatgagatyctggtcctctctgtcacatgactctttacaattggctgtggctttgttttaacgtgtgtagttattgctaaggatccttgagatgaactttggtattttc

SEQ ID NO: 24055 - DNA, 201 bp, Homo sapiens
ctggtacccgtgcgctgcagcgtctccttcccgttctccaggtatctgcggagccactccacgcacgtgccctccaggtaggctctcaactgctccgccasacgggccgcctcccacttgcgctgggtgatctgagccgccatgtccgccgcggtccaagagcgcaggtcctcgttcaaggcgatgtaatccttgccgtcg

SEQ ID NO: 24056 - DNA, 201 bp, Homo sapiens
gctactcaagaggctgagatcagaggatcccttgagcccaggaggtcgacactgcagtgcatggtgatcatgccactgcactccagcctgggtgacagagyaagaccctgtctcaaaaatagtaatatgatgatgataaatttagagcaaatgcaaattaacgtgtaataatacatcctctcttgtgaaaatgtattagtt

SEQ ID NO: 24057 - DNA, 201 bp, Homo sapiens
ctgcttccactcatggcagaagacaaaggggagctggtatatgcagagatcacatggtaacagaggaacacagagagtaggaagttgccagggtctttttwacaactagctctcttggaaaataatagagcaacaattcattcattcccgagagagggcagtatctctcgattcataaaagattggtcaccatgacccaaa

SEQ ID NO: 24058 - DNA, 201 bp, Homo sapiens
cctggtacccgtgcgctgcagcgtctccttcccgttctccaggtatctgcggagccactccacgcacgtgccctccaggtaggctctcaactgctccgccdcacgggccgcctcccacttgcgctgggtgatctgagccgccatgtccgccgcggtccaagagcgcaggtcctcgttcaaggcgatgtaatccttgccgtc

SEQ ID NO: 24059 - DNA, 201 bp, Homo sapiens
ctctacaaaaaaattagaaaattagccaggcatgttaattcatgcctatagtcccagctactcaagaggctgagatcagaggatcccttgagcccaggagrtcgacactgcagtgcatggtgatcatgccactgcactccagcctgggtgacagagcaagaccctgtctcaaaaatagtaatatgatgatgataaatttag

SEQ ID NO: 24060 - DNA, 201 bp, Homo sapiens
ttgtctaggtccgggaccctacaccatggcagaagccatcttccctcccagtgtgcagtgatgtcccagatagcgaattggttagccacttttcagtctcrggcagttttgttttccaaaacatgggtttttatctcaggaccttcttgtccccagatgatcaaaaccggggccatccactcccttctgagccacctctgc

SEQ ID NO: 24061 - DNA, 201 bp, Homo sapiens
aaaacatttagtctttgtccctggtttctcctaaaaaccttagactctcttgagtgataagagtgtctttagagtactgatgagaagactcttggctgagwggatcctggatatcttaagaacggtggctagctgccagagacacatacctgtgatgcgagggttatctttttccattttgtgttgctataaagaaatgtc

SEQ ID NO: 24062 - DNA, 201 bp, Homo sapiens
gggaggcgccccgtggcccctggtacccgtgcgctgcagcgtctccttcccgttctccaggtatctgcggagccactccacgcacgtgccctccaggtagrctctcaactgctccgccacacgggccgcctcccacttgcgctgggtgatctgagccgccatgtccgccgcggtccaagagcgcaggtcctcgttcaaggc

SEQ ID NO: 24063 - DNA, 201 bp, Homo sapiens
gtgaatagtaataaaatacatcctcttcagccgtggaaattctcctttccttttaaaactaagttacatgtttaatatcttatagttaatttagaccaggkgtggtggctcacgcctgcaatcctagcactgttgaaggcagaggaaggcagatttgactccagaagttcaagatcagcctgggcaacatggtgaaacccc

SEQ ID NO: 24064 - DNA, 201 bp, Homo sapiens
ggtctttggcctcatttaaaggtgcttcagaagcactgagccataggaaggcctctttgtctaggtccgggaccctacaccatggcagaagccatcttccmtcccagtgtgcagtgatgtcccagatagcgaattggttagccacttttcagtctcgggcagttttgttttccaaaacatgggtttttatctcaggacctt

SEQ ID NO: 24065 - DNA, 201 bp, Homo sapiens
tgtggtcaaagaaaagtgggcaatctgagttatcacaaaaacatttagtctttgtccctggtttctcctaaaaaccttagactctcttgagtgataagagbgtctttagagtactgatgagaagactcttggctgagtggatcctggatatcttaagaacggtggctagctgccagagacacatacctgtgatgcgagggt

SEQ ID NO: 24066 - DNA, 201 bp, Homo sapiens
agaaaacatgattttcaaagtcaccacatgttagtattcaaaataaaaatgaggtatgcaattaaactagacagtaagacccattctcaagaaaaaagagsaattgacagaaactgttcctgagaaaggccattgaacatacttactggacaaacaactttgaattgactgcttaaatatgttcacagagctaaaggaaac

SEQ ID NO: 24067 - DNA, 201 bp, Homo sapiens
caggcgatcagggaggcgccccgtggcccctggtacccgtgcgctgcagcgtctccttcccgttctccaggtatctgcggagccactccacgcacgtgccmtccaggtaggctctcaactgctccgccacacgggccgcctcccacttgcgctgggtgatctgagccgccatgtccgccgcggtccaagagcgcaggtcct

SEQ ID NO: 24068 - DNA, 201 bp, Homo sapiens
gttgggagccatgatagaatcagcccaggaagggctggatcttccttttgtgtttaatttggacacagttggaaattgaagttcaagtaaagtgatcattrtgaatagtaataaaatacatcctcttcagccgtggaaattctcctttccttttaaaactaagttacatgtttaatatcttatagttaatttagaccaggt

SEQ ID NO: 24069 - DNA, 201 bp, Homo sapiens
agtgggaactagtcagctaatcatgaacatgaggtctttggcctcatttaaaggtgcttcagaagcactgagccataggaaggcctctttgtctaggtccrggaccctacaccatggcagaagccatcttccctcccagtgtgcagtgatgtcccagatagcgaattggttagccacttttcagtctcgggcagttttgtt

SEQ ID NO: 24070 - DNA, 201 bp, Homo sapiens
ctaattttgaatgaatggatgagactctgataatatgccaatacctctttactgttacaatcctttttcctgtaaaagatatgtggtcaaagaaaagtggrcaatctgagttatcacaaaaacatttagtctttgtccctggtttctcctaaaaaccttagactctcttgagtgataagagtgtctttagagtactgatga

SEQ ID NO: 24071 - DNA, 201 bp, Homo sapiens
gagacctgtccatgactctgtgtggctggcagcccctgggaggtgcaggtggtgataagaccagggggtgccatggtcatggaccacgcttcatccccttmcctctgaggtgtgtcccgcgggcagataatgtactgaaattctgagccagtggctcaggaatgccaatagtgatactggctgagggtctaagagtagaga

SEQ ID NO: 24072 - DNA, 201 bp, Homo sapiens
gaaggtgaatgaccaggagctggttgttgggagccatgatagaatcagcccaggaagggctggatcttccttttgtgtttaatttggacacagttggaaaytgaagttcaagtaaagtgatcattgtgaatagtaataaaatacatcctcttcagccgtggaaattctcctttccttttaaaactaagttacatgtttaat

SEQ ID NO: 24073 - DNA, 201 bp, Homo sapiens
gggagggcgatattctagtgttggtcccaattgtctcccctccttgtgggaggccagcccgggagatctacaggcgatcagggaggcgccccgtggccccyggtacccgtgcgctgcagcgtctccttcccgttctccaggtatctgcggagccactccacgcacgtgccctccaggtaggctctcaactgctccgccaca

SEQ ID NO: 24074 - DNA, 201 bp, Homo sapiens
acatattcatacaagaggatgataaactggcctaattttgaatgaatggatgagactctgataatatgccaatacctctttactgttacaatcctttttchtgtaaaagatatgtggtcaaagaaaagtgggcaatctgagttatcacaaaaacatttagtctttgtccctggtttctcctaaaaaccttagactctcttg

SEQ ID NO: 24075 - DNA, 201 bp, Homo sapiens
gtatgtcgcacagactcacaaagcacctgagaatgccctgtgttcacacctcttgctaactttcaatatctgcacaagtaggaaatgaaggccaaagcagkattgtaaactgcccagcagagtgttgagggcatgccccaaaacacacagagagcccagataaaaagattgaattttcttttcttatttctttttggctga

SEQ ID NO: 24076 - DNA, 201 bp, Homo sapiens
cactaagttgtgtctgtagagacctgtccatgactctgtgtggctggcagcccctgggaggtgcaggtggtgataagaccagggggtgccatggtcatggmccacgcttcatcccctttcctctgaggtgtgtcccgcgggcagataatgtactgaaattctgagccagtggctcaggaatgccaatagtgatactggctg

SEQ ID NO: 24077 - DNA, 201 bp, Homo sapiens
tgtagagaacagggagggctgcacttaatgcatggtgcccaccagcgttctttcctacacagccccttcattttcaaagcccacagtggaggaaacccctyatgctgaatccctctcacactgtgaatctctatgctcaggaagaacccagtcctttcaaggactctccttattaggacagtccaagcaggataaactcag

SEQ ID NO: 24078 - DNA, 201 bp, Homo sapiens
cttaattgtgtcagagagcagggcggaacctcagagtcactctctggtacaggatctggaaacccaggaggattcctctccctcaggaccagagggagggygatattctagtgttggtcccaattgtctcccctccttgtgggaggccagcccgggagatctacaggcgatcagggaggcgccccgtggcccctggtaccc

SEQ ID NO: 24079 - DNA, 201 bp, Homo sapiens
gagaagatattgtcacttaggtcaattatacgggatgcctaaaagagtgaagctgtatgtccctgagaccatccttgtttttggaacctggtaagattgartgttgtcagcaaagctgagtgatttcattctgggagacatattcatacaagaggatgataaactggcctaattttgaatgaatggatgagactctgataa

SEQ ID NO: 24080 - DNA, 201 bp, Homo sapiens
atcatataaatgaaactgttgcactgtctccataatacccaatttcaaaatatctacaagaacagagaaatatgtaagaacaaaagagagaaagaaagcakaaattttaatttgtaatctttggtatatgtaactcagtactgtcataaaatattaataatgtagctttcaaagaaaaaagtcatgtaaaatacataacat

SEQ ID NO: 24081 - DNA, 201 bp, Homo sapiens
tcatccaagctggcactaagttgtgtctgtagagacctgtccatgactctgtgtggctggcagcccctgggaggtgcaggtggtgataagaccagggggtkccatggtcatggaccacgcttcatcccctttcctctgaggtgtgtcccgcgggcagataatgtactgaaattctgagccagtggctcaggaatgccaata

SEQ ID NO: 24082 - DNA, 201 bp, Homo sapiens
gcagtttctggcagttgtaagactgaggtccctgttcctcactggctgtcactgtagagaacagggagggctgcacttaatgcatggtgcccaccagcgtyctttcctacacagccccttcattttcaaagcccacagtggaggaaacccctcatgctgaatccctctcacactgtgaatctctatgctcaggaagaaccc

SEQ ID NO: 24083 - DNA, 201 bp, Homo sapiens
gtgtgagcaagagaagatattgtcacttaggtcaattatacgggatgcctaaaagagtgaagctgtatgtccctgagaccatccttgtttttggaacctgwtaagattgagtgttgtcagcaaagctgagtgatttcattctgggagacatattcatacaagaggatgataaactggcctaattttgaatgaatggatgag

SEQ ID NO: 24084 - DNA, 201 bp, Homo sapiens
gccctccttgtgtgatagcagccctgcctcctcctcttctcacctgcttgtatctggacacatactattcaaacatccctgggggcagccataatgtgtarttccatggactctcatttaaatgtctccttgccagggtgccccctttgggaaaccaggacctcctcccctacagagcccagatattggagatgagaagtg

SEQ ID NO: 24085 - DNA, 201 bp, Homo sapiens
ggcttatacagaggtggcagaatgcagtttctggcagttgtaagactgaggtccctgttcctcactggctgtcactgtagagaacagggagggctgcactyaatgcatggtgcccaccagcgttctttcctacacagccccttcattttcaaagcccacagtggaggaaacccctcatgctgaatccctctcacactgtga

SEQ ID NO: 24086 - DNA, 201 bp, Homo sapiens
gagaacaaggcctgagaggaaaagtcacgggcccaaggctgctgcctgtgtgtgtcaaagggaaccactcatcagtattcgagggatcgtcttcccgtcaytccttcagagattttatcccttaattgtgtcagagagcagggcggaacctcagagtcactctctggtacaggatctggaaacccaggaggattcctctcc

SEQ ID NO: 24087 - DNA, 201 bp, Homo sapiens
tgagggaagacatgctagaatactattgctgcctgcagtctaggccagcccagcagacaaacctaatgtcactcccaaacctggaaacaactgatataaarggacagagggaggaatagtggctgagggtaagtgaataaatcaaagggttatataatgagaaaaattcaatattagcttaactcctcaaaggtggtgtga

SEQ ID NO: 24088 - DNA, 201 bp, Homo sapiens
cttcctagtcacatggaccacaggcctccttatgacacaacagccagcttcccccagggctcatgattccagagaaagaaagaaccaaagtagaaacttcrgtgagtcttatgttctacacccagaatcacaaactattatgtcagcattactctatcagttagaagtgagtcattaagtccaggccacacgaacagggag

SEQ ID NO: 24089 - DNA, 201 bp, Homo sapiens
tctcctgccctccttgtgtgatagcagccctgcctcctcctcttctcacctgcttgtatctggacacatactattcaaacatccctgggggcagccataargtgtatttccatggactctcatttaaatgtctccttgccagggtgccccctttgggaaaccaggacctcctcccctacagagcccagatattggagatga

SEQ ID NO: 24090 - DNA, 201 bp, Homo sapiens
tcaagactagactgagggaagacatgctagaatactattgctgcctgcagtctaggccagcccagcagacaaacctaatgtcactcccaaacctggaaacractgatataaagggacagagggaggaatagtggctgagggtaagtgaataaatcaaagggttatataatgagaaaaattcaatattagcttaactcctca

SEQ ID NO: 24091 - DNA, 201 bp, Homo sapiens
aaggggaaccataaggtctccaagtggatctcttatttccacacacacatctcctgccctccttgtgtgatagcagccctgcctcctcctcttctcacctkcttgtatctggacacatactattcaaacatccctgggggcagccataatgtgtatttccatggactctcatttaaatgtctccttgccagggtgccccct

SEQ ID NO: 24092 - DNA, 201 bp, Homo sapiens
actggctgggaacagcccatgggaagcagggctttgcaccaatcctgctgaggatgtcagagcacaggagcacagccttgggacattacctatgagtatcrctcaatccttccttcctgagggttctgggctcttgaatatgaaaccctctcaggctgggttgctggatgattctgctcacacttacaacaggacaagggg

SEQ ID NO: 24093 - DNA, 201 bp, Homo sapiens
tgaccagtcactggctgggaacagcccatgggaagcagggctttgcaccaatcctgctgaggatgtcagagcacaggagcacagccttgggacattacctrtgagtatcgctcaatccttccttcctgagggttctgggctcttgaatatgaaaccctctcaggctgggttgctggatgattctgctcacacttacaacag

SEQ ID NO: 24094 - DNA, 201 bp, Homo sapiens
caggcaatctaaggagagttgagcaaggccgtggaggagccttccagctacagttggccatcagaggagtcccgtgtctcccaggaatggcttgccttaahgcctgctgtgaccagtcactggctgggaacagcccatgggaagcagggctttgcaccaatcctgctgaggatgtcagagcacaggagcacagccttggga

SEQ ID NO: 24095 - DNA, 201 bp, Homo sapiens
tgctggacagaaggagagaaagtttgttcgacgcatcctagagcacaggcaatctaaggagagttgagcaaggccgtggaggagccttccagctacagttrgccatcagaggagtcccgtgtctcccaggaatggcttgccttaacgcctgctgtgaccagtcactggctgggaacagcccatgggaagcagggctttgca

SEQ ID NO: 24096 - DNA, 201 bp, Homo sapiens
ccccaagactggccataaacaaaatctctgcagcaccgtaacatgttcataatggccctaatgtccaagctggaaggttgcgggtttacaagaatgagggmaaggaacacctggcctgcccagggcggaaaaccgcttaaaggcattcttaagccacaaacaatagcatgagcgatctgtgtcttaagggtgtgttcctgc

SEQ ID NO: 24097 - DNA, 201 bp, Homo sapiens
agcccaccacacattgaaaaattccaaatcaaagactctctagagcctagttgtgtcccatctgccccaactcctccttcacttcaggccctctaaggtgycacttttacaagacttgagagacacatcagagccctgggtactgttcctgtttggggtggaacaaaaacaaagtctggtcagagcccacaggtgatgtga

SEQ ID NO: 24098 - DNA, 201 bp, Homo sapiens
atgagtcatgcataaccgtagcactaagagacaagagggaaatccctctctcctaaaattttgcaaaagttctgggtttttttttccactgagtgggaacwagtcagctaatcatgaacatgaggtctttggcctcatttaaaggtgcttcagaagcactgagccataggaaggcctctttgtctaggtccgggaccctac

SEQ ID NO: 24099 - DNA, 201 bp, Homo sapiens
agcggggctccccgcggccgggccgggacacggatgtggtgaaatacctcatggagtgggagcctgggggcgaggagtggctgagacccacccgaccctcstcccggcgcggctacccgggtcctgcgtccccgccgggcgggccccttgcttctccccgcagaggcggtttccccacgaccccgcactcacccgcccagg

SEQ ID NO: 24100 - DNA, 201 bp, Homo sapiens
acactgcaattcaagtatgagtcatgcataaccgtagcactaagagacaagagggaaatccctctctcctaaaattttgcaaaagttctgggttttttttyccactgagtgggaactagtcagctaatcatgaacatgaggtctttggcctcatttaaaggtgcttcagaagcactgagccataggaaggcctctttgtct

SEQ ID NO: 24101 - DNA, 201 bp, Homo sapiens
tctcaaagtcctggctgcaagtgttcctcctgtgtcagctcctcaaatgttaggatacaggtgtgcactaccacgcctggccaaataacactcatttgttstttatagtttcttaatcagaaatctgggcatgatgtggatggaatctctgttccggtcttcctaaacctgtgttttcattttgaatcctccttcaggctt

SEQ ID NO: 24102 - DNA, 201 bp, Homo sapiens
gatgagtggaaagatggccagagagtgggaagtgtgaaattgagagtatggaagggctggggttcttgggcatgatgaggcctaggggatgacaggggcaygagattcaggcagagagaggagaaggtcatggaggagaggagttccaggatctgagagtccagggagcaagggcatcttctctgctgtataggtgtctat

SEQ ID NO: 24103 - DNA, 201 bp, Homo sapiens
tgggttgtttaaccttataccatatagttttacatatctataacaacagtagtttgggcctcttgtattctaatagttaagtccttaagctgtgtacacaytgcaattcaagtatgagtcatgcataaccgtagcactaagagacaagagggaaatccctctctcctaaaattttgcaaaagttctgggtttttttttcca

SEQ ID NO: 24104 - DNA, 201 bp, Homo sapiens
tgagggactcagaagtgctggactcagacccccacacacattgagtgtgaagcagagaacaaggcctgagaggaaaagtcacgggcccaaggctgctgcckgtgtgtgtcaaagggaaccactcatcagtattcgagggatcgtcttcccgtcattccttcagagattttatcccttaattgtgtcagagagcagggcgga

SEQ ID NO: 24105 - DNA, 201 bp, Homo sapiens
ctagaaatttgcagctgacaaatctctctttgatgaataaaggtaaaacaaaacattatcatataaatgaaactgttgcactgtctccataatacccaatytcaaaatatctacaagaacagagaaatatgtaagaacaaaagagagaaagaaagcataaattttaatttgtaatctttggtatatgtaactcagtactgt

SEQ ID NO: 24106 - DNA, 201 bp, Homo sapiens
cctggttcattgtagggactaaattattttttcttggctgaatgaatgaattatgagtgtattaaattgcatcacagaaaattataaaatgtaaaacactraaaaagttaaaaaagattttattttatgtaactagtgtgcgtatcaattcatcagttcattccaggagtcttttgagtctgtgtatgaattttataagac

SEQ ID NO: 24107 - DNA, 201 bp, Homo sapiens
tttgttttttttctaaagggctgctaatcttgttttaaatttgcaatgtagttaatttatcttcactgttaattagttgtgggttgtttaaccttataccrtatagttttacatatctataacaacagtagtttgggcctcttgtattctaatagttaagtccttaagctgtgtacacactgcaattcaagtatgagtcat

SEQ ID NO: 24108 - DNA, 201 bp, Homo sapiens
aagatctgagagaaaaccaatgtcaaactagaaatttgcagctgacaaatctctctttgatgaataaaggtaaaacaaaacattatcatataaatgaaacygttgcactgtctccataatacccaatttcaaaatatctacaagaacagagaaatatgtaagaacaaaagagagaaagaaagcataaattttaatttgtaa

SEQ ID NO: 24109 - DNA, 201 bp, Homo sapiens
tccttttcctcacctcctgctcctccagcccttccctccgtccctctcatccctcaggccctcttctccccttaatccccaccaccctctcactcctgaaytgtggctctagcactgttccatgacctgctacatgagtgttctctctatagtggtcctgctactatgagtcagagtgtgtcatttctccacctaaaacac

SEQ ID NO: 24110 - DNA, 201 bp, Homo sapiens
gcctggacacaggcacctgggataatctcctattccgtggaaaattctagtccctgaagagggaacagcgacttctggtcctgacctgagtggaggctgarggactcagaagtgctggactcagacccccacacacattgagtgtgaagcagagaacaaggcctgagaggaaaagtcacgggcccaaggctgctgcctgtg

SEQ ID NO: 24111 - DNA, 201 bp, Homo sapiens
cttcatgaatgtgctcgctgtcaacatgagtggggctgcaagaataactccactaggtagcatcctctcttttacctgatggatcaggacgatgctgttaygacgatacatacaattcttctgaaggggagaggatgctggaataaagactacacttcacctcaaatttattttttcatatgttatgccatagtaccagga

SEQ ID NO: 24112 - DNA, 201 bp, Homo sapiens
cacataagatattaaaggccaactgcaaagaacacccagcgaggctctgtagatggatgtattaaaatctataaaacaatgtgtttaaacctaagagttcygctgctttggaattctttcctctgctccttttcctcacctcctgctcctccagcccttccctccgtccctctcatccctcaggccctcttctccccttaa

SEQ ID NO: 24113 - DNA, 201 bp, Homo sapiens
gcacacatgtggctatcttgagaatggacaggacacctgggatggggaagggagcacagaacccagacaccagcctggacacaggcacctgggataatctyctattccgtggaaaattctagtccctgaagagggaacagcgacttctggtcctgacctgagtggaggctgagggactcagaagtgctggactcagacccc

SEQ ID NO: 24114 - DNA, 201 bp, Homo sapiens
cctgattaacataaaaaacaattagtttctaggcagacccacataagatattaaaggccaactgcaaagaacacccagcgaggctctgtagatggatgtawtaaaatctataaaacaatgtgtttaaacctaagagttctgctgctttggaattctttcctctgctccttttcctcacctcctgctcctccagcccttccc

SEQ ID NO: 24115 - DNA, 201 bp, Homo sapiens
aaactcagatggttgaaatgtcattttcatgaaggatttttattagagtatcatttagattgcctttgcaacctcccatgtgttttgttttttttctaaarggctgctaatcttgttttaaatttgcaatgtagttaatttatcttcactgttaattagttgtgggttgtttaaccttataccatatagttttacatatct

SEQ ID NO: 24116 - DNA, 201 bp, Homo sapiens
aagagtcagatcattcaggcattttgcatctgtcatgggacactcctccagcacacatgtggctatcttgagaatggacaggacacctgggatggggaagrgagcacagaacccagacaccagcctggacacaggcacctgggataatctcctattccgtggaaaattctagtccctgaagagggaacagcgacttctggt

SEQ ID NO: 24117 - DNA, 201 bp, Homo sapiens
tagatgtcaatgcttcaagggctatacaaggaccagaaaagaagaggttgcaccaatttggactgccgagtcacacttctttacacaagaaaacacacttdacagcctcaaacggccaacaatgcagagggacatgtcctcctcaggggaaaatttgatagaaaattgaaatggtcaattgaaacattgtttgtctaaaaa

SEQ ID NO: 24118 - DNA, 201 bp, Homo sapiens
tagcataaccttggtaacccctgaatgatcaggaatctaatcggtaaaaaatgtgactttggcctgttggtatataaatgcatctaaaagcattacaacasgactcacaaagctcttaagtttcactttcccagacagtgtatctgtgactcccgcttgttttattttaaatttaccttcattccgtagccctaagtttcc

SEQ ID NO: 24119 - DNA, 201 bp, Homo sapiens
actgtaaattattgggtgttagtccattttggagttcataacttaaagcagaaactcagatggttgaaatgtcattttcatgaaggatttttattagagtrtcatttagattgcctttgcaacctcccatgtgttttgttttttttctaaagggctgctaatcttgttttaaatttgcaatgtagttaatttatcttcact

SEQ ID NO: 24120 - DNA, 201 bp, Homo sapiens
ggcgtctgtcaggaagagtcagatcattcaggcattttgcatctgtcatgggacactcctccagcacacatgtggctatcttgagaatggacaggacaccygggatggggaagggagcacagaacccagacaccagcctggacacaggcacctgggataatctcctattccgtggaaaattctagtccctgaagagggaac

SEQ ID NO: 24121 - DNA, 201 bp, Homo sapiens
tggatcttgacaggaaaatcactgactctggattgggctatgctcaaccaggggtagatgtcaatgcttcaagggctatacaaggaccagaaaagaagagrttgcaccaatttggactgccgagtcacacttctttacacaagaaaacacactttacagcctcaaacggccaacaatgcagagggacatgtcctcctcagg

SEQ ID NO: 24122 - DNA, 201 bp, Homo sapiens
caagtgtgaccccaagtgctggacagaaggagagaaagtttgttcgacgcatcctagagcacaggcaatctaaggagagttgagcaaggccgtggaggaghcttccagctacagttggccatcagaggagtcccgtgtctcccaggaatggcttgccttaacgcctgctgtgaccagtcactggctgggaacagcccatgg

SEQ ID NO: 24123 - DNA, 201 bp, Homo sapiens
agaccagtttgctttttgtttattaactatagtgggtagcataaccttggtaacccctgaatgatcaggaatctaatcggtaaaaaatgtgactttggccygttggtatataaatgcatctaaaagcattacaacaggactcacaaagctcttaagtttcactttcccagacagtgtatctgtgactcccgcttgttttat

SEQ ID NO: 24124 - DNA, 201 bp, Homo sapiens
gggtagaagctcagggcccagcacctcagggtggcttcatggtcagagacagcgtggtgagtcatatgcgttttgggggcgtctgtcaggaagagtcagawcattcaggcattttgcatctgtcatgggacactcctccagcacacatgtggctatcttgagaatggacaggacacctgggatggggaagggagcacagaa

SEQ ID NO: 24125 - DNA, 201 bp, Homo sapiens
ccaaaggagctgccaatggatcttgacaggaaaatcactgactctggattgggctatgctcaaccaggggtagatgtcaatgcttcaagggctatacaagraccagaaaagaagaggttgcaccaatttggactgccgagtcacacttctttacacaagaaaacacactttacagcctcaaacggccaacaatgcagaggg

SEQ ID NO: 24126 - DNA, 201 bp, Homo sapiens
ttgcctaatcagggtgctttgcagttagaaaaatgtgaatctcacacctctgtctatacactagcttagcatcatgacaataatttgtttggctagggtargcagaaattgtttactccaatctaggaacaagatttttcaataactggctattcagtgggcatcctatgaaagtttaacatctttcactgtgttttttaa

SEQ ID NO: 24127 - DNA, 201 bp, Homo sapiens
tgggagtgagaactggggccgcccggtgagtatccaggaagaaggacccgacacaggttaggagaaggaggagagaatccccaacgcggggcctccccaayccatacaccgcctgtggggcctgagaccctgagagccacgcttgaggccctgggacttcgccctgaccccgctactcttgtgccaagcgttctgtctcag

SEQ ID NO: 24128 - DNA, 201 bp, Homo sapiens
tccagaagacaccactgcagctgcccacttctggaaggttctgtaccctgcaagtctggtctccacaaactctgcatcctgaatttggtcctccccatccsgctcctgggtcagtgtgatctccagagggtagaagcccagggcccagcacctcagcgtggcctcatagttggagatggggtggagggttacctgtgcctt

SEQ ID NO: 24129 - DNA, 201 bp, Homo sapiens
cccgctgccaggtcagtgtgatctccgcagggtagaagctcagggcccagcacctcagggtggcttcatggtcagagacagcgtggtgagtcatatgcgtyttgggggcgtctgtcaggaagagtcagatcattcaggcattttgcatctgtcatgggacactcctccagcacacatgtggctatcttgagaatggacagg

SEQ ID NO: 24130 - DNA, 201 bp, Homo sapiens
ccagaatgatgccagcaaccccaaaggagctgccaatggatcttgacaggaaaatcactgactctggattgggctatgctcaaccaggggtagatgtcaawgcttcaagggctatacaaggaccagaaaagaagaggttgcaccaatttggactgccgagtcacacttctttacacaagaaaacacactttacagcctcaa

SEQ ID NO: 24131 - DNA, 201 bp, Homo sapiens
tactgttataatccttttcgtatgaaaaatatgtggtcaaagaaaagggggtaatatgagttatcacaaaaacatttagttttgtccctggtttctcctawaaaccttagaatctcttgagtgattagagtgtctttagaatactgaggaaaggactcttggctgagtggatcctggataccttgagaatgggggctggct

SEQ ID NO: 24132 - DNA, 201 bp, Homo sapiens
ctctttgataagttgcaacagagttgagaaaatacagtagctaaattaaagtgtcccaagactttggtgccatacaataatgcctttacaatcataactaygtttgtttctcttcagaagtttctaattcggtttaagaatgcccaaaatgccaattttcttactcaagcatctacaaaaatatttgcctaatcagggtgc

SEQ ID NO: 24133 - DNA, 201 bp, Homo sapiens
ccacgagctccgtgtcctgggtctggtcctccccatcccgctgccaggtcagtgtgatctccgcagggtagaagctcagggcccagcacctcagggtggcytcatggtcagagacagcgtggtgagtcatatgcgttttgggggcgtctgtcaggaagagtcagatcattcaggcattttgcatctgtcatgggacactcc

SEQ ID NO: 24134 - DNA, 201 bp, Homo sapiens
taatattctctttgataagttgcaacagagttgagaaaatacagtagctaaattaaagtgtcccaagactttggtgccatacaataatgcctttacaatcrtaactacgtttgtttctcttcagaagtttctaattcggtttaagaatgcccaaaatgccaattttcttactcaagcatctacaaaaatatttgcctaatc

SEQ ID NO: 24135 - DNA, 201 bp, Homo sapiens
tggtctccacgagctccgtgtcctgggtctggtcctccccatcccgctgccaggtcagtgtgatctccgcagggtagaagctcagggcccagcacctcagrgtggcttcatggtcagagacagcgtggtgagtcatatgcgttttgggggcgtctgtcaggaagagtcagatcattcaggcattttgcatctgtcatggga

SEQ ID NO: 24136 - DNA, 201 bp, Homo sapiens
ttgggtcagttttggcaatttctatctctgcacgaattggtcctttttatctaagtggtctaacttattggcttcaggtttttcagagtattcacttatartgttttttaacttcctaagggtcattagtgataatctcttttgttcacaattttggtaatttatcttatttctcataatctcttttttcactgttggtca

SEQ ID NO: 24137 - DNA, 201 bp, Homo sapiens
agttatccatggtcaggaatccaggagaagtttctctgaatgcttctggctcagggcctctcacaacgttgcagtctagttgtcttccagggctgaatcayctgagggctcaaatggggccagggattcacaagacacaagaatctctcacatggcttttggaagaggctttagcttcttattgtctggtcccaggaggac

SEQ ID NO: 24138 - DNA, 201 bp, Homo sapiens
ccaggtctcaccagcactttttctcttgctggctcagctttctcatctatgaaatagggaatgtaacaacatttatttcttgtggttgggtggatgaaaaktgttagtatatatgaggtgtttgcagctgtgccatattatttttgttattttgttatgattttattatattttaatacattaatgtcatgtagttgtatt

SEQ ID NO: 24139 - DNA, 201 bp, Homo sapiens
cagtgttctttccccatgatccctccattttcaaagcccaaagtggaggaagcccctcacgctgaatccctctcacactgtgagtctctattctcaggaaraacccagtccttttcagagcttacctgattaggaccgtctaagcaggataatcctcatcttaaagtcaactgactggggactttaaatatatctgcaaaa

SEQ ID NO: 24140 - DNA, 201 bp, Homo sapiens
ccttcatcagaaatccaggcctaatgtgatagactctttgttcagagtttcgcaaagctgtatcctcatcttaagattggggttctcccccaagcttgtgyagagtttgttggcagaattcggtttctggcaattgtaggattaaggtccctgtttccttcgggctatcagagtagacagtggggagggcttctaattcct

SEQ ID NO: 24141 - DNA, 201 bp, Homo sapiens
tacctcacctcctgcttctccagcccttctctctgtccctgtcatccttcaggccctcctctccccttagtctctactactctgtcactactgaattgtgkccctagctctgtcccttgcctgctgcccatgactgttctccccacaaaggtcagcaatcctgctaatgtgagtcagattgtttcatttcttcacttaaaa

SEQ ID NO: 24142 - DNA, 201 bp, Homo sapiens
ctataaaacactgtatttaagtctgagaattccattgctttagaattctttctctctgttcctttacctcacctcctgcttctccagcccttctctctgtycctgtcatccttcaggccctcctctccccttagtctctactactctgtcactactgaattgtgtccctagctctgtcccttgcctgctgcccatgactgt

SEQ ID NO: 24143 - DNA, 201 bp, Homo sapiens
caggagatcagggaggcgacccgtggcctctggtacctgcgcattgcagcctctccttctcattcttaaggcctttgctgagccactccgcccaccttccsggcaggtaggttttgagcagctctgcatgttcctcctccaaaacatctgagccgccttttccgctgcggtccaagagagcagttcctggtttaggacgag

SEQ ID NO: 24144 - DNA, 201 bp, Homo sapiens
gccactctggaagctttgtaaggtttatcttcaccttctggagtgcccgtgttttgccaagcactacagtgcactttctacctgctgctcatccagccagrtcaacaggaagttgtcaatgatatgagctgatttaatatcctattggatatccagtatgtttagtatagtcttaagactatactatagaggtcaggggag

SEQ ID NO: 24145 - DNA, 201 bp, Homo sapiens
gtgatccatccacctcagccttccaaagtgctgggattacaggcgtgagccactgcacctggccgagtggccactctggaagctttgtaaggtttatcttyaccttctggagtgcccgtgttttgccaagcactacagtgcactttctacctgctgctcatccagccaggtcaacaggaagttgtcaatgatatgagctga

SEQ ID NO: 24146 - DNA, 201 bp, Homo sapiens
gactctggggaagaatccatttccaagctcattcaggttcttgtctgaattcacttccttgcacatagaacagaggtttccacttccttgttaagagccaygcttagctcctagaatcttctttcagctactcacacatggtgcctaaggcacatccaatcctcctgcttggaacgtctgacctcccctcttctatgtctc

SEQ ID NO: 24147 - DNA, 201 bp, Homo sapiens
cagctactcacacatggtgcctaaggcacatccaatcctcctgcttggaacgtctgacctcccctcttctatgtctcctctgccttcctcctctgcagaayctgactccagccagggcaggttctctgcttttagtggctcatttgatttgaatggggccacacagattgtccaggagaatctccctattttaaggtcctt

SEQ ID NO: 24148 - DNA, 201 bp, Homo sapiens
ctccagccagggcaggttctctgcttttagtggctcatttgatttgaatggggccacacagattgtccaggagaatctccctattttaaggtccttaatcrtcattacatgagtaaagtcccttttgccatgtaatgcaacctgttcacaggttccaaggactaagactggacctctttcgggaccattactcagcccacc

SEQ ID NO: 24149 - DNA, 201 bp, Homo sapiens
cagccagggcaggttctctgcttttagtggctcatttgatttgaatggggccacacagattgtccaggagaatctccctattttaaggtccttaatcatcrttacatgagtaaagtcccttttgccatgtaatgcaacctgttcacaggttccaaggactaagactggacctctttcgggaccattactcagcccaccaca

SEQ ID NO: 24150 - DNA, 201 bp, Homo sapiens
taaccaggcagggcacacttctacctggggcttgaaacccccagtgggacaagaaaactcagaccccacttgtcaccccttccttacctgagctcttcttyctccacagcacagcagcgaccgcagctccagtgactacagctgcaaggacaaccaggccagcaacgatacccatgatggggatggtgggcagggaagact

SEQ ID NO: 24151 - DNA, 201 bp, Homo sapiens
ttccaaaacatgggtttttatctcaggaccttcttgtccccagatgatcaaaaccggggccatccactcccttctgagccacctctgcctggggggcccgyggctgtgtcctccagtcacaacagaacactccttcagaacactcgcaggaagacaacatcttgtcattggctcacacatgcacggtgcatgcacagagct

SEQ ID NO: 24152 - DNA, 201 bp, Homo sapiens
ggtctgccctgacacctttcttggtggcttagacctccctactgtaaattattgggtgttagtccattttggagttcataacttaaagcagaaactcagakggttgaaatgtcattttcatgaaggatttttattagagtatcatttagattgcctttgcaacctcccatgtgttttgttttttttctaaagggctgctaa

SEQ ID NO: 24153 - DNA, 201 bp, Homo sapiens
ctggggggcccgtggctgtgtcctccagtcacaacagaacactccttcagaacactcgcaggaagacaacatcttgtcattggctcacacatgcacggtgyatgcacagagctttggttctagttcaggaggtgtgtggggaggaggctcactagtccaacagagcttggtaccagtgtcatatgccaggagccaaggtta

SEQ ID NO: 24154 - DNA, 201 bp, Homo sapiens
tgagagagggggcgtgttcattccaggtttcaggtctgccctgacacctttcttggtggcttagacctccctactgtaaattattgggtgttagtccattytggagttcataacttaaagcagaaactcagatggttgaaatgtcattttcatgaaggatttttattagagtatcatttagattgcctttgcaacctccca

SEQ ID NO: 24155 - DNA, 201 bp, Homo sapiens
tcctcgaccaactgccctcctaaggtctgtccttagccagggaccttcccctgacctgtgattactgggatcaggtccccatcactacaatcatcaaggtrataaatctgtccttcattgtcacaggtgctttacaaaagagaaggtgctggcacacagggcccaggctgggtaggcccatgagtgtggatggtgcttccc

SEQ ID NO: 24156 - DNA, 201 bp, Homo sapiens
tggggggcccgtggctgtgtcctccagtcacaacagaacactccttcagaacactcgcaggaagacaacatcttgtcattggctcacacatgcacggtgcrtgcacagagctttggttctagttcaggaggtgtgtggggaggaggctcactagtccaacagagcttggtaccagtgtcatatgccaggagccaaggttac

SEQ ID NO: 24157 - DNA, 201 bp, Homo sapiens
ggaaggctgtgccagtgctctaaagcaagttctgcctaaagcggcagaaacatttttcacattaggaacaggagttgtttgggatcctgtctggggccagsttgagagcagagcgggagtgggggcctgggtagggccaggcactggagtgaagacaggcctggagagagcctcctgaaggctgctgagcggctcagacag

SEQ ID NO: 24158 - DNA, 201 bp, Homo sapiens
cgggatcaggaaaaacaaggaaagcagatgtgggtcctcgaccaactgccctcctaaggtctgtccttagccagggaccttcccctgacctgtgattactrggatcaggtccccatcactacaatcatcaaggtaataaatctgtccttcattgtcacaggtgctttacaaaagagaaggtgctggcacacagggcccagg

SEQ ID NO: 24159 - DNA, 201 bp, Homo sapiens
ggtctgtctgagatagaacgggtcttagaggatttactcattaccctgagagagggggcgtgttcattccaggtttcaggtctgccctgacacctttcttkgtggcttagacctccctactgtaaattattgggtgttagtccattttggagttcataacttaaagcagaaactcagatggttgaaatgtcattttcatga

SEQ ID NO: 24160 - DNA, 201 bp, Homo sapiens
tccaggagcgcaggtcctcgttcagggcgaggtaatccttgccatcgtaggcatactgttcatacccgcggaggaggcgtccgtcggaccccaggtcgcarccaatcatccactggagggtgtgagaacctggccccaccccctcggtcagccccgcccaccgagcctcgccctcgcccggacccacccgcggggattttg

SEQ ID NO: 24161 - DNA, 201 bp, Homo sapiens
gtgactgcagactcagggcgggatcaggaaaaacaaggaaagcagatgtgggtcctcgaccaactgccctcctaaggtctgtccttagccagggaccttcycctgacctgtgattactgggatcaggtccccatcactacaatcatcaaggtaataaatctgtccttcattgtcacaggtgctttacaaaagagaaggtgc

SEQ ID NO: 24162 - DNA, 201 bp, Homo sapiens
cattaggcataaacttgcatgttaactgaagcttttgtttttattttattcgaagttacaattgcacataattgaaagagtaaatatttgcgcaggacttyctgagaaaaacgagtcttctctgcctttctagggagagtcctctcttctctgtttctgcctttctagggagcaaccactttcaagtttcagctgattctt

SEQ ID NO: 24163 - DNA, 201 bp, Homo sapiens
caggcctggtctccacgagctccgtgtcctgggtctggtcctccccatcccgctgccaggtcagtgtgatctccgcagggtagaagctcagggcccagcayctcagggtggcttcatggtcagagacagcgtggtgagtcatatgcgttttgggggcgtctgtcaggaagagtcagatcattcaggcattttgcatctgtc

SEQ ID NO: 24164 - DNA, 201 bp, Homo sapiens
acaaagttgtcattaggcataaacttgcatgttaactgaagcttttgtttttattttattcgaagttacaattgcacataattgaaagagtaaatatttgygcaggacttcctgagaaaaacgagtcttctctgcctttctagggagagtcctctcttctctgtttctgcctttctagggagcaaccactttcaagtttca

SEQ ID NO: 24165 - DNA, 201 bp, Homo sapiens
ctcggcgcagacaatggtgctgaggctgtgggagatgagggaggaggagcaggggtggctctcacctgggctctgtccgtggaggtgaggacaatgaggtrgttgggtctcagtgctgtgtggaactttcttttgacctccttatgagtggatggtctgtctgagatagaacgggtcttagaggatttactcattaccctg

SEQ ID NO: 24166 - DNA, 201 bp, Homo sapiens
gttccatcccctgcaggcctggtctccacgagctccgtgtcctgggtctggtcctccccatcccgctgccaggtcagtgtgatctccgcagggtagaagcycagggcccagcacctcagggtggcttcatggtcagagacagcgtggtgagtcatatgcgttttgggggcgtctgtcaggaagagtcagatcattcaggca

SEQ ID NO: 24167 - DNA, 201 bp, Homo sapiens
tttcaatttctgacttagttcacagttctcttcaggttttccagttaatttgggtcagttttggcaatttctatctctgcacgaattggtcctttttatcyaagtggtctaacttattggcttcaggtttttcagagtattcacttataatgttttttaacttcctaagggtcattagtgataatctcttttgttcacaat

SEQ ID NO: 24168 - DNA, 201 bp, Homo sapiens
cctcagctccacccaggtaaggcagtggtggcagagagttaggggagcacctatgaaacagaccaaggcagggatgggagcccttggtgcagcaggagtgyatgcaggacttgcctggaagcaagagtattagggaccctagtcaggtcctggtcccctccctgcctaggctcacaggacaaccagtaaagatgctggagt

SEQ ID NO: 24169 - DNA, 201 bp, Homo sapiens
tcaaaatatttgatagaattcaccagtgaagatatctgggctttggcatttctttttgagaaggtttttcaatttctgacttagttcacagttctcttcakgttttccagttaatttgggtcagttttggcaatttctatctctgcacgaattggtcctttttatctaagtggtctaacttattggcttcaggtttttcag

SEQ ID NO: 24170 - DNA, 201 bp, Homo sapiens
cccgcggcctcggggtggatcccagacccggagactcgggagtacccggggcgtccgtggggcatggaggtggggggtcgtgatctgcgccctgggccggrgttactcactggcctcgctctggttgtagtagccgcgcagggtctgcaggttcattctgtcagtctgtgcgtgggccttggtgttccgtgtctcctcttc

SEQ ID NO: 24171 - DNA, 201 bp, Homo sapiens
tgcagagccttgtggggatgtgagtgcagagtatgtgggggacccagtgtcactgacacaaacagggaaaggacatgatgagctgagtcctggtggactcrgcgcagacaatggtgctgaggctgtgggagatgagggaggaggagcaggggtggctctcacctgggctctgtccgtggaggtgaggacaatgaggtggtt

SEQ ID NO: 24172 - DNA, 201 bp, Homo sapiens; identical to SEQ ID NO: 4341

SEQ ID NO: 24173 - DNA, 201 bp, Homo sapiens
aagtcttccctcctctcttcttgtctgaaagagctttcaaaatatttgatagaattcaccagtgaagatatctgggctttggcatttctttttgagaaggyttttcaatttctgacttagttcacagttctcttcaggttttccagttaatttgggtcagttttggcaatttctatctctgcacgaattggtcctttttat

SEQ ID NO: 24174 - DNA, 201 bp, Homo sapiens
gtctgggcgggtcccgcggcctcggggtggatcccagacccggagactcgggagtacccggggcgtccgtggggcatggaggtggggggtcgtgatctgckccctgggccggggttactcactggcctcgctctggttgtagtagccgcgcagggtctgcaggttcattctgtcagtctgtgcgtgggccttggtgttccg

SEQ ID NO: 24175 - DNA, 201 bp, Homo sapiens
gtgcagagccttgtggggatgtgagtgcagagtatgtgggggacccagtgtcactgacacaaacagggaaaggacatgatgagctgagtcctggtggactyggcgcagacaatggtgctgaggctgtgggagatgagggaggaggagcaggggtggctctcacctgggctctgtccgtggaggtgaggacaatgaggtggt

SEQ ID NO: 24176 - DNA, 201 bp, Homo sapiens; identical to SEQ ID NO: 4343

SEQ ID NO: 24177 - DNA, 201 bp, Homo sapiens
tatgagggtaatgccagttctgtaaatgggctggaaagtcttccctcctctcttcttgtctgaaagagctttcaaaatatttgatagaattcaccagtgawgatatctgggctttggcatttctttttgagaaggtttttcaatttctgacttagttcacagttctcttcaggttttccagttaatttgggtcagttttgg

SEQ ID NO: 24178 - DNA, 201 bp, Homo sapiens
ttttggtaaaggcgccttggggttctcccaggtagagggtctgggcgggtcccgcggcctcggggtggatcccagacccggagactcgggagtacccgggscgtccgtggggcatggaggtggggggtcgtgatctgcgccctgggccggggttactcactggcctcgctctggttgtagtagccgcgcagggtctgcagg

SEQ ID NO: 24179 - DNA, 201 bp, Homo sapiens
ggaggttggggagacagaatagtggtgtgcagagccttgtggggatgtgagtgcagagtatgtgggggacccagtgtcactgacacaaacagggaaaggayatgatgagctgagtcctggtggactcggcgcagacaatggtgctgaggctgtgggagatgagggaggaggagcaggggtggctctcacctgggctctgtc

SEQ ID NO: 24180 - DNA, 201 bp, Homo sapiens
tccctccttaccccatctcagggtgaggggcttgggcaaaccctcatgctgcacatggcaggtgtatctctgctcctgtccagaaggcaccaccacagccrcccacttctggaaggttccatcccctgcaggcctggtctccacgagctccgtgtcctgggtctggtcctccccatcccgctgccaggtcagtgtgatctc

SEQ ID NO: 24181 - DNA, 201 bp, Homo sapiens
gttggtcccattttcctccccttcttttggaaggtggctcagggatatctgcaggagatcagggaggcgacccgtggcctctggtacctgcgcattgcagvctctccttctcattcttaaggcctttgctgagccactccgcccaccttcccggcaggtaggttttgagcagctctgcatgttcctcctccaaaacatctg

SEQ ID NO: 24182 - DNA, 201 bp, Homo sapiens
tctccctccttaccccatctcagggtgaggggcttgggcaaaccctcatgctgcacatggcaggtgtatctctgctcctgtccagaaggcaccaccacagmcgcccacttctggaaggttccatcccctgcaggcctggtctccacgagctccgtgtcctgggtctggtcctccccatcccgctgccaggtcagtgtgatc

SEQ ID NO: 24183 - DNA, 201 bp, Homo sapiens
tcttttgagataattatgtcttttattcccttactacagtgcattccattaattgatttctaattgttaatccagccatatattcctgggatgaatcccaytggtcatggaatgtaatccttttttacgtggctttctattgtctgccaatgtttgttaaggatgttttcatttatgtttattggtgacactggtctatgg

SEQ ID NO: 24184 - DNA, 201 bp, Homo sapiens
ctgcctcaggacaagagggagagggatattttagcgttggtcccattttcctccccttcttttggaaggtggctcagggatatctgcaggagatcagggargcgacccgtggcctctggtacctgcgcattgcagcctctccttctcattcttaaggcctttgctgagccactccgcccaccttcccggcaggtaggtttt

SEQ ID NO: 24185 - DNA, 201 bp, Homo sapiens
ccttggaaagttctagtgtctgaggcggaaacagagatttctggtcctgacctgagtggaggccgagggactcagaagagctggaatcagacccccacacrcattgagtatgaggcagagaacaaggcctgagaggaaaattcctggtgcccaaggctgctggggggtcaaaggggaccgcgtatcagtattccagggatt

SEQ ID NO: 24186 - DNA, 201 bp, Homo sapiens
tgacacccccgtctccctccttaccccatctcagggtgaggggcttgggcaaaccctcatgctgcacatggcaggtgtatctctgctcctgtccagaaggyaccaccacagccgcccacttctggaaggttccatcccctgcaggcctggtctccacgagctccgtgtcctgggtctggtcctccccatcccgctgccagg

SEQ ID NO: 24187 - DNA, 201 bp, Homo sapiens
cacctgggataatctcttattccttggaaagttctagtgtctgaggcggaaacagagatttctggtcctgacctgagtggaggccgagggactcagaagasctggaatcagacccccacacacattgagtatgaggcagagaacaaggcctgagaggaaaattcctggtgcccaaggctgctggggggtcaaaggggaccg

SEQ ID NO: 24188 - DNA, 201 bp, Homo sapiens
ttcttggtcagggcggcctcagctccacccaggtaaggcagtggtggcagagagttaggggagcacctatgaaacagaccaaggcagggatgggagccctyggtgcagcaggagtgcatgcaggacttgcctggaagcaagagtattagggaccctagtcaggtcctggtcccctccctgcctaggctcacaggacaacca

SEQ ID NO: 24189 - DNA, 201 bp, Homo sapiens
ttcaggcactttgcattcctcatgagacacagcacccatgtgaccatcctgagaatggatgggacatctggggtggggaagggagcacagaacccagacarcattctggacacaggcacctgggataatctcttattccttggaaagttctagtgtctgaggcggaaacagagatttctggtcctgacctgagtggaggcc

SEQ ID NO: 24190 - DNA, 201 bp, Homo sapiens
gccttcaggggatctgagggcaagaggtagaaaattcaggcactttgcattcctcatgagacacagcacccatgtgaccatcctgagaatggatgggacahctggggtggggaagggagcacagaacccagacaacattctggacacaggcacctgggataatctcttattccttggaaagttctagtgtctgaggcggaa

SEQ ID NO: 24191 - DNA, 201 bp, Homo sapiens
tacctgtgccttcaggggatctgagggcaagaggtagaaaattcaggcactttgcattcctcatgagacacagcacccatgtgaccatcctgagaatggahgggacatctggggtggggaagggagcacagaacccagacaacattctggacacaggcacctgggataatctcttattccttggaaagttctagtgtctga

SEQ ID NO: 24192 - DNA, 201 bp, Homo sapiens
ttggtcctccccatcccgctcctgggtcagtgtgatctccagagggtagaagcccagggcccagcacctcagcgtggcctcatagttggagatggggtggwgggttacctgtgccttcaggggatctgagggcaagaggtagaaaattcaggcactttgcattcctcatgagacacagcacccatgtgaccatcctgagaa

SEQ ID NO: 24193 - DNA, 201 bp, Homo sapiens
gctgcccacttctggaaggttctgtaccctgcaagtctggtctccacaaactctgcatcctgaatttggtcctccccatcccgctcctgggtcagtgtgayctccagagggtagaagcccagggcccagcacctcagcgtggcctcatagttggagatggggtggagggttacctgtgccttcaggggatctgagggcaag

SEQ ID NO: 24194 - DNA, 201 bp, Homo sapiens
ccaggccagcaatgatgcccacaacggggatgatgggctgggaagacagctctaagaaaggaggtgaacgtgaggggccctgacccccaggcctcagcccygaccctgcttaaaggctccagaaggacttctgctttgcctgagaagagacatgacccctcattcgtctccttaccccatcttagtgtgaggggctcaggc

SEQ ID NO: 24195 - DNA, 201 bp, Homo sapiens
ggggcgaggaggggttgagacccgcccgaccctcctcccggcgcggctgccgagtcctgcgcccccgccgggccggcccctccctcctccgcgcaggggcygtttccctcctgaccccgcactcacccgcccaggtctcggtcagggtcagggcccccgagagcagcaggaagagggttcggggcgccatgaccaccatcc

SEQ ID NO: 24196 - DNA, 201 bp, Homo sapiens
tcctccgcgcaggggccgtttccctcctgaccccgcactcacccgcccaggtctcggtcagggtcagggcccccgagagcagcaggaagagggttcggggygccatgaccaccatccttggcgtctggggagaatgagtccgggtgggtgagcgaggactttagaaccaggaccgcggcgacgctgattggcttctctaaa

SEQ ID NO: 24197 - DNA, 201 bp, Homo sapiens
ccttcacttttcatcccggaatccctgtccctgaactggactccctgcctcccactccttgcctgtcctcctgtactcttctagaagaaaaatcaccccasggagcttgttgccagagagtgagctcgccctgggattgtaggtgtaaagacagggttttttttcccccttaaatctggaaaagttgtgcctgagtgcatg

SEQ ID NO: 24198 - DNA, 201 bp, Homo sapiens
gtgtgaaaagatacagaaagtaaggaggtgggagagtgggtgtccctctgggtgtggggcttaactgctgcaggtaggtctcagaatcctcatgcatgtcrtaggtaaaggcaatgctcatctgctccatgtccatggctcagccaaataagttggtagtcaacaaattgatcttatcttttggggtcattctccagcaag

SEQ ID NO: 24199 - DNA, 201 bp, Homo sapiens
ttttttttcccccttaaatctggaaaagttgtgcctgagtgcatgagatagaatagagaccagtttgctttttgtttattaactatagtgggtagcataaycttggtaacccctgaatgatcaggaatctaatcggtaaaaaatgtgactttggcctgttggtatataaatgcatctaaaagcattacaacaggactcaca

SEQ ID NO: 24200 - DNA, 201 bp, Homo sapiens
gggtcattctccagcaagtgcagaacagtaaaaaaatttagtcacctgaggtgcatatcttggcttcctggccagttttcccaaggcctccactgccaccmtgcaccctgggtgccctccacactctccaagtgtccagatgtgtgtgaggagttaagggcaggaagaactattggatcgtggatttaggtgcctttttcc

SEQ ID NO: 24201 - DNA, 201 bp, Homo sapiens
tatagtgggtagcataaccttggtaacccctgaatgatcaggaatctaatcggtaaaaaatgtgactttggcctgttggtatataaatgcatctaaaagcmttacaacaggactcacaaagctcttaagtttcactttcccagacagtgtatctgtgactcccgcttgttttattttaaatttaccttcattccgtagccc

SEQ ID NO: 24202 - DNA, 201 bp, Homo sapiens
gaagacaccactgcagctgcccacttctggaaggttctgtaccctgcaagtctggtctccacaaactctgcatcctgaatttggtcctccccatcccgctyctgggtcagtgtgatctccagagggtagaagcccagggcccagcacctcagcgtggcctcatagttggagatggggtggagggttacctgtgccttcagg

SEQ ID NO: 24203 - DNA, 201 bp, Homo sapiens
taatcggtaaaaaatgtgactttggcctgttggtatataaatgcatctaaaagcattacaacaggactcacaaagctcttaagtttcactttcccagacartgtatctgtgactcccgcttgttttattttaaatttaccttcattccgtagccctaagtttccgtgtgagtccaggacatctcctcaagacaaagtacca

SEQ ID NO: 24204 - DNA, 201 bp, Homo sapiens
ctcccaaacacaagatcccaaggatctcagggatcagcctccttcatacttacttgcagcctgagagtagctccctccttttcaatctgtgggaagaaaaygtcctgtgagaggccagaaaggtggcagggccatgaggtcctagaggaacctcctagtcttggaccctcgagaagtttccagaaatgtgtgactgcagac

SEQ ID NO: 24205 - DNA, 201 bp, Homo sapiens
ggagatggtgcctcacaactaggcaagatatgagcctactcctacctggggcttgaaatccaccaatggaagaaggaaactcagagctcacccctttcctrcctgggatcttattcctccacatcacagcagcgaccacagctacagtgattacagcaactagaagaaccaggccagcaatgatgcccacaacggggatga

SEQ ID NO: 24206 - DNA, 201 bp, Homo sapiens
aaacaattagtttctaggcagacccacataagatattaaaggccaactgcaaagaacacccagcgaggctctgtagatggatgtattaaaatctataaaayaatgtgtttaaacctaagagttctgctgctttggaattctttcctctgctccttttcctcacctcctgctcctccagcccttccctccgtccctctcatc

SEQ ID NO: 24207 - DNA, 201 bp, Homo sapiens
cacaggtgctttacaaaagagtaagtgttgatagacagggcctctgaacagggtaaatgtgtgtggagatggtgcctcacaactaggcaagatatgagccwactcctacctggggcttgaaatccaccaatggaagaaggaaactcagagctcacccctttcctacctgggatcttattcctccacatcacagcagcgacc

SEQ ID NO: 24208 - DNA, 201 bp, Homo sapiens
agccttaatagttattaactgctgtgtcacaaactacctcaaaatttagtggcttaatacaacaaatatctgttaattcaaagagatactacgaacgcgcrcaaaatagattttatgggggtggcagaagttggataaagagatggattttacaggttggaataagtaagagttattggtgtgcacatggcaatgcttttt

SEQ ID NO: 24209 - DNA, 201 bp, Homo sapiens
tatgctgcttagaaatttcttccaccagatacccttatacatcactctcaagttcaaagttctacagatccctagggagggggaacaatgcctccaagttmtttgccaatgcataacaaaagtgacctttcctctaggtcccaataagttcctcatctccatgtgagaccttatcagcctggactctattgtccatatcac

SEQ ID NO: 24210 - DNA, 201 bp, Homo sapiens
cttaagaaagccttaatagttattaactgctgtgtcacaaactacctcaaaatttagtggcttaatacaacaaatatctgttaattcaaagagatactacraacgcgcgcaaaatagattttatgggggtggcagaagttggataaagagatggattttacaggttggaataagtaagagttattggtgtgcacatggcaa

SEQ ID NO: 24211 - DNA, 201 bp, Homo sapiens
ctgatgtctggaaatgtttgagcatttagcgagggcctcaggctgcttccactcatggcagaaggcaaaggggagctggtatgtgcagaagtcacgtggtmagagaggaacagagggagtaggaaggtgcgagactcttttaacaactagctcttttggaaactaatagggcaacaattcattgactcccgagagagggca

SEQ ID NO: 24212 - DNA, 201 bp, Homo sapiens
aggcctgggctgacccatggtgaaggctggctaactgccatttgtctgtttggttgttcagtgccacatcacacttgggtgttttctgtgggtgtcaacawgggattcaagctcaacccaggtggaccattttcacctgttgatgaatgctgttgggcctgtgcaatttatgactttgtgggtcacacagccacttggaac

SEQ ID NO: 24213 - DNA, 201 bp, Homo sapiens
agagggtgtggaggttttgttgatcattgactgagattccagggggtgcactgggaagatttctgtggttcgggaggttggggagacagaatagtggtgtkcagagccttgtggggatgtgagtgcagagtatgtgggggacccagtgtcactgacacaaacagggaaaggacatgatgagctgagtcctggtggactcgg

SEQ ID NO: 24214 - DNA, 201 bp, Homo sapiens
tgtggggtcaaagggaacccctgatcagtcttccagggattgtcttcccctccactccctcagagacttcatcccttaattgtcccagagagcaggacggrccctcagaatcactctctggtacaggatctggaaacccaggaggattcctctccctcaggaccagagggagggcgatattctagtgttggtcccattttc

SEQ ID NO: 24215 - DNA, 201 bp, Homo sapiens
ggagctgggaggtgcaggaacatcctgagagagggtgtggaggttttgttgatcattgactgagattccagggggtgcactgggaagatttctgtggttcrggaggttggggagacagaatagtggtgtgcagagccttgtggggatgtgagtgcagagtatgtgggggacccagtgtcactgacacaaacagggaaagga

SEQ ID NO: 24216 - DNA, 201 bp, Homo sapiens
ctcagaccccacttgtcaccccttccttacctgagctcttctttctccacagcacagcagcgaccgcagctccagtgactacagctgcaaggacaaccagrccagcaacgatacccatgatggggatggtgggcagggaagactgctctgggaaaggaggtgaaggtgagggtctctgacccccagccctcaccaccgacc

SEQ ID NO: 24217 - DNA, 201 bp, Homo sapiens
tggagctgggaggtgcaggaacatcctgagagagggtgtggaggttttgttgatcattgactgagattccagggggtgcactgggaagatttctgtggttygggaggttggggagacagaatagtggtgtgcagagccttgtggggatgtgagtgcagagtatgtgggggacccagtgtcactgacacaaacagggaaagg

SEQ ID NO: 24218 - DNA, 201 bp, Homo sapiens
ctaaaagacatgacacccccgtctccctccttaccccatctcagggtgaggggcttgggcaaaccctcatgctgcacatggcaggtgtatctctgctcctbtccagaaggcaccaccacagccgcccacttctggaaggttccatcccctgcaggcctggtctccacgagctccgtgtcctgggtctggtcctccccatcc

SEQ ID NO: 24219 - DNA, 201 bp, Homo sapiens
tgtgggaggacttcagagggggtcatgtcctcagggagaccaggttgctgctggagctgggaggtgcaggaacatcctgagagagggtgtggaggttttgytgatcattgactgagattccagggggtgcactgggaagatttctgtggttcgggaggttggggagacagaatagtggtgtgcagagccttgtggggatgt

SEQ ID NO: 24220 - DNA, 201 bp, Homo sapiens
ctttccctaaaagacatgacacccccgtctccctccttaccccatctcagggtgaggggcttgggcaaaccctcatgctgcacatggcaggtgtatctctkctcctgtccagaaggcaccaccacagccgcccacttctggaaggttccatcccctgcaggcctggtctccacgagctccgtgtcctgggtctggtcctcc

SEQ ID NO: 24221 - DNA, 201 bp, Homo sapiens
ggcacctacactctgcagccaggcggcctggattgaacgccctgcccaggtctcaccagcactttttctcttgctggctcagctttctcatctatgaaatrgggaatgtaacaacatttatttcttgtggttgggtggatgaaaagtgttagtatatatgaggtgtttgcagctgtgccatattatttttgttattttgtt

SEQ ID NO: 24222 - DNA, 201 bp, Homo sapiens
ttgtcacaggtgctttacaaaagagaaggtgctggcacacagggcccaggctgggtaggcccatgagtgtggatggtgcttcccagtaaccaggcagggcrcacttctacctggggcttgaaacccccagtgggacaagaaaactcagaccccacttgtcaccccttccttacctgagctcttctttctccacagcacagc

SEQ ID NO: 24223 - DNA, 201 bp, Homo sapiens
ccattcctattttgttgaaacttatgaacatgagtgatgttaacatttttgtcaactgtttcttctgcatcttttgagataattatgtctttttttccatyaatacagtgcattccatgaattgattttcaaatgttaatccaaccatatgttcctgggatgaatcccattggtcatggagtgtaatccttttttatgtgg

SEQ ID NO: 24224 - DNA, 201 bp, Homo sapiens
gtcctgtgagaggccagaaaggtggcagggccatgaggtcctagaggaacctcctagtcttggaccctcgagaagtttccagaaatgtgtgactgcagacycagggcgggatcaggaaaaacaaggaaagcagatgtgggtcctcgaccaactgccctcctaaggtctgtccttagccagggaccttcccctgacctgtga

SEQ ID NO: 24225 - DNA, 201 bp, Homo sapiens
ggattggacatccttgcattgatccccatcttaggagaaaagcattcagtcttcagtctttcttcattaagtttgattttagctgtgggttttttatagaygccctttatcagagtgaagaaggtctcctccattcctattttgttgaaacttatgaacatgagtgatgttaacatttttgtcaactgtttcttctgcatc

SEQ ID NO: 24226 - DNA, 201 bp, Homo sapiens
cttttctggaacaggaaaggtgattggggaaggaatgcagttcagcatgaggaagagggtcatggtgggcacaggggtgggctggtctctgcagaaagagragtcagggttcttgaagtcacaaagggacttgccactcagtcccacacagggcagctgtttcacactacagaaaaatattcatgaacaaattcatatcag

SEQ ID NO: 24227 - DNA, 201 bp, Homo sapiens
catgggggaaactcccctatgtgggaggacttcagagggggtcatgtcctcagggagaccaggttgctgctggagctgggaggtgcaggaacatcctgagrgagggtgtggaggttttgttgatcattgactgagattccagggggtgcactgggaagatttctgtggttcgggaggttggggagacagaatagtggtgtg

SEQ ID NO: 24228 - DNA, 201 bp, Homo sapiens
tactcctacctggggcttgaaatccaccaatggaagaaggaaactcagagctcacccctttcctacctgggatcttattcctccacatcacagcagcgacyacagctacagtgattacagcaactagaagaaccaggccagcaatgatgcccacaacggggatgatgggctgggaagacagctctaagaaaggaggtgaac

SEQ ID NO: 24229 - DNA, 201 bp, Homo sapiens
ccagccccttttctggaacaggaaaggtgattggggaaggaatgcagttcagcatgaggaagagggtcatggtgggcacaggggtgggctggtctctgcasaaagagaagtcagggttcttgaagtcacaaagggacttgccactcagtcccacacagggcagctgtttcacactacagaaaaatattcatgaacaaattc

SEQ ID NO: 24230 - DNA, 201 bp, Homo sapiens
agtagagatggggtttcaccgtgttagccaggatggtctggatctcctgacctcatgatccgcctgcctcagcctcccaaagtgctgggattaccggcatragccaccgcgcccggcctattttgtcaattttctataaaatccctgctgggattttgatagggattgtgttgaacctatagatctactgggggagaattg

SEQ ID NO: 24231 - DNA, 201 bp, Homo sapiens
cttcccctgacctgtgactgctgggagtcaggttcccatgaccacaatcaaggtgataaatttgtccttcattttcacaggtgctttacaaaagagtaagbgttgatagacagggcctctgaacagggtaaatgtgtgtggagatggtgcctcacaactaggcaagatatgagcctactcctacctggggcttgaaatcca

SEQ ID NO: 24232 - DNA, 201 bp, Homo sapiens
aagcccccgaccccttcttttagaacagatctttttgtctttgtctttatttctgtgttcatcccccttcattatatcccatagtaaccgattgcgacaayggggttttaccatgttagccagactggtcttgaactcctgacctcaggtggtccacccacctcagcctcccaaagtgctgggattacaggcgtgaaccac

SEQ ID NO: 24233 - DNA, 201 bp, Homo sapiens
gcaacaaatcagcacaagaaacacgtgtactgtggaaagttctcatgtcttccatttattttgtctctcaaatttcaggaatcttctcctttaattaacchatcaatctctcttggaaataatttgaaaaagtaaatttatactcagattctaattttaatacagaagtaagttatagctcagtgcaccacaaatttgaga

SEQ ID NO: 24234 - DNA, 201 bp, Homo sapiens
tttttagtagagatggggtttcaccgtgttagccaggatggtctggatctcctgacctcatgatccgcctgcctcagcctcccaaagtgctgggattaccrgcatgagccaccgcgcccggcctattttgtcaattttctataaaatccctgctgggattttgatagggattgtgttgaacctatagatctactgggggag

SEQ ID NO: 24235 - DNA, 201 bp, Homo sapiens
aggtctgtcctcagcagggaccttcccctgacctgtgactgctgggagtcaggttcccatgaccacaatcaaggtgataaatttgtccttcattttcacargtgctttacaaaagagtaagtgttgatagacagggcctctgaacagggtaaatgtgtgtggagatggtgcctcacaactaggcaagatatgagcctactc

SEQ ID NO: 24236 - DNA, 201 bp, Homo sapiens
gacctatttgtagccaaagccattttcatggcctcgtggtcctctctgtcacatggctccttacaattctgtgtggttttgttccaatgtaagtagttctygttaaggatgcttgcaatgaactttggtattcttttctctttcatttttataaaaaccaagcatattttactttgaaaaaatctgtttaaggaattagga

SEQ ID NO: 24237 - DNA, 201 bp, Homo sapiens
tggaaaatacaattgaaagagacctggaaggaggggaagaggtgtaggggtctgaaaatttttcttctgataacacaggaacttctacgtgtagggaccaycctaggtgatatccaagtctatgtgatcacaggtcctggtgggacaaggttctactgaagggccaaggacaatggagcagcaaagatgacccagctgagc

SEQ ID NO: 24238 - DNA, 201 bp, Homo sapiens
ggaatagcactgctatgagcatgactgtacaattatctgtgtgcatacctgctttcaatttttggggggtatacacccaaaagtggaattgttgcttcatrtggaaattctatgtttaccttcttgagaaagcgtcatcctgtttccatgatggctgcactgttgttcactctcagcagcagtgcacaagcattccatttt

SEQ ID NO: 24239 - DNA, 201 bp, Homo sapiens
cccttctgcatcctctgcattttaatatacatttttaggattattttgtcaattttcttttctttttttctttttttttttttttttgagacggagtctcrctctgtcacccaggctggagtgcagtggcatgatctccgctcactgcaacctccgcctaccgggttcatgccatttttctgcctcagcctcccgaggagc

SEQ ID NO: 24240 - DNA, 201 bp, Homo sapiens
aggtcaggatcagaaaacccaagggaagaggatgtgttgaggctggaccagttgtcctcctgaggtctgtcctcagcagggaccttcccctgacctgtgaytgctgggagtcaggttcccatgaccacaatcaaggtgataaatttgtccttcattttcacaggtgctttacaaaagagtaagtgttgatagacagggcct

SEQ ID NO: 24241 - DNA, 201 bp, Homo sapiens
aaaaaaaaaaagatggaaaatacaattgaaagagacctggaaggaggggaagaggtgtaggggtctgaaaatttttcttctgataacacaggaacttctavgtgtagggaccaccctaggtgatatccaagtctatgtgatcacaggtcctggtgggacaaggttctactgaagggccaaggacaatggagcagcaaagat

SEQ ID NO: 24242 - DNA, 201 bp, Homo sapiens
ggcagggcatgagatcctagagaagtttccagaactgtgactacagacccaggtcaggatcagaaaacccaagggaagaggatgtgttgaggctggaccarttgtcctcctgaggtctgtcctcagcagggaccttcccctgacctgtgactgctgggagtcaggttcccatgaccacaatcaaggtgataaatttgtcct

SEQ ID NO: 24243 - DNA, 201 bp, Homo sapiens
gattattgtagtttcatatgacattccattttttttttcaaatttgtgttggcccttctgcatcctctgcattttaatatacatttttaggattattttgycaattttcttttctttttttctttttttttttttttttgagacggagtctcgctctgtcacccaggctggagtgcagtggcatgatctccgctcactgca

SEQ ID NO: 24244 - DNA, 201 bp, Homo sapiens
cacttacatgaagcctgagcataactgcctccttttccatctgtggaaagaaaacaaactgtgagaggccagggaggaggcagggcatgagatcctagagragtttccagaactgtgactacagacccaggtcaggatcagaaaacccaagggaagaggatgtgttgaggctggaccagttgtcctcctgaggtctgtcct

SEQ ID NO: 24245 - DNA, 201 bp, Homo sapiens
ccacacttacatgaagcctgagcataactgcctccttttccatctgtggaaagaaaacaaactgtgagaggccagggaggaggcagggcatgagatcctaragaagtttccagaactgtgactacagacccaggtcaggatcagaaaacccaagggaagaggatgtgttgaggctggaccagttgtcctcctgaggtctgt

SEQ ID NO: 24246 - DNA, 201 bp, Homo sapiens
acaggtgatgtgactaaaggaggaattttggggtggctgagctcccccatgggctcctgtctacactatcccaaggatctcagggatcactcttcccaccmctaccacacttacatgaagcctgagcataactgcctccttttccatctgtggaaagaaaacaaactgtgagaggccagggaggaggcagggcatgagatc

SEQ ID NO: 24247 - DNA, 201 bp, Homo sapiens
gtcaccttcacacaggttaactcggaagacaaaggtgctttggctaagctggtggaagttctcaggaccaattacaatgacagatacgatgagatccgccrtcactggggagacagtgtcctgggtctcaagtatgtggtttgcattgccaagctcaaaaaggcaaagggtaaagaacatgccactaaattgggtgaaatg

SEQ ID NO: 24248 - DNA, 201 bp, Homo sapiens
agacctgcaccactgtcaccttcacacaggttaactcggaagacaaaggtgctttggctaagctggtggaagttctcaggaccaattacaatgacagatabgatgagatccgccatcactggggagacagtgtcctgggtctcaagtatgtggtttgcattgccaagctcaaaaaggcaaagggtaaagaacatgccacta

SEQ ID NO: 24249 - DNA, 201 bp, Homo sapiens
ttgagtctgtgtatgaattttataagactgggtaacaaattgtcacaaacattggctttaaacagcacccatttattgtattcattgatttatttttagakacagagtctccctctgtcatccaggatgaagtgcagtcacatgatcatggctcactgcagcctcaaattcctgggctcaagggaccctcctacctcagtc

SEQ ID NO: 24250 - DNA, 201 bp, Homo sapiens
tcactgcagcctcaaattcctgggctcaagggaccctcctacctcagtcttcagagtagctaggactgcaggcaagtgccaccatgcccagctaattaaaragaaatgtagagacgagtgtctcactatattatcctagctggtctcaaagtcctggctgcaagtgttcctcctgtgtcagctcctcaaatgttaggatac

SEQ ID NO: 24251 - DNA, 201 bp, Homo sapiens
cctagctggtctcaaagtcctggctgcaagtgttcctcctgtgtcagctcctcaaatgttaggatacaggtgtgcactaccacgcctggccaaataacacycatttgttgtttatagtttcttaatcagaaatctgggcatgatgtggatggaatctctgttccggtcttcctaaacctgtgttttcattttgaatcctcc

SEQ ID NO: 24252 - DNA, 201 bp, Homo sapiens
tctgttcactgtgattgatgatagtttcttttgctgtgcagaaaaaaatgcctaatcaaattgcttttcatttacaaaaatgtgaatctcatacttcagtmaactttattttactttagtaaaaattattagcatgatgccaataattttggcttgatgctgtagcccgaaatggttagttctaattgagaaacaagtttt

SEQ ID NO: 24253 - DNA, 201 bp, Homo sapiens
ttggacatccttgcattgatccccatcttaggagaaaagcattcagtcttcagtctttcttcattaagtttgattttagctgtgggttttttatagatgcsctttatcagagtgaagaaggtctcctccattcctattttgttgaaacttatgaacatgagtgatgttaacatttttgtcaactgtttcttctgcatcttt

SEQ ID NO: 24254 - DNA, 201 bp, Homo sapiens
tctgaacccaggggtacaagtccatgggggaaactcccctatgtgggaggacttcagagggggtcatgtcctcagggagaccaggttgctgctggagctgkgaggtgcaggaacatcctgagagagggtgtggaggttttgttgatcattgactgagattccagggggtgcactgggaagatttctgtggttcgggaggtt

SEQ ID NO: 24255 - DNA, 201 bp, Homo sapiens
tttttttccattaatacagtgcattccatgaattgattttcaaatgttaatccaaccatatgttcctgggatgaatcccattggtcatggagtgtaatccktttttatgtggctttgtattatctgccaatgtttgttaaggatgttttcatttatgtttattggtgacactggtgtatggcactcttttcctgtgagtct

SEQ ID NO: 24256 - DNA, 201 bp, Homo sapiens
gaaagttctgagaaccacagtgaggagcaaggtccccacctcacctctgaacccaggggtacaagtccatgggggaaactcccctatgtgggaggacttcrgagggggtcatgtcctcagggagaccaggttgctgctggagctgggaggtgcaggaacatcctgagagagggtgtggaggttttgttgatcattgactga

SEQ ID NO: 24257 - DNA, 201 bp, Homo sapiens
cagtgcttttctcaccagggctgcttttgtgtcctccctccctccctcctcccacaccaatcctcctgcacactgcagcacacaaccatatttgtctcttsaggaaagataacccaaggcttatggctccaattatccaaccacatatgaatctaaattagactctgctttacaaatccatgagtttggtttggagccagc

SEQ ID NO: 24258 - DNA, 201 bp, Homo sapiens
agaaagttctgagaaccacagtgaggagcaaggtccccacctcacctctgaacccaggggtacaagtccatgggggaaactcccctatgtgggaggacttyagagggggtcatgtcctcagggagaccaggttgctgctggagctgggaggtgcaggaacatcctgagagagggtgtggaggttttgttgatcattgactg

SEQ ID NO: 24259 - DNA, 201 bp, Homo sapiens
gaaaaaaaatgcatggataattttcatgatatctgccactacagataagcaaaaaaatcgtcacattctaaagctgtcctgggccacatgcatcccgagakctgcaggttggacaagcttgcatctagaatgtatacacgacaaggccagaaatttttctgtttttactttaacgatgttttctaaatgcaaaaacagtca

SEQ ID NO: 24260 - DNA, 201 bp, Homo sapiens
tacactaatgacagctgatgagcagaaaaaaatagaaaaaagaaaaaaaatgcatggataattttcatgatatctgccactacagataagcaaaaaaatcrtcacattctaaagctgtcctgggccacatgcatcccgagagctgcaggttggacaagcttgcatctagaatgtatacacgacaaggccagaaatttttct

SEQ ID NO: 24261 - DNA, 201 bp, Homo sapiens
cacatccctcaaatctttactccaaggtcacatttgcaacaaggcccatgctgaccacccagcacaacagccacctccctgtacccacagcccaccctctsgatcacctgccacacagcacttgccaccttctaactcaagcattttctgttcctactctgcttatactatatcatctgcctgcagaggtgtccaatcttt

SEQ ID NO: 24262 - DNA, 201 bp, Homo sapiens
tggctacaatgaggggaatgggggtctaatctgatgacagcctaggggttttagggaggagggaggcagaaagttctgagaaccacagtgaggagcaaggwccccacctcacctctgaacccaggggtacaagtccatgggggaaactcccctatgtgggaggacttcagagggggtcatgtcctcagggagaccaggttg

SEQ ID NO: 24263 - DNA, 201 bp, Homo sapiens
ccagagagaagctttcaaaggataagtcctaccatgtcccactttccaaaactgtcctctaactccccatgtcattcagagcaaaggtcaacatccttcchacaccctccagggcaacctgctctgggcacacctctgacttcatttcagtttctctctgttcaacacttctggcctcttcctccttccaggaacacagac

SEQ ID NO: 24264 - DNA, 201 bp, Homo sapiens
tccagaatcccatcacttcccactatttcccctgctcacaccccagtcaaggtaagcgacgtctccatcctggaatactgcactcctttcccaccgttttycccactgcctcactagtcccccacctctcaattctgttctcagcacagcagccagagagaagctttcaaaggataagtcctaccatgtcccactttccaa

SEQ ID NO: 24265 - DNA, 201 bp, Homo sapiens
gggaatggctacaatgaggggaatgggggtctaatctgatgacagcctaggggttttagggaggagggaggcagaaagttctgagaaccacagtgaggagmaaggtccccacctcacctctgaacccaggggtacaagtccatgggggaaactcccctatgtgggaggacttcagagggggtcatgtcctcagggagacca

SEQ ID NO: 24266 - DNA, 201 bp, Homo sapiens
atctgggcccctcaccttcattcctcgtagatgtcacctccactggatgcctgcaatgccctctcctctgtatgctcctgccagagtctccccatctccaytgacagcagctccacccttctgctcactcagtccaatactgtgggtgtccttgattcttctttctcacaccacagataaatccattagcaagtgctgtga

SEQ ID NO: 24267 - DNA, 201 bp, Homo sapiens
tatctgtgtgcatacctgctttcaatttttggggggtatacacccaaaagtggaattgttgcttcatatggaaattctatgtttaccttcttgagaaagcrtcatcctgtttccatgatggctgcactgttgttcactctcagcagcagtgcacaagcattccattttctccacatcctcaccaacacctggactagtgaa

SEQ ID NO: 24268 - DNA, 201 bp, Homo sapiens
tcttgctcaactatttttcttctgttgccttctttagatgaataaaaaactttgcattattgtggtcttctcagtaagtgttctagttacaaattctcttrttatttctttaattatctgagaaagcacaataatctgtgacttattataaccaacagcagaccataacttccctgactttcacctacctgtgcagacagc

SEQ ID NO: 24269 - DNA, 201 bp, Homo sapiens
ctgccttcagcccctggtaacctgtattctactttctgtttttgtgaatttgcttattctaggtgcctcatataagtgaaatatcatatttgccttttttytggcttattttatttagcgtgttttcaaggttccatccaatccaaatattcttcacttttaaggctgattaatattccatgtgtatatgcaccacatttt

SEQ ID NO: 24270 - DNA, 201 bp, Homo sapiens
caggaggatttttaccgggaacctgtgcgatgagctgtgacatccttctccccaccttcaatctcagccccagcaggcacctcctgggcgcagaagcagtkcagcggcgccacctggcggtctgcactcttcctttcccagatcaagcacagccctgaaatccacctgtccctcctctgtgcctgtgatttcttcagggga

SEQ ID NO: 24271 - DNA, 201 bp, Homo sapiens
ggcatgtctgcagctgtgcccacacttggagtgtgtcagtacattataaacactggctcagtggtgttagtacattataaacattggcttatcatgggttrttttattatttattgtgtattttgatttcactttactggcaacacaataaacaatgacatgatgaccctagcaatcacatcctctttcttgtgtcaaaaa

SEQ ID NO: 24272 - DNA, 201 bp, Homo sapiens
ctgtaaaatgtaaatgtggatatggcttggattactaagtggttttatttcttcattcacctgacatttgttgtgtacctgctgcaagtcaaatacatggyatgatattgtttccttgttcacaccacagcaaatgagaaaatgagacattatagccaggtgtggcggcacaggcttctcgtcctagctactcagaaggct

SEQ ID NO: 24273 - DNA, 201 bp, Homo sapiens
tgccaggcctcttccatgggggcccttttctgcagtgactgggatttctttccatttcactctaccctgtgtcctgacccaagagacaaggcatgtctgcmgctgtgcccacacttggagtgtgtcagtacattataaacactggctcagtggtgttagtacattataaacattggcttatcatgggttattttattattt

SEQ ID NO: 24274 - DNA, 201 bp, Homo sapiens
cttcctggtgcctcagtttcttaatctgtgaaatggtgaggacattacagcacttacctctcgggcgggtttctcaacagcagccctattaagaatttgaracagagaatcccttgtggtctgtcctgtgcattgtgggaggtttgccagcagcaccccactcaccccctcccaccaatccccacgtgacaaccgaaaatg

SEQ ID NO: 24275 - DNA, 201 bp, Homo sapiens
tgtaaatcaaagacttcttttatctaattatttttctttaatgctttaagcttatcttttaatttaatttaatttaatttaattttaagttccagggtacrtgtgcaggatgtgcaggtttgttacataggtaatcgtgtgccatggtggttggctgtacctatcaacccatcacctaggtgttaaccctggcattcatta

SEQ ID NO: 24276 - DNA, 201 bp, Homo sapiens
tttaatgctttaagcttatcttttaatttaatttaatttaatttaattttaagttccagggtacgtgtgcaggatgtgcaggtttgttacataggtaatcrtgtgccatggtggttggctgtacctatcaacccatcacctaggtgttaaccctggcattcattagctatttttcctaatgatccccccatcactgccctc

SEQ ID NO: 24277 - DNA, 201 bp, Homo sapiens
ctatgattctaaatagcatgccatcaggtgcttctgaagtggttttgtttgtttctttgttttcgcagtcctattgtgttttctattcatattgctattcygtcactggttattcctttctactcttttcttgtttcatttattttgatcaatgatgtgcatttccaattctgtaaaagtttaattcagtggtatgtgtgg

SEQ ID NO: 24278 - DNA, 201 bp, Homo sapiens
ttctttgttttcgcagtcctattgtgttttctattcatattgctattccgtcactggttattcctttctactcttttcttgtttcatttattttgatcaawgatgtgcatttccaattctgtaaaagtttaattcagtggtatgtgtggtagaatgtaacatcaaatcctttgcaagatggaattaccttgcacatcagat

SEQ ID NO: 24279 - DNA, 201 bp, Homo sapiens
gccttattgcaccagctgcaatctccagtacaatgttaagtagaagtgttggattggacatccttgcattgatctccatcttaggagaaaagcattcagtmtttcttcagcaagcatgattttagttgtgggttttttatagatgccctttatcagggtgaggaaggtcccctccattcctattttgttgaaacttatgaa

SEQ ID NO: 24280 - DNA, 201 bp, Homo sapiens
cttgcacatcagattgaagattgtatacatgaaaatctacagagatgccagtgagccaaggatcaaatgacctatttgtagccaaagccattttcatggcmtcgtggtcctctctgtcacatggctccttacaattctgtgtggttttgttccaatgtaagtagttcttgttaaggatgcttgcaatgaactttggtattc

SEQ ID NO: 24281 - DNA, 201 bp, Homo sapiens
tgcacatcagattgaagattgtatacatgaaaatctacagagatgccagtgagccaaggatcaaatgacctatttgtagccaaagccattttcatggcctsgtggtcctctctgtcacatggctccttacaattctgtgtggttttgttccaatgtaagtagttcttgttaaggatgcttgcaatgaactttggtattctt

SEQ ID NO: 24282 - DNA, 201 bp, Homo sapiens
aatgtaagtagttcttgttaaggatgcttgcaatgaactttggtattcttttctctttcatttttataaaaaccaagcatattttactttgaaaaaatctrtttaaggaattaggaatttaagtcaattctttcaactcaatgttttcagaacacatcatcaacatcaagtattacacatttattttaaaagttccatttt

SEQ ID NO: 24283 - DNA, 201 bp, Homo sapiens
ctttggtattcttttctctttcatttttataaaaaccaagcatattttactttgaaaaaatctgtttaaggaattaggaatttaagtcaattctttcaacwcaatgttttcagaacacatcatcaacatcaagtattacacatttattttaaaagttccattttaaaagggaatggatgatatgttgtttggactttagcc

SEQ ID NO: 24284 - DNA, 201 bp, Homo sapiens
ttttttcatatgttatgccatagtaccaggaatagggatgtaaataaaagtgccagaaacaggaattatccctaagcgaaaaaccataactatatttttayacctttatgtaagaattctcaagtattcatttcatctgaaaagttaggattaacagtaagtagagttatatagcctggtggtctgatagcccccactagt

SEQ ID NO: 24285 - DNA, 201 bp, Homo sapiens
tgcctgcagtctaggccagcccagcagacaaacctaatgtcactcccaaacctggaaacaactgatataaagggacagagggaggaatagtggctgagggyaagtgaataaatcaaagggttatataatgagaaaaattcaatattagcttaactcctcaaaggtggtgtgagcaagagaagatattgtcacttaggtcaa

SEQ ID NO: 24286 - DNA, 201 bp, Homo sapiens
ataaatcaaagggttatataatgagaaaaattcaatattagcttaactcctcaaaggtggtgtgagcaagagaagatattgtcacttaggtcaattatacdggatgcctaaaagagtgaagctgtatgtccctgagaccatccttgtttttggaacctggtaagattgagtgttgtcagcaaagctgagtgatttcattct

SEQ ID NO: 24287 - DNA, 201 bp, Homo sapiens
agtgaaccaagagctacaagagtcaggattgagaggaaaggccaggggcccacagggaatggctacaatgaggggaatgggggtctaatctgatgacagcytaggggttttagggaggagggaggcagaaagttctgagaaccacagtgaggagcaaggtccccacctcacctctgaacccaggggtacaagtccatgggg

SEQ ID NO: 24288 - DNA, 201 bp, Homo sapiens
aaatcaaagggttatataatgagaaaaattcaatattagcttaactcctcaaaggtggtgtgagcaagagaagatattgtcacttaggtcaattatacggratgcctaaaagagtgaagctgtatgtccctgagaccatccttgtttttggaacctggtaagattgagtgttgtcagcaaagctgagtgatttcattctgg

SEQ ID NO: 24289 - DNA, 201 bp, Homo sapiens
cttaactcctcaaaggtggtgtgagcaagagaagatattgtcacttaggtcaattatacgggatgcctaaaagagtgaagctgtatgtccctgagaccatycttgtttttggaacctggtaagattgagtgttgtcagcaaagctgagtgatttcattctgggagacatattcatacaagaggatgataaactggcctaat

SEQ ID NO: 24290 - DNA, 201 bp, Homo sapiens
aagtcccttttgccatgtaatgcaacctgttcacaggttccaaggactaagactggacctctttcgggaccattactcagcccaccacatgttgaagtcaycaacagtcaaggagactgctggagagggtgacagtgaaccaagagctacaagagtcaggattgagaggaaaggccaggggcccacagggaatggctacaa

SEQ ID NO: 24291 - DNA, 201 bp, Homo sapiens
atcacatggtaacagaggaacacagagagtaggaagttgccagggtctttttaacaactagctctcttggaaaataatagagcaacaattcattcattccygagagagggcagtatctctcgattcataaaagattggtcaccatgacccaaatggtggccattaggccccaagtcccacagtgggcgttagattttaaca

SEQ ID NO: 24292 - DNA, 201 bp, Homo sapiens
ttaatcatcattacatgagtaaagtcccttttgccatgtaatgcaacctgttcacaggttccaaggactaagactggacctctttcgggaccattactcarcccaccacatgttgaagtcaccaacagtcaaggagactgctggagagggtgacagtgaaccaagagctacaagagtcaggattgagaggaaaggccaggg

SEQ ID NO: 24293 - DNA, 201 bp, Homo sapiens
tcttcctggtgcctcagtttcttaatctgtgaaatggtgaggacattacagcacttacctctcgggcgggtttctcaacagcagccctattaagaatttgrgacagagaatcccttgtggtctgtcctgtgcattgtgggaggtttgccagcagcaccccactcaccccctcccaccaatccccacgtgacaaccgaaaat

SEQ ID NO: 24294 - DNA, 201 bp, Homo sapiens
aacttgcatgttaactgaagcttttgtttttattttattcgaagttacaattgcacataattgaaagagtaaatatttgcgcaggacttcctgagaaaaaygagtcttctctgcctttctagggagagtcctctcttctctgtttctgcctttctagggagcaaccactttcaagtttcagctgattcttttgactttact

SEQ ID NO: 24295 - DNA, 201 bp, Homo sapiens
attttttctgagtgtaagtcatggcttgaaatctggagagcctgaaggagatcccgctacctaaacccgttttccttttccctcaagcctcatttggccayaggcccagtgtcaacaccagggggcgccacagaccatgaaggcaccgcgcagctgggattgtttgtggtgggctcctgggtccctgacttaaccagggaa

SEQ ID NO: 24296 - DNA, 201 bp, Homo sapiens
ttagtggctcatttgatttgaatggggccacacagattgtccaggagaatctccctattttaaggtccttaatcatcattacatgagtaaagtcccttttrccatgtaatgcaacctgttcacaggttccaaggactaagactggacctctttcgggaccattactcagcccaccacatgttgaagtcaccaacagtcaag

SEQ ID NO: 24297 - DNA, 201 bp, Homo sapiens
gtcctgtaatgaagtcatgtgtgcatgtaacatcacttctgcacgcagtgtcatgggaaagtgggttcgcggaccccaggttaaaagcctaagcactaaakgcacagagctagagctctaggaggggcgggatggctggggtggaacgtcatcttgtcctttagtcctggggcattttcactcctcacatggtgggtgctg

SEQ ID NO: 24298 - DNA, 201 bp, Homo sapiens
ctgctgcctggggcttagaaaagtgacttggatattttgccaaagttgtatttctttgatggaattcgaaatccatgaacactctgctttcctgctgtatycccagagcgggttgagtaccttgcacttcttttcagcacttccctagaagtggtagaagatttggagttagggcctccctcaatctctgccctttcttta

SEQ ID NO: 24299 - DNA, 201 bp, Homo sapiens
ttaaatgacagctgcccattgttcctgccttcagcccctggtaacctgtattctactttctgtttttgtgaatttgcttattctaggtgcctcatataagwgaaatatcatatttgccttttttttggcttattttatttagcgtgttttcaaggttccatccaatccaaatattcttcacttttaaggctgattaatatt

SEQ ID NO: 24300 - DNA, 201 bp, Homo sapiens
ggcgggccccttgcttctccccgcagaggcggtttccccacgaccccgcactcacccgcccaggtctgggtcagggccagggcccccaagagtagcaggasgagggttcggggcgccatgacggccatcctcggcgtctggggagaatctgagtcccggtgggtgcgtgcggactttagaaccgcgaccgcgacgacactg

SEQ ID NO: 24301 - DNA, 201 bp, Homo sapiens
tgcagccctaaattgaattgtccttcgctctaaatacaggtctcacaaagttttatgtcttcaatgatttcacctgggccgagattttgttttgtttttgrtgttgtttgttttgagctgctgcctggggcttagaaaagtgacttggatattttgccaaagttgtatttctttgatggaattcgaaatccatgaacactc

SEQ ID NO: 24302 - DNA, 201 bp, Homo sapiens
tgatggtggttacacaaacaccaacatgcattttcagaacattttcatcatcccaacagagactgtacccattaaatgacagctgcccattgttcctgccytcagcccctggtaacctgtattctactttctgtttttgtgaatttgcttattctaggtgcctcatataagtgaaatatcatatttgccttttttttggct

SEQ ID NO: 24303 - DNA, 201 bp, Homo sapiens
agtagtaaatgtaaacatcaggaatccaaggagattctatctttttacacagaaatggcctcactatgcactgctgaagggagaaggtccctccaggagamcttcatgatgaggaaaaacccaatatgatgtaggggttttctgctgcagccctaaattgaattgtccttcgctctaaatacaggtctcacaaagttttat

SEQ ID NO: 24304 - DNA, 201 bp, Homo sapiens
caaacagaaacataggctgaaatgaagggtttatgtttatcttgctacaaattctgttggcccacaatctcttatgcttattgcataagagagccacagaktggggtgatagctcaaataaccagtccctggttttctgcttcagaaacaagtttaaattctctgcttagacaaagtaaagaaaataattgaaagatgttg

SEQ ID NO: 24305 - DNA, 201 bp, Homo sapiens
acatgggagcaccatgaatttatttacatgtctttacttcacagttgttttgaggaggctttcactgagaaacctaacagaaatgaatatatatgacttcytataaaatgaaatttaagtaaaattatactttttaaaatgttaagactggagcaagactggaacatcaccagacaaacagaaacataggctgaaatgaag

SEQ ID NO: 24306 - DNA, 201 bp, Homo sapiens
aaagggggagtcatccctaaatatggcggccctgggacagctggcctccctgccaggcctcttccatgggggcccttttctgcagtgactgggatttcttyccatttcactctaccctgtgtcctgacccaagagacaaggcatgtctgcagctgtgcccacacttggagtgtgtcagtacattataaacactggctcagt

SEQ ID NO: 24307 - DNA, 201 bp, Homo sapiens
taatagcgtcctttgatgcaaaaaagtttttacattttgatgaagtcttatttgtcattttccttttattgcttgtacttttggtcaccagccaagaaacsactaccaattctaatgaccataagactttccctcagtattttcttttaagagttttacaggtttaactcttaagattagttctttaaggcattctgactt

SEQ ID NO: 24308 - DNA, 201 bp, Homo sapiens
tttgtaggtttccccctaaccccgtcattattgtgcagggcattctatcaccccacctgccatagcttcccctaaccagggcatcctctcagctcagcackggtgagacccatagcagctcggctgcatcttgtgctatggaatttctgtgtctcccacaaccctggtggcatcctcttggcctgccaggcagtgggcaag

SEQ ID NO: 24309 - DNA, 201 bp, Homo sapiens
ttttaaaagttccattttaaaagggaatggatgatatgttgtttggactttagccagcactgttgtaaaacacagaacctgtaaactaccctgggctgctkcccattcacatcccccaaaaggagactccatcctgagtcttgtgattattattcctttatttagatgtgtggtcttatttctgagttctctgttctgttc

SEQ ID NO: 24310 - DNA, 201 bp, Homo sapiens
tcatgaggtgaaaatgatccacctgggttgagcttgaatcccatgttgacacccacagaaaacagccaagtctgaagtgtcattaaacaacgaaacagacmaatggaagctagccagccttcactatgggtcagcccatgcatgataggatgggcacatgaatggaacaaccacagtggcaggtgtgaggctacatatggg

SEQ ID NO: 24311 - DNA, 201 bp, Homo sapiens
tgaggtatcaggggataaatgtttatatcattgcatcccctccctagccagccaaaggtcatgttcttctcacattgcaaaatataataatctactcccarttgtcccaaatgtgttaggttgttccagcatcaactcaaaattctagagtctcatctgagacgcaaggtaaattcttatagctttgagcctgtaaaattt

SEQ ID NO: 24312 - DNA, 201 bp, Homo sapiens
acagcattcatcatgaggtgaaaatgatccacctgggttgagcttgaatcccatgttgacacccacagaaaacagccaagtctgaagtgtcattaaacaaygaaacagacaaatggaagctagccagccttcactatgggtcagcccatgcatgataggatgggcacatgaatggaacaaccacagtggcaggtgtgaggc

SEQ ID NO: 24313 - DNA, 201 bp, Homo sapiens
aaattactctattgctaaaaaatgctaacggtcgtctgaggcttcagctaattttaatctttttgctgggcagggtcttgcctcaatgttgatgactgccrgctgttcaagagggtggttgctaaaggctgctgtggcaatttcttaaaataagacaatgaagtttatggcatggattataaagggggaatcagtacttaa

SEQ ID NO: 24314 - DNA, 201 bp, Homo sapiens
gacttgtgactgctgggagtcaggttcccatgatcacaatcaaggtgataaatttgtccttcaatttcacaggtgctttacaaaagagtgagagttgacakggcatctgaacagggtaaatgtgtgtggagatggtgtctcacaactaggcaggaaatgagccaacttccatctggagcttgaaatccacgaatggaagaa

SEQ ID NO: 24315 - DNA, 201 bp, Homo sapiens
aagtaggggggatggtggcttagtacattttccttctttatctctttatgaccatgtggcctgcttaaacctatactaaggcacatagaattgaaaatgarccatcacatgtaggttattttttacacccttaagtcctgcccaagccagggctgggccaaggccctcgaacatccagctgtggcctcctcctgctgcagg

SEQ ID NO: 24316 - DNA, 201 bp, Homo sapiens
ttaaaattactctattgctaaaaaatgctaacggtcgtctgaggcttcagctaattttaatctttttgctgggcagggtcttgcctcaatgttgatgactrccggctgttcaagagggtggttgctaaaggctgctgtggcaatttcttaaaataagacaatgaagtttatggcatggattataaagggggaatcagtact

SEQ ID NO: 24317 - DNA, 201 bp, Homo sapiens
gtggcctgcttaaacctatactaaggcacatagaattgaaaatgaaccatcacatgtaggttattttttacacccttaagtcctgcccaagccagggctgrgccaaggccctcgaacatccagctgtggcctcctcctgctgcaggtgaggagtgggcagcagggagggccgtggtgcctgctttgtccccatcccggtct

SEQ ID NO: 24318 - DNA, 201 bp, Homo sapiens
cacgaatggaagaagaaatcttggaactcacccctttcctacctggggtcttattcttccacatcacagcagtgaccacagcacctagaacaaccaggacrgtaacgatgcccatgatgaggaatgtgggctgggaagatggccctaagaaaggaggggaacgtgaggggtcctgacccccaggcctcagccctgaccctg

SEQ ID NO: 24319 - DNA, 201 bp, Homo sapiens
atgaaagaactatgtacataccttaatttaaaattactctattgctaaaaaatgctaacggtcgtctgaggcttcagctaattttaatctttttgctgggsagggtcttgcctcaatgttgatgactgccggctgttcaagagggtggttgctaaaggctgctgtggcaatttcttaaaataagacaatgaagtttatggc

SEQ ID NO: 24320 - DNA, 201 bp, Homo sapiens
aggtgaatctaagagattagacatggagccatacctgcttccaccgtttgatttctggacccacatgttcttcctcttgcgaacacagaactgtagagacdactctgatttaaacaacgcaccatgtcctgaaagatggcacgcaaccctcagagtgcttcctccaggctggcacttagttgtgcctgtggaagatcacgg

SEQ ID NO: 24321 - DNA, 201 bp, Homo sapiens
tggaagaagaaatcttggaactcacccctttcctacctggggtcttattcttccacatcacagcagtgaccacagcacctagaacaaccaggacggtaacratgcccatgatgaggaatgtgggctgggaagatggccctaagaaaggaggggaacgtgaggggtcctgacccccaggcctcagccctgaccctgctgaag

SEQ ID NO: 24322 - DNA, 201 bp, Homo sapiens
tatgaaagaactatgtacataccttaatttaaaattactctattgctaaaaaatgctaacggtcgtctgaggcttcagctaattttaatctttttgctggrcagggtcttgcctcaatgttgatgactgccggctgttcaagagggtggttgctaaaggctgctgtggcaatttcttaaaataagacaatgaagtttatgg

SEQ ID NO: 24323 - DNA, 201 bp, Homo sapiens
gcaaaccaggacctcgtaccctgcacagcccagtgttctgagataaaacatgtcaaataccccattaggtgaatctaagagattagacatggagccatacytgcttccaccgtttgatttctggacccacatgttcttcctcttgcgaacacagaactgtagagacgactctgatttaaacaacgcaccatgtcctgaaag

SEQ ID NO: 24324 - DNA, 201 bp, Homo sapiens
gaaatcttggaactcacccctttcctacctggggtcttattcttccacatcacagcagtgaccacagcacctagaacaaccaggacggtaacgatgcccaygatgaggaatgtgggctgggaagatggccctaagaaaggaggggaacgtgaggggtcctgacccccaggcctcagccctgaccctgctgaaggcctccag

SEQ ID NO: 24325 - DNA, 201 bp, Homo sapiens
ttttaagggtaccctcctttgcaaaccaggacctcgtaccctgcacagcccagtgttctgagataaaacatgtcaaataccccattaggtgaatctaagasattagacatggagccatacctgcttccaccgtttgatttctggacccacatgttcttcctcttgcgaacacagaactgtagagacgactctgatttaaac

SEQ ID NO: 24326 - DNA, 201 bp, Homo sapiens
cttggaactcacccctttcctacctggggtcttattcttccacatcacagcagtgaccacagcacctagaacaaccaggacggtaacgatgcccatgatgrggaatgtgggctgggaagatggccctaagaaaggaggggaacgtgaggggtcctgacccccaggcctcagccctgaccctgctgaaggcctccagaaggg

SEQ ID NO: 24327 - DNA, 201 bp, Homo sapiens
agatttggtttcagaccatggcaacaaacaagtcacacaaatttttgtttttccagtacatataaaagttatattcacactctactgtagcctattaagtrtacaatagcattatgtatgaaagaactatgtacataccttaatttaaaattactctattgctaaaaaatgctaacggtcgtctgaggcttcagctaattt

SEQ ID NO: 24328 - DNA, 201 bp, Homo sapiens
gcttttaagggtaccctcctttgcaaaccaggacctcgtaccctgcacagcccagtgttctgagataaaacatgtcaaataccccattaggtgaatctaaragattagacatggagccatacctgcttccaccgtttgatttctggacccacatgttcttcctcttgcgaacacagaactgtagagacgactctgatttaa

SEQ ID NO: 24329 - DNA, 201 bp, Homo sapiens
tgaggaatgtgggctgggaagatggccctaagaaaggaggggaacgtgaggggtcctgacccccaggcctcagccctgaccctgctgaaggcctccagaarggctcctgctttccctgagaagagacatggcccctcattcatctccttagcccatctcagtgtgaggggctctggcagtgcctcctgctgcacatggcat

SEQ ID NO: 24330 - DNA, 201 bp, Homo sapiens
tactgcagatttggtttcagaccatggcaacaaacaagtcacacaaatttttgtttttccagtacatataaaagttatattcacactctactgtagcctaktaagtatacaatagcattatgtatgaaagaactatgtacataccttaatttaaaattactctattgctaaaaaatgctaacggtcgtctgaggcttcagc

SEQ ID NO: 24331 - DNA, 201 bp, Homo sapiens
gtcttttgtctgcttttaagggtaccctcctttgcaaaccaggacctcgtaccctgcacagcccagtgttctgagataaaacatgtcaaataccccattasgtgaatctaagagattagacatggagccatacctgcttccaccgtttgatttctggacccacatgttcttcctcttgcgaacacagaactgtagagacga

SEQ ID NO: 24332 - DNA, 201 bp, Homo sapiens
cagacaaggacaagaaacaagttcaaaagagggaaagggaaactacagacgtacctcagagatactgcagatttggtttcagaccatggcaacaaacaagycacacaaatttttgtttttccagtacatataaaagttatattcacactctactgtagcctattaagtatacaatagcattatgtatgaaagaactatgta

SEQ ID NO: 24333 - DNA, 201 bp, Homo sapiens
tctgacctcccctcttctatgtctcctctgccttcctcctctgcagaatctgactccagccagggcaggttctctgcttttagtggctcatttgatttgawtggggccacacagattgtccaggagaatctccctattttaaggtccttaatcatcattacatgagtaaagtcccttttgccatgtaatgcaacctgttca

SEQ ID NO: 24334 - DNA, 201 bp, Homo sapiens
atactgtccacacttctctggtgacaaacttaatgtgtagttcagtgggctgtcttttgtctgcttttaagggtaccctcctttgcaaaccaggacctcgbaccctgcacagcccagtgttctgagataaaacatgtcaaataccccattaggtgaatctaagagattagacatggagccatacctgcttccaccgtttga

SEQ ID NO: 24335 - DNA, 201 bp, Homo sapiens
gcttgcaggaccagacaaggacaagaaacaagttcaaaagagggaaagggaaactacagacgtacctcagagatactgcagatttggtttcagaccatggyaacaaacaagtcacacaaatttttgtttttccagtacatataaaagttatattcacactctactgtagcctattaagtatacaatagcattatgtatgaa

SEQ ID NO: 24336 - DNA, 201 bp, Homo sapiens
caatgtccccagacctaccagagaaggcaaactcatacagcttgcaggaccagacaaggacaagaaacaagttcaaaagagggaaagggaaactacagacrtacctcagagatactgcagatttggtttcagaccatggcaacaaacaagtcacacaaatttttgtttttccagtacatataaaagttatattcacactct

SEQ ID NO: 24337 - DNA, 201 bp, Homo sapiens
ttggcaaatattttatcttattctatgcagtttcttttattttcacttttttttttttttttttttttttttttgagacagagtctctctctgatgccccrgctggagtgcaatggtgcaatctcagctcattgcaacctctgcctcccaggttcaagcgattctcctgcctcagcctcccgagtagctgggattacaggt

SEQ ID NO: 24338 - DNA, 201 bp, Homo sapiens
aattctttatcagatatgtgattggcaaatattttatcttattctatgcagtttcttttattttcacttttttttttttttttttttttttttttgagacrgagtctctctctgatgccccagctggagtgcaatggtgcaatctcagctcattgcaacctctgcctcccaggttcaagcgattctcctgcctcagcctcc

SEQ ID NO: 24339 - DNA, 201 bp, Homo sapiens
atcacccaggcttcccctccaaagaaccactgctatcatattattgaaacttcctggactgcagtgtgaatggtcatccctggagctatcttctgcagtgrtgctgacttccattcttttgttttctatgtatatatttttatatatgctttcattgtagaaagttgcattcataagttttggggttttttttaagatgga

SEQ ID NO: 24340 - DNA, 201 bp, Homo sapiens
tagttctgtatgtagtctggatattaattctttatcagatatgtgattggcaaatattttatcttattctatgcagtttcttttattttcacttttttttktttttttttttttttttttgagacagagtctctctctgatgccccagctggagtgcaatggtgcaatctcagctcattgcaacctctgcctcccaggttc

SEQ ID NO: 24341 - DNA, 201 bp, Homo sapiens
gttcttctgcaagtagaaagccctctttcagaacattgtccaagatcagccaggcccaaccctcaaaatgactttctgtctttgacccaaatgctcaaatrcaactctggggctaatttcagtgggagtaagagattatccaatcaggataattcatttggagagaaaatgttttgcttaagtcagcaaagtcctttgctt

SEQ ID NO: 24342 - DNA, 201 bp, Homo sapiens
ttcacttccttgcacatagaacagaggtttccacttccttgttaagagccacgcttagctcctagaatcttctttcagctactcacacatggtgcctaagkcacatccaatcctcctgcttggaacgtctgacctcccctcttctatgtctcctctgccttcctcctctgcagaatctgactccagccagggcaggttctc

SEQ ID NO: 24343 - DNA, 201 bp, Homo sapiens
agttgtagttctgtatgtagtctggatattaattctttatcagatatgtgattggcaaatattttatcttattctatgcagtttcttttattttcactttyttttttttttttttttttttttttgagacagagtctctctctgatgccccagctggagtgcaatggtgcaatctcagctcattgcaacctctgcctccca

SEQ ID NO: 24344 - DNA, 201 bp, Homo sapiens
gaagaatccatttccaagctcattcaggttcttgtctgaattcacttccttgcacatagaacagaggtttccacttccttgttaagagccacgcttagctmctagaatcttctttcagctactcacacatggtgcctaaggcacatccaatcctcctgcttggaacgtctgacctcccctcttctatgtctcctctgcctt

SEQ ID NO: 24345 - DNA, 201 bp, Homo sapiens
tgcgtccccgccgggcgggccccttgcttctccccgcagaggcggtttccccacgaccccgcactcacccgcccaggtctgggtcagggccagggcccccragagtagcaggaggagggttcggggcgccatgacggccatcctcggcgtctggggagaatctgagtcccggtgggtgcgtgcggactttagaaccgcgac

SEQ ID NO: 24346 - DNA, 201 bp, Homo sapiens
gggtggaggtggcagaggagtgagaagtgattggatttggtgttgatatatatttttaaaattgtggtaaaacacacatactatacgatttaccttctaamaatttttttcagtgtacaattcattggcattaagcacatttacaattgatggtggttacacaaacaccaacatgcattttcagaacattttcatcatccc

SEQ ID NO: 24347 - DNA, 201 bp, Homo sapiens
gacagtgggcatgagagtcagcaggcagcccagctggaaggcccttccggttttctatcctagtgaggatggttctggggtggaggtggcagaggagtgaraagtgattggatttggtgttgatatatatttttaaaattgtggtaaaacacacatactatacgatttaccttctaacaatttttttcagtgtacaattca

SEQ ID NO: 24348 - DNA, 201 bp, Homo sapiens
ataaatcacctatctatctatctgtctgtctatctatctatctatctatctatctatctatctatcatcatctaacatctatctatcatctatcatctatctatctattatctatctatcatctatgtacctatgctattggttctttctttcttggtaaccttaataaatcaacagacaataaacaaataaaacctgtca

SEQ ID NO: 24349 - DNA, 201 bp, Homo sapiens
ccaattagcccaataaatcacctatctatctatctgtctgtctatctatctatctatctatctatctatctatctatcatcatctaacatctatctatcawctatcatctatctatctattatctatctatcatctatgtacctatgctattggttctttctttcttggtaaccttaataaatcaacagacaataaacaaa

SEQ ID NO: 24350 - DNA, 201 bp, Homo sapiens
taattgtgtgagccaattagcccaataaatcacctatctatctatctgtctgtctatctatctatctatctatctatctatctatctatcatcatctaacmtctatctatcatctatcatctatctatctattatctatctatcatctatgtacctatgctattggttctttctttcttggtaaccttaataaatcaacag

SEQ ID NO: 24351 - DNA, 201 bp, Homo sapiens
gcctcccacttgcgctgggtgatctgagccgccatgtccgccgcggtccaagagcgcaggtcctcgttcaaggcgatgtaatccttgccgtcgtaggcgtmctgccggtacccgcggaggaagcgcccgtccgaccccacgtcgcagccatacatcatctggatggtgtgagaacctggccccgaccccacggtcagccca

SEQ ID NO: 24352 - DNA, 201 bp, Homo sapiens
aatgggctggaaaaagagaaaacgaggtcgaattcctcacttaccatgagatcttgcaacacaggttccaagggcctcaacccctctaccctggctgatgytccctcctccactccctctgaccagggccctgagccccccacacagctgagctggcccaagctgaggagttgcttgcacagcagctggagctggaccagg

SEQ ID NO: 24353 - DNA, 201 bp, Homo sapiens
aaaatacatcctcttcagccatggaaattctccttaccttttaaaactaagttacatgtttaatatcttataattaatttacgccaggtatggtggctcaygcctgccatcctagcactgtggaaggcagaggaaggcagatttgttgactccagaagttcaagatcagcctgggcaaaacccccatctatacaaaaaatt

SEQ ID NO: 24354 - DNA, 201 bp, Homo sapiens
ggaaggcagatttgttgactccagaagttcaagatcagcctgggcaaaacccccatctatacaaaaaattagaaaattagccaggcatagtagttcatgayggtagtcccagctactcaggaggctgagatcagtgggtcccttgaacccaggaggtcgacactgcagtgcatggtgatcatgccactgcactccagcctg

SEQ ID NO: 24355 - DNA, 201 bp, Homo sapiens
cttgttacttagtggctagttagtcacctaaagaaatagtgccccactggggcacatcatgggcctcaattgctaatgagttggacattcagaggtgtcgrcagctggatctgccttggtaggggggagtcagtgctgttggccccatacgtagcctcatgcctgccactgtggttgctccattcatgaactcatcctacc

SEQ ID NO: 24356 - DNA, 201 bp, Homo sapiens
ccccacaattcctcctctagccacatcttctgtgggatctgaccaggttctgtttttgttctaccccaggcagtgacagtgcccagggctctgatgtgtcyctcacagcttgtaaaggtgagagcttggagggcctgatgtgtgttgggtgttgggcggaacagtggacacagctgtgctatggggtttctttgcattgga

SEQ ID NO: 24357 - DNA, 201 bp, Homo sapiens
gtcggggccggacggggctcgggggactgggctgaccgtggggtcggggccaggttctcacaccatccagatgatgtatggctgcgacgtggggtcggackggcgcttcctccgcgggtaccggcaggacgcctacgacggcaaggattacatcgccttgaacgaggacctgcgctcttggaccgcggcggacatggcggc

SEQ ID NO: 24358 - DNA, 201 bp, Homo sapiens
gccggacggggctcgggggactgggctgaccgtggggtcggggccaggttctcacaccatccagatgatgtatggctgcgacgtggggtcggacgggcgcytcctccgcgggtaccggcaggacgcctacgacggcaaggattacatcgccttgaacgaggacctgcgctcttggaccgcggcggacatggcggctcagat

SEQ ID NO: 24359 - DNA, 201 bp, Homo sapiens
gggactgggctgaccgtggggtcggggccaggttctcacaccatccagatgatgtatggctgcgacgtggggtcggacgggcgcttcctccgcgggtaccrgcaggacgcctacgacggcaaggattacatcgccttgaacgaggacctgcgctcttggaccgcggcggacatggcggctcagatcacccagcgcaagtgg

SEQ ID NO: 24360 - DNA, 201 bp, Homo sapiens
agggcctgatgtgtgttgggtgttgggcggaacagtggacacagctgtgctatggggtttctttgcattggatgtattgagcatgcgatgggctgtttaargtgtgacccctcactgtgacagatatgaatttgttcatgaatatttttttctatagtgtgagacagctgccttgtgtgggactgagaggcaagagttgtt

SEQ ID NO: 24361 - DNA, 201 bp, Homo sapiens; identical to SEQ ID NO: 4410

SEQ ID NO: 24362 - DNA, 201 bp, Homo sapiens
atgtgtgttgggtgttgggcggaacagtggacacagctgtgctatggggtttctttgcattggatgtattgagcatgcgatgggctgtttaaagtgtgacycctcactgtgacagatatgaatttgttcatgaatatttttttctatagtgtgagacagctgccttgtgtgggactgagaggcaagagttgttcctgccct

SEQ ID NO: 24363 - DNA, 201 bp, Homo sapiens; identical to SEQ ID NO: 4411

SEQ ID NO: 24364 - DNA, 201 bp, Homo sapiens
tcattttcagtttaggccaaaaatccccccgggttggtcggggccggacggggctcgggggactgggctgaccgtggggtcggggccaggttctcacaccrtccagatgatgtatggctgcgacgtggggtcggacgggcgcttcctccgcgggtaccggcaggacgcctacgacggcaaggattacatcgccttgaacga

SEQ ID NO: 24365 - DNA, 201 bp, Homo sapiens
tgttgggcggaacagtggacacagctgtgctatggggtttctttgcattggatgtattgagcatgcgatgggctgtttaaagtgtgacccctcactgtgayagatatgaatttgttcatgaatatttttttctatagtgtgagacagctgccttgtgtgggactgagaggcaagagttgttcctgcccttccctttgtgac

SEQ ID NO: 24366 - DNA, 201 bp, Homo sapiens; identical to SEQ ID NO: 4413

SEQ ID NO: 24367 - DNA, 201 bp, Homo sapiens
gcggaacagtggacacagctgtgctatggggtttctttgcattggatgtattgagcatgcgatgggctgtttaaagtgtgacccctcactgtgacagataygaatttgttcatgaatatttttttctatagtgtgagacagctgccttgtgtgggactgagaggcaagagttgttcctgcccttccctttgtgacttgaag

SEQ ID NO: 24368 - DNA, 201 bp, Homo sapiens; identical to SEQ ID NO: 4414

SEQ ID NO: 24369 - DNA, 201 bp, Homo sapiens; identical to SEQ ID NO: 4415

SEQ ID NO: 24370 - DNA, 201 bp, Homo sapiens; identical to SEQ ID NO: 4416

SEQ ID NO: 24371 - DNA, 201 bp, Homo sapiens
gacgacacgcagttcgtgcggtttgacagcgacgccgcgagccagaggatggagccgcgggcaccgtggatagagcaggaggggccggagtattgggaccrgcagacacggaatgtgaaggcccagtcacagactgaccgagcgaacctggggaccctgcgcggctactacaaccagagcgaggccggtgagtgaccccgg

SEQ ID NO: 24372 - DNA, 201 bp, Homo sapiens
acacgcagttcgtgcggtttgacagcgacgccgcgagccagaggatggagccgcgggcaccgtggatagagcaggaggggccggagtattgggacctgcasacacggaatgtgaaggcccagtcacagactgaccgagcgaacctggggaccctgcgcggctactacaaccagagcgaggccggtgagtgaccccggcccg

SEQ ID NO: 24373 - DNA, 201 bp, Homo sapiens
gcagttcgtgcggtttgacagcgacgccgcgagccagaggatggagccgcgggcaccgtggatagagcaggaggggccggagtattgggacctgcagacasggaatgtgaaggcccagtcacagactgaccgagcgaacctggggaccctgcgcggctactacaaccagagcgaggccggtgagtgaccccggcccggggc

SEQ ID NO: 24374 - DNA, 201 bp, Homo sapiens
tcgtgcggtttgacagcgacgccgcgagccagaggatggagccgcgggcaccgtggatagagcaggaggggccggagtattgggacctgcagacacggaawgtgaaggcccagtcacagactgaccgagcgaacctggggaccctgcgcggctactacaaccagagcgaggccggtgagtgaccccggcccggggcgcagg

SEQ ID NO: 24375 - DNA, 201 bp, Homo sapiens
cgtgcggtttgacagcgacgccgcgagccagaggatggagccgcgggcaccgtggatagagcaggaggggccggagtattgggacctgcagacacggaatrtgaaggcccagtcacagactgaccgagcgaacctggggaccctgcgcggctactacaaccagagcgaggccggtgagtgaccccggcccggggcgcaggt

SEQ ID NO: 24376 - DNA, 201 bp, Homo sapiens
ccaccgggactcagattctccccagacgccgaggatggccgtcatggcgccccgaaccctcctcctgctactcttgggggccctggccctgacccagaccwgggcgggtgagtgcggggtcgtggggaaaccgcctctgcggggagaagcaaggggcccgcccggcggggacgcaggacccgggtagccgcgccgggagga

SEQ ID NO: 24377 - DNA, 201 bp, Homo sapiens
cagacgccgaggatggccgtcatggcgccccgaaccctcctcctgctactcttgggggccctggccctgacccagacctgggcgggtgagtgcggggtcgkggggaaaccgcctctgcggggagaagcaaggggcccgcccggcggggacgcaggacccgggtagccgcgccgggaggagggtcgggtgggtctcagccac

SEQ ID NO: 24378 - DNA, 201 bp, Homo sapiens
aacctggggaccctgcgcggctactacaaccagagcgaggccggtgagtgaccccggcccggggcgcaggtcacgacctctcatcccccacggacgggccrggtcgcccacagtctccgggtccgagatccaccccgaagccgcgggaccccgagacccttgccccgggagaggcccaggcgcctttacccggtttcattt

SEQ ID NO: 24379 - DNA, 201 bp, Homo sapiens
tttaaagtgtgacccctcactgtgacagatatgaatttgttcatgaatatttttttctatagtgtgagacagctgccttgtgtgggactgagaggcaagakttgttcctgcccttccctttgtgacttgaagaaccctgactttgtttctgcaaaggcacctgcatgtgtctgtgttcgtgtaggcataatgtgaggaggt

SEQ ID NO: 24380 - DNA, 201 bp, Homo sapiens; identical to SEQ ID NO: 4529
  misc_feature (1)...(201): n = A,T,C or G, or insertion/deletion polymorphism (see Tables 1-2)

SEQ ID NO: 24381 - DNA, 201 bp, Homo sapiens; identical to SEQ ID NO: 4530

SEQ ID NO: 24382 - DNA, 201 bp, Homo sapiens
gcctacgacggcaaggattacatcgccttgaacgaggacctgcgctcttggaccgcggcggacatggcggctcagatcacccagcgcaagtgggaggcggyccgtgtggcggagcagttgagagcctacctggagggcacgtgcgtggagtggctccgcagatacctggagaacgggaaggagacgctgcagcgcacgggt

SEQ ID NO: 24383 - DNA, 201 bp, Homo sapiens; identical to SEQ ID NO: 4532

SEQ ID NO: 24384 - DNA, 201 bp, Homo sapiens; identical to SEQ ID NO: 4534

SEQ ID NO: 24385 - DNA, 201 bp, Homo sapiens
tacgacggcaaggattacatcgccttgaacgaggacctgcgctcttggaccgcggcggacatggcggctcagatcacccagcgcaagtgggaggcggcccrtgtggcggagcagttgagagcctacctggagggcacgtgcgtggagtggctccgcagatacctggagaacgggaaggagacgctgcagcgcacgggtacc

SEQ ID NO: 24386 - DNA, 201 bp, Homo sapiens
gaggtggggctgaggtgtctccatctctgtctcaacttcatggtgcactgagctgtaacttcttccttccctattaaaattagaacctgagtataaatttmctttctcaaattcttgccatgagaggttgatgagttaattaaaggagaagattcctaaaatttgagagacaaaataaatggaacacatgagaaccttcca

SEQ ID NO: 24387 - DNA, 201 bp, Homo sapiens
cgacggcaaggattacatcgccttgaacgaggacctgcgctcttggaccgcggcggacatggcggctcagatcacccagcgcaagtgggaggcggcccgtstggcggagcagttgagagcctacctggagggcacgtgcgtggagtggctccgcagatacctggagaacgggaaggagacgctgcagcgcacgggtaccag

SEQ ID NO: 24388 - DNA, 201 bp, Homo sapiens
gacggcaaggattacatcgccttgaacgaggacctgcgctcttggaccgcggcggacatggcggctcagatcacccagcgcaagtgggaggcggcccgtghggcggagcagttgagagcctacctggagggcacgtgcgtggagtggctccgcagatacctggagaacgggaaggagacgctgcagcgcacgggtaccagg

SEQ ID NO: 24389 - DNA, 201 bp, Homo sapiens
gccttgaacgaggacctgcgctcttggaccgcggcggacatggcggctcagatcacccagcgcaagtgggaggcggcccgtgtggcggagcagttgagagyctacctggagggcacgtgcgtggagtggctccgcagatacctggagaacgggaaggagacgctgcagcgcacgggtaccaggggccacggggcgcctccc

SEQ ID NO: 24390 - DNA, 201 bp, Homo sapiens
aaattagaacctgagtataaatttactttctcaaattcttgccatgagaggttgatgagttaattaaaggagaagattcctaaaatttgagagacaaaatwaatggaacacatgagaaccttccagagtccacgtgttgcttatgctgatttgttgcaggggaggagagtagatggggctgtgcccagtttctgttccggc

SEQ ID NO: 24391 - DNA, 201 bp, Homo sapiens
aggacctgcgctcttggaccgcggcggacatggcggctcagatcacccagcgcaagtgggaggcggcccgtgtggcggagcagttgagagcctacctggakggcacgtgcgtggagtggctccgcagatacctggagaacgggaaggagacgctgcagcgcacgggtaccaggggccacggggcgcctccctgatcgcctg

SEQ ID NO: 24392 - DNA, 201 bp, Homo sapiens
acctgagtataaatttactttctcaaattcttgccatgagaggttgatgagttaattaaaggagaagattcctaaaatttgagagacaaaataaatggaasacatgagaaccttccagagtccacgtgttgcttatgctgatttgttgcaggggaggagagtagatggggctgtgcccagtttctgttccggccaccatgg

SEQ ID NO: 24393 - DNA, 201 bp, Homo sapiens
tgtggcggagcagttgagagcctacctggagggcacgtgcgtggagtggctccgcagatacctggagaacgggaaggagacgctgcagcgcacgggtaccrggggccacggggcgcctccctgatcgcctgtagatctcccgggctggcctcccacaaggaggggagacaattgggaccaacactagaatatcgccctccc

SEQ ID NO: 24394 - DNA, 201 bp, Homo sapiens
gggtaccaggggccacggggcgcctccctgatcgcctgtagatctcccgggctggcctcccacaaggaggggagacaattgggaccaacactagaatatcrccctccctctggtcctgagggagaggaatcctcctgggtttccagatcctgtaccagagagtgactctgaggttccgccctgctctctgacacaattaag

SEQ ID NO: 24395 - DNA, 201 bp, Homo sapiens
ggagaggaatcctcctgggtttccagatcctgtaccagagagtgactctgaggttccgccctgctctctgacacaattaagggataaaatctctgaaggartgacgggaagacgatccctcgaatactgatgagtggttccctttgacacacacaggcagcagccttgggcccgtgacttttcctctcaggccttgttctc

SEQ ID NO: 24396 - DNA, 201 bp, Homo sapiens; identical to SEQ ID NO: 4435

SEQ ID NO: 24397 - DNA, 201 bp, Homo sapiens
tgcggtttgacagcgacgccgcgagccagaggatggagccgcgggcaccgtggatagagcaggaggggccggagtattgggacctgcagacacggaatgtsaaggcccagtcacagactgaccgagcgaacctggggaccctgcgcggctactacaaccagagcgaggccggtgagtgaccccggcccggggcgcaggtca

SEQ ID NO: 24398 - DNA, 201 bp, Homo sapiens
acagcgacgccgcgagccagaggatggagccgcgggcaccgtggatagagcaggaggggccggagtattgggacctgcagacacggaatgtgaaggcccastcacagactgaccgagcgaacctggggaccctgcgcggctactacaaccagagcgaggccggtgagtgaccccggcccggggcgcaggtcacgacctctc

SEQ ID NO: 24399 - DNA, 201 bp, Homo sapiens
cagcgacgccgcgagccagaggatggagccgcgggcaccgtggatagagcaggaggggccggagtattgggacctgcagacacggaatgtgaaggcccagkcacagactgaccgagcgaacctggggaccctgcgcggctactacaaccagagcgaggccggtgagtgaccccggcccggggcgcaggtcacgacctctca

SEQ ID NO: 24400 - DNA, 201 bp, Homo sapiens
gccgcgagccagaggatggagccgcgggcaccgtggatagagcaggaggggccggagtattgggacctgcagacacggaatgtgaaggcccagtcacagaytgaccgagcgaacctggggaccctgcgcggctactacaaccagagcgaggccggtgagtgaccccggcccggggcgcaggtcacgacctctcatccccca

SEQ ID NO: 24401 - DNA, 201 bp, Homo sapiens
cgcgagccagaggatggagccgcgggcaccgtggatagagcaggaggggccggagtattgggacctgcagacacggaatgtgaaggcccagtcacagactsaccgagcgaacctggggaccctgcgcggctactacaaccagagcgaggccggtgagtgaccccggcccggggcgcaggtcacgacctctcatcccccacg

SEQ ID NO: 24402 - DNA, 201 bp, Homo sapiens
cagaggatggagccgcgggcaccgtggatagagcaggaggggccggagtattgggacctgcagacacggaatgtgaaggcccagtcacagactgaccgaghgaacctggggaccctgcgcggctactacaaccagagcgaggccggtgagtgaccccggcccggggcgcaggtcacgacctctcatcccccacggacgggc

SEQ ID NO: 24403 - DNA, 201 bp, Homo sapiens
ggacgcaggacccgggtagccgcgccgggaggagggtcgggtgggtctcagccactcctcgcccccaggctcccactccatgaggtatttcaccacatccrtgtcccggcccggccgcggggagccccgcttcatcgccgtgggctacgtggacgacacgcagttcgtgcggtttgacagcgacgccgcgagccagaggat

SEQ ID NO: 24404 - DNA, 201 bp, Homo sapiens
gaatttgttcatgaatatttttttctatagtgtgagacagctgccttgtgtgggactgagaggcaagagttgttcctgcccttccctttgtgacttgaagwaccctgactttgtttctgcaaaggcacctgcatgtgtctgtgttcgtgtaggcataatgtgaggaggtggggagaccaccccacccccatgtccaccatg

SEQ ID NO: 24405 - DNA, 201 bp, Homo sapiens; identical to SEQ ID NO: 4564

SEQ ID NO: 24406 - DNA, 201 bp, Homo sapiens
cctgagtataaatttactttctcaaattcttgccatgagaggttgatgagttaattaaaggagaagattcctaaaatttgagagacaaaataaatggaacrcatgagaaccttccagagtccacgtgttgcttatgctgatttgttgcaggggaggagagtagatggggctgtgcccagtttctgttccggccaccatggg

SEQ ID NO: 24407 - DNA, 201 bp, Homo sapiens
cctgggcgggtgagtgcggggtcgtggggaaaccgcctctgcggggagaagcaaggggcccgcccggcggggacgcaggacccgggtagccgcgccgggasgagggtcgggtgggtctcagccactcctcgcccccaggctcccactccatgaggtatttcaccacatccgtgtcccggcccggccgcggggagccccgct

SEQ ID NO: 24408 - DNA, 201 bp, Homo sapiens
cacatgtgtgctggaggagtgtcccatgacagatgcaaaatgcctgaatgatctgactcttcctgacagacgcccccaaaacgcatatgactcaccacgcygtctctgaccatgaagccaccctgaggtgctgggccctgagcttctaccctgcggagatcacactgacctggcagcgggatggggaggaccagacccagg

SEQ ID NO: 24409 - DNA, 201 bp, Homo sapiens
tccgccctgctctctgacacaattaagggataaaatctctgaaggaatgacgggaagacgatccctcgaatactgatgagtggttccctttgacacacacmggcagcagccttgggcccgtgacttttcctctcaggccttgttctctgcttcacactcaatgtgtgtgggggtctgagtccagcacttctgagtccctca

SEQ ID NO: 24410 - DNA, 201 bp, Homo sapiens
cagtttaggccaaaaatccccccgggttggtcggggccggacggggctcgggggactgggctgaccgtggggtcggggccaggttctcacaccatccagakgatgtatggctgcgacgtggggtcggacgggcgcttcctccgcgggtaccggcaggacgcctacgacggcaaggattacatcgccttgaacgaggacctg

SEQ ID NO: 24411 - DNA, 201 bp, Homo sapiens
cacaggcagcagccttgggcccgtgacttttcctctcaggccttgttctctgcttcacactcaatgtgtgtgggggtctgagtccagcacttctgagtccytcagcctccactcaggtcaggaccagaagtcgctgttccctcttcagggactagaattttccacggaataggagattatcccaggtgcctgtgtccaggc

SEQ ID NO: 24412 - DNA, 201 bp, Homo sapiens
ggggtctgagtccagcacttctgagtccctcagcctccactcaggtcaggaccagaagtcgctgttccctcttcagggactagaattttccacggaatagragattatcccaggtgcctgtgtccaggctggtgtctgggttctgtgctcccttccccatcccaggtgtcctgtccattctcaagatagccacatgtgtgc

SEQ ID NO: 24413 - DNA, 201 bp, Homo sapiens
accagaagtcgctgttccctcttcagggactagaattttccacggaataggagattatcccaggtgcctgtgtccaggctggtgtctgggttctgtgctcycttccccatcccaggtgtcctgtccattctcaagatagccacatgtgtgctggaggagtgtcccatgacagatgcaaaatgcctgaatgatctgactctt

SEQ ID NO: 24414 - DNA, 201 bp, Homo sapiens
gttccctcttcagggactagaattttccacggaataggagattatcccaggtgcctgtgtccaggctggtgtctgggttctgtgctcccttccccatcccrggtgtcctgtccattctcaagatagccacatgtgtgctggaggagtgtcccatgacagatgcaaaatgcctgaatgatctgactcttcctgacagacgcc

SEQ ID NO: 24415 - DNA, 201 bp, Homo sapiens
ttctgtgctcccttccccatcccaggtgtcctgtccattctcaagatagccacatgtgtgctggaggagtgtcccatgacagatgcaaaatgcctgaatgwtctgactcttcctgacagacgcccccaaaacgcatatgactcaccacgctgtctctgaccatgaagccaccctgaggtgctgggccctgagcttctaccc

SEQ ID NO: 24416 - DNA, 201 bp, Homo sapiens
cctgtccattctcaagatagccacatgtgtgctggaggagtgtcccatgacagatgcaaaatgcctgaatgatctgactcttcctgacagacgcccccaaracgcatatgactcaccacgctgtctctgaccatgaagccaccctgaggtgctgggccctgagcttctaccctgcggagatcacactgacctggcagcggg

SEQ ID NO: 24417 - DNA, 201 bp, Homo sapiens
ggagtgtcccatgacagatgcaaaatgcctgaatgatctgactcttcctgacagacgcccccaaaacgcatatgactcaccacgctgtctctgaccatgargccaccctgaggtgctgggccctgagcttctaccctgcggagatcacactgacctggcagcgggatggggaggaccagacccaggacacggagctcgtgg

SEQ ID NO: 24418 - DNA, 201 bp, Homo sapiens
tcccatgacagatgcaaaatgcctgaatgatctgactcttcctgacagacgcccccaaaacgcatatgactcaccacgctgtctctgaccatgaagccacyctgaggtgctgggccctgagcttctaccctgcggagatcacactgacctggcagcgggatggggaggaccagacccaggacacggagctcgtggagacca

SEQ ID NO: 24419 - DNA, 201 bp, Homo sapiens
gaggatggagccgcgggcaccgtggatagagcaggaggggccggagtattgggacctgcagacacggaatgtgaaggcccagtcacagactgaccgagcgracctggggaccctgcgcggctactacaaccagagcgaggccggtgagtgaccccggcccggggcgcaggtcacgacctctcatcccccacggacgggccg

SEQ ID NO: 24420 - DNA, 201 bp, Homo sapiens
ggagccgcgggcaccgtggatagagcaggaggggccggagtattgggacctgcagacacggaatgtgaaggcccagtcacagactgaccgagcgaacctgsggaccctgcgcggctactacaaccagagcgaggccggtgagtgaccccggcccggggcgcaggtcacgacctctcatcccccacggacgggccgggtcgc

SEQ ID NO: 24421 - DNA, 201 bp, Homo sapiens
ccggagtattgggacctgcagacacggaatgtgaaggcccagtcacagactgaccgagcgaacctggggaccctgcgcggctactacaaccagagcgaggmcggtgagtgaccccggcccggggcgcaggtcacgacctctcatcccccacggacgggccgggtcgcccacagtctccgggtccgagatccaccccgaagc

SEQ ID NO: 24422 - DNA, 201 bp, Homo sapiens
cgacacgcagttcgtgcggtttgacagcgacgccgcgagccagaggatggagccgcgggcaccgtggatagagcaggaggggccggagtattgggacctgvagacacggaatgtgaaggcccagtcacagactgaccgagcgaacctggggaccctgcgcggctactacaaccagagcgaggccggtgagtgaccccggcc

SEQ ID NO: 24423 - DNA, 201 bp, Homo sapiens
tgaccgtggggtcggggccaggttctcacaccatccagatgatgtatggctgcgacgtggggtcggacgggcgcttcctccgcgggtaccggcaggacgcytacgacggcaaggattacatcgccttgaacgaggacctgcgctcttggaccgcggcggacatggcggctcagatcacccagcgcaagtgggaggcggccc

SEQ ID NO: 24424 - DNA, 201 bp, Homo sapiens; identical to SEQ ID NO: 4476

SEQ ID NO: 24425 - DNA, 201 bp, Homo sapiens; identical to SEQ ID NO: 4590

SEQ ID NO: 24426 - DNA, 201 bp, Homo sapiens; identical to SEQ ID NO: 4592

SEQ ID NO: 24427 - DNA, 201 bp, Homo sapiens
agctcttgggccaagactcagggagacattgagacagagcgcttggcacagaagcagaggggtcagggcgaagtcccagggccccaggcgtggctctcagrgtctcaggccccgaaggcggtgtatggattggggagtcccagccttggggattccccaactccgcagtttcttttctccctctcccaacctatgtagggt

SEQ ID NO: 24428 - DNA, 201 bp, Homo sapiens; identical to SEQ ID NO: 4595

SEQ ID NO: 24429 - DNA, 201 bp, Homo sapiens
gacagatgcaaaatgcctgaatgatctgactcttcctgacagacgcccccaaaacgcatatgactcaccacgctgtctctgaccatgaagccaccctgagrtgctgggccctgagcttctaccctgcggagatcacactgacctggcagcgggatggggaggaccagacccaggacacggagctcgtggagaccaggcctg

SEQ ID NO: 24430 - DNA, 201 bp, Homo sapiens
tgcctgaatgatctgactcttcctgacagacgcccccaaaacgcatatgactcaccacgctgtctctgaccatgaagccaccctgaggtgctgggccctgrgcttctaccctgcggagatcacactgacctggcagcgggatggggaggaccagacccaggacacggagctcgtggagaccaggcctgcaggggatggaac

SEQ ID NO: 24431 - DNA, 201 bp, Homo sapiens; identical to SEQ ID NO: 4492

SEQ ID NO: 24432 - DNA, 201 bp, Homo sapiens; identical to SEQ ID NO: 4494

SEQ ID NO: 24433 - DNA, 201 bp, Homo sapiens
ggactgggctgaccgtggggtcggggccaggttctcacaccatccagatgatgtatggctgcgacgtggggtcggacgggcgcttcctccgcgggtaccgscaggacgcctacgacggcaaggattacatcgccttgaacgaggacctgcgctcttggaccgcggcggacatggcggctcagatcacccagcgcaagtggg

SEQ ID NO: 24434 - DNA, 201 bp, Homo sapiens
gagatcacactgacctggcagcgggatggggaggaccagacccaggacacggagctcgtggagaccaggcctgcaggggatggaaccttccagaagtgggyggctgtggtggtgccttctggacaggagcagagatacacctgccatgtgcagcatgagggtttgcccaagcccctcaccctgagatggggtaaggaggga

SEQ ID NO: 24435 - DNA, 201 bp, Homo sapiens
gatcacactgacctggcagcgggatggggaggaccagacccaggacacggagctcgtggagaccaggcctgcaggggatggaaccttccagaagtgggcgkctgtggtggtgccttctggacaggagcagagatacacctgccatgtgcagcatgagggtttgcccaagcccctcaccctgagatggggtaaggagggaga

SEQ ID NO: 24436 - DNA, 201 bp, Homo sapiens
accgcctctgcggggagaagcaaggggcccgcccggcggggacgcaggacccgggtagccgcgccgggaggagggtcgggtgggtctcagccactcctcgyccccaggctcccactccatgaggtatttcaccacatccgtgtcccggcccggccgcggggagccccgcttcatcgccgtgggctacgtggacgacacgca

SEQ ID NO: 24437 - DNA, 201 bp, Homo sapiens
gggaaaccgcctctgcggggagaagcaaggggcccgcccggcggggacgcaggacccgggtagccgcgccgggaggagggtcgggtgggtctcagccactsctcgcccccaggctcccactccatgaggtatttcaccacatccgtgtcccggcccggccgcggggagccccgcttcatcgccgtgggctacgtggacgac

SEQ ID NO: 24438 - DNA, 201 bp, Homo sapiens
cctggcagcgggatggggaggaccagacccaggacacggagctcgtggagaccaggcctgcaggggatggaaccttccagaagtgggcggctgtggtggtrccttctggacaggagcagagatacacctgccatgtgcagcatgagggtttgcccaagcccctcaccctgagatggggtaaggagggagacgggggtgtca

SEQ ID NO: 24439 - DNA, 201 bp, Homo sapiens
tcagggcccctcaccttcccctcttttcccagagccgtcttcccagcccaccatccccatcgtgggcatcattgctggcctggttctctttggagctgtgwtcactggagctgtggtcgctgctgtgaggtggaggaggaagagctcaggtggggaagggatgaagggtgggtctgagatttcttgtctcactgagggttc

SEQ ID NO: 24440 - DNA, 201 bp, Homo sapiens
ggatggggaggaccagacccaggacacggagctcgtggagaccaggcctgcaggggatggaaccttccagaagtgggcggctgtggtggtgccttctggavaggagcagagatacacctgccatgtgcagcatgagggtttgcccaagcccctcaccctgagatggggtaaggagggagacgggggtgtcatgtcttttag

SEQ ID NO: 24441 - DNA, 201 bp, Homo sapiens
ggaggaccagacccaggacacggagctcgtggagaccaggcctgcaggggatggaaccttccagaagtgggcggctgtggtggtgccttctggacaggagmagagatacacctgccatgtgcagcatgagggtttgcccaagcccctcaccctgagatggggtaaggagggagacgggggtgtcatgtcttttagggaaag

SEQ ID NO: 24442 - DNA, 201 bp, Homo sapiens
agtgcggggtcgtggggaaaccgcctctgcggggagaagcaaggggcccgcccggcggggacgcaggacccgggtagccgcgccgggaggagggtcgggtrggtctcagccactcctcgcccccaggctcccactccatgaggtatttcaccacatccgtgtcccggcccggccgcggggagccccgcttcatcgccgtgg

SEQ ID NO: 24443 - DNA, 201 bp, Homo sapiens
cagacctgggcgggtgagtgcggggtcgtggggaaaccgcctctgcggggagaagcaaggggcccgcccggcggggacgcaggacccgggtagccgcgcckggaggagggtcgggtgggtctcagccactcctcgcccccaggctcccactccatgaggtatttcaccacatccgtgtcccggcccggccgcggggagccc

SEQ ID NO: 24444 - DNA, 201 bp, Homo sapiens
ggccctgacccagacctgggcgggtgagtgcggggtcgtggggaaaccgcctctgcggggagaagcaaggggcccgcccggcggggacgcaggacccgggdagccgcgccgggaggagggtcgggtgggtctcagccactcctcgcccccaggctcccactccatgaggtatttcaccacatccgtgtcccggcccggccg

SEQ ID NO: 24445 - DNA, 201 bp, Homo sapiens; identical to SEQ ID NO: 4527

SEQ ID NO: 24446 - DNA, 201 bp, Homo sapiens
atgaaaagtgaaaggagagggacggggcccatgccgagggtttctcccttgtttctcagacagctcttgggccaagactcagggagacattgagacagagmgcttggcacagaagcagaggggtcagggcgaagtcccagggccccaggcgtggctctcagggtctcaggccccgaaggcggtgtatggattggggagtcc

SEQ ID NO: 24447 - DNA, 201 bp, Homo sapiens
aggagagggacggggcccatgccgagggtttctcccttgtttctcagacagctcttgggccaagactcagggagacattgagacagagcgcttggcacagragcagaggggtcagggcgaagtcccagggccccaggcgtggctctcagggtctcaggccccgaaggcggtgtatggattggggagtcccagccttgggga

SEQ ID NO: 24448 - DNA, 201 bp, Homo sapiens
aaggagggagacgggggtgtcatgtcttttagggaaagcaggagcctctctgacctttagcagggtcagggcccctcaccttcccctcttttcccagagcygtcttcccagcccaccatccccatcgtgggcatcattgctggcctggttctctttggagctgtgatcactggagctgtggtcgctgctgtgaggtggagg

SEQ ID NO: 24449 - DNA, 201 bp, Homo sapiens
acagatatgaatttgttcatgaatatttttttctatagtgtgagacagctgccttgtgtgggactgagaggcaagagttgttcctgcccttccctttgtgrcttgaagaaccctgactttgtttctgcaaaggcacctgcatgtgtctgtgttcgtgtaggcataatgtgaggaggtggggagaccaccccacccccatgt

SEQ ID NO: 24450 - DNA, 201 bp, Homo sapiens
ccctggccctgacccagacctgggcgggtgagtgcggggtcgtggggaaaccgcctctgcggggagaagcaaggggcccgcccggcggggacgcaggaccsgggtagccgcgccgggaggagggtcgggtgggtctcagccactcctcgcccccaggctcccactccatgaggtatttcaccacatccgtgtcccggcccg

SEQ ID NO: 24451 - DNA, 201 bp, Homo sapiens
tcctgctactcttgggggccctggccctgacccagacctgggcgggtgagtgcggggtcgtggggaaaccgcctctgcggggagaagcaaggggcccgccyggcggggacgcaggacccgggtagccgcgccgggaggagggtcgggtgggtctcagccactcctcgcccccaggctcccactccatgaggtatttcacca

SEQ ID NO: 24452 - DNA, 201 bp, Homo sapiens
tcctcctgctactcttgggggccctggccctgacccagacctgggcgggtgagtgcggggtcgtggggaaaccgcctctgcggggagaagcaaggggccckcccggcggggacgcaggacccgggtagccgcgccgggaggagggtcgggtgggtctcagccactcctcgcccccaggctcccactccatgaggtatttca

SEQ ID NO: 24453 - DNA, 201 bp, Homo sapiens
tgtcatgtcttttagggaaagcaggagcctctctgacctttagcagggtcagggcccctcaccttcccctcttttcccagagccgtcttcccagcccaccrtccccatcgtgggcatcattgctggcctggttctctttggagctgtgatcactggagctgtggtcgctgctgtgaggtggaggaggaagagctcaggtgg

SEQ ID NO: 24454 - DNA, 201 bp, Homo sapiens
tctctgacctttagcagggtcagggcccctcaccttcccctcttttcccagagccgtcttcccagcccaccatccccatcgtgggcatcattgctggcctrgttctctttggagctgtgatcactggagctgtggtcgctgctgtgaggtggaggaggaagagctcaggtggggaagggatgaagggtgggtctgagattt

SEQ ID NO: 24455 - DNA, 201 bp, Homo sapiens
gggactcagattctccccagacgccgaggatggccgtcatggcgccccgaaccctcctcctgctactcttgggggccctggccctgacccagacctgggcrggtgagtgcggggtcgtggggaaaccgcctctgcggggagaagcaaggggcccgcccggcggggacgcaggacccgggtagccgcgccgggaggagggtc

SEQ ID NO: 24456 - DNA, 201 bp, Homo sapiens
gggtcagggcccctcaccttcccctcttttcccagagccgtcttcccagcccaccatccccatcgtgggcatcattgctggcctggttctctttggagctrtgatcactggagctgtggtcgctgctgtgaggtggaggaggaagagctcaggtggggaagggatgaagggtgggtctgagatttcttgtctcactgaggg

SEQ ID NO: 24457 - DNA, 201 bp, Homo sapiens
ggggagaagcaaggggcccgcccggcggggacgcaggacccgggtagccgcgccgggaggagggtcgggtgggtctcagccactcctcgcccccaggctcycactccatgaggtatttcaccacatccgtgtcccggcccggccgcggggagccccgcttcatcgccgtgggctacgtggacgacacgcagttcgtgcggt

SEQ ID NO: 24458 - DNA, 201 bp, Homo sapiens
gggcccctcaccttcccctcttttcccagagccgtcttcccagcccaccatccccatcgtgggcatcattgctggcctggttctctttggagctgtgatcrctggagctgtggtcgctgctgtgaggtggaggaggaagagctcaggtggggaagggatgaagggtgggtctgagatttcttgtctcactgagggttccaa

SEQ ID NO: 24459 - DNA, 201 bp, Homo sapiens; identical to SEQ ID NO: 4450

SEQ ID NO: 24460 - DNA, 201 bp, Homo sapiens
ttctaaagtccgcacgcacccaccgggactcagattctccccagacgccgaggatggccgtcatggcgccccgaaccctcctcctgctactcttgggggcyctggccctgacccagacctgggcgggtgagtgcggggtcgtggggaaaccgcctctgcggggagaagcaaggggcccgcccggcggggacgcaggacccg

SEQ ID NO: 24461 - DNA, 201 bp, Homo sapiens; identical to SEQ ID NO: 4453

SEQ ID NO: 24462 - DNA, 201 bp, Homo sapiens
ggtggggaagggatgaagggtgggtctgagatttcttgtctcactgagggttccaagacccaggtagaagtgtgccctgcctcgttactgggaagcaccayccacaattatgggcctacccagcctgggccctgtgtgccagcacttactcttttgtaaagcacctgttaaaatgaaggacagatttatcaccttgattac

SEQ ID NO: 24463 - DNA, 201 bp, Homo sapiens
cgggtttccagagaagccaatcagtgtcgtcgcggtcgcggttctaaagtccgcacgcacccaccgggactcagattctccccagacgccgaggatggccrtcatggcgccccgaaccctcctcctgctactcttgggggccctggccctgacccagacctgggcgggtgagtgcggggtcgtggggaaaccgcctctgcg

SEQ ID NO: 24464 - DNA, 201 bp, Homo sapiens
gcccggcggggacgcaggacccgggtagccgcgccgggaggagggtcgggtgggtctcagccactcctcgcccccaggctcccactccatgaggtatttcwccacatccgtgtcccggcccggccgcggggagccccgcttcatcgccgtgggctacgtggacgacacgcagttcgtgcggtttgacagcgacgccgcgag

SEQ ID NO: 24465 - DNA, 201 bp, Homo sapiens
ccacaattatgggcctacccagcctgggccctgtgtgccagcacttactcttttgtaaagcacctgttaaaatgaaggacagatttatcaccttgattacrgcggtgatgggacctgatcccagcagtcacaagtcacaggggaaggtccctgaggaccttcaggagggcggttggtccaggacccacacctgctttcttc

SEQ ID NO: 24466 - DNA, 201 bp, Homo sapiens
gtagccgcgccgggaggagggtcgggtgggtctcagccactcctcgcccccaggctcccactccatgaggtatttcaccacatccgtgtcccggcccggcmgcggggagccccgcttcatcgccgtgggctacgtggacgacacgcagttcgtgcggtttgacagcgacgccgcgagccagaggatggagccgcgggcacc

SEQ ID NO: 24467 - DNA, 201 bp, Homo sapiens
tccagagaagccaatcagtgtcgtcgcggtcgcggttctaaagtccgcacgcacccaccgggactcagattctccccagacgccgaggatggccgtcatgscgccccgaaccctcctcctgctactcttgggggccctggccctgacccagacctgggcgggtgagtgcggggtcgtggggaaaccgcctctgcggggaga

SEQ ID NO: 24468 - DNA, 201 bp, Homo sapiens
cagagaagccaatcagtgtcgtcgcggtcgcggttctaaagtccgcacgcacccaccgggactcagattctccccagacgccgaggatggccgtcatggckccccgaaccctcctcctgctactcttgggggccctggccctgacccagacctgggcgggtgagtgcggggtcgtggggaaaccgcctctgcggggagaag

SEQ ID NO: 24469 - DNA, 201 bp, Homo sapiens
gttctaaagtccgcacgcacccaccgggactcagattctccccagacgccgaggatggccgtcatggcgccccgaaccctcctcctgctactcttgggggycctggccctgacccagacctgggcgggtgagtgcggggtcgtggggaaaccgcctctgcggggagaagcaaggggcccgcccggcggggacgcaggaccc

SEQ ID NO: 24470 - DNA, 201 bp, Homo sapiens
gggttggtcggggccggacggggctcgggggactgggctgaccgtggggtcggggccaggttctcacaccatccagatgatgtatggctgcgacgtggggycggacgggcgcttcctccgcgggtaccggcaggacgcctacgacggcaaggattacatcgccttgaacgaggacctgcgctcttggaccgcggcggacat

SEQ ID NO: 24471 - DNA, 201 bp, Homo sapiens
gtccattctcaagatagccacatgtgtgctggaggagtgtcccatgacagatgcaaaatgcctgaatgatctgactcttcctgacagacgcccccaaaacrcatatgactcaccacgctgtctctgaccatgaagccaccctgaggtgctgggccctgagcttctaccctgcggagatcacactgacctggcagcgggatg

SEQ ID NO: 24472 - DNA, 201 bp, Homo sapiens
caagatagccacatgtgtgctggaggagtgtcccatgacagatgcaaaatgcctgaatgatctgactcttcctgacagacgcccccaaaacgcatatgacycaccacgctgtctctgaccatgaagccaccctgaggtgctgggccctgagcttctaccctgcggagatcacactgacctggcagcgggatggggaggacc

SEQ ID NO: 24473 - DNA, 201 bp, Homo sapiens
acatgtgtgctggaggagtgtcccatgacagatgcaaaatgcctgaatgatctgactcttcctgacagacgcccccaaaacgcatatgactcaccacgctrtctctgaccatgaagccaccctgaggtgctgggccctgagcttctaccctgcggagatcacactgacctggcagcgggatggggaggaccagacccagga

SEQ ID NO: 24474 - DNA, 201 bp, Homo sapiens
cagtgtcgtcgcggtcgcggttctaaagtccgcacgcacccaccgggactcagattctccccagacgccgaggatggccgtcatggcgccccgaaccctcstcctgctactcttgggggccctggccctgacccagacctgggcgggtgagtgcggggtcgtggggaaaccgcctctgcggggagaagcaaggggcccgcc

SEQ ID NO: 24475 - DNA, 201 bp, Homo sapiens
cgaaccctcctcctgctactcttgggggccctggccctgacccagacctgggcgggtgagtgcggggtcgtggggaaaccgcctctgcggggagaagcaasgggcccgcccggcggggacgcaggacccgggtagccgcgccgggaggagggtcgggtgggtctcagccactcctcgcccccaggctcccactccatgagg

SEQ ID NO: 24476 - DNA, 201 bp, Homo sapiens
cgtcatggcgccccgaaccctcctcctgctactcttgggggccctggccctgacccagacctgggcgggtgagtgcggggtcgtggggaaaccgcctctgyggggagaagcaaggggcccgcccggcggggacgcaggacccgggtagccgcgccgggaggagggtcgggtgggtctcagccactcctcgcccccaggctc

SEQ ID NO: 24477 - DNA, 201 bp, Homo sapiens
cccggcggggacgcaggacccgggtagccgcgccgggaggagggtcgggtgggtctcagccactcctcgcccccaggctcccactccatgaggtatttcahcacatccgtgtcccggcccggccgcggggagccccgcttcatcgccgtgggctacgtggacgacacgcagttcgtgcggtttgacagcgacgccgcgagc

SEQ ID NO: 24478 - DNA, 201 bp, Homo sapiens
gcggggacgcaggacccgggtagccgcgccgggaggagggtcgggtgggtctcagccactcctcgcccccaggctcccactccatgaggtatttcaccacmtccgtgtcccggcccggccgcggggagccccgcttcatcgccgtgggctacgtggacgacacgcagttcgtgcggtttgacagcgacgccgcgagccaga

SEQ ID NO: 24479 - DNA, 201 bp, Homo sapiens
agtttaggccaaaaatccccccgggttggtcggggccggacggggctcgggggactgggctgaccgtggggtcggggccaggttctcacaccatccagatratgtatggctgcgacgtggggtcggacgggcgcttcctccgcgggtaccggcaggacgcctacgacggcaaggattacatcgccttgaacgaggacctgc

SEQ ID NO: 24480 - DNA, 201 bp, Homo sapiens
ttcatgtttcctgatcccgccctgggtctgcagtcacacatttctggaaacttctctgaggtccaagacttggaggttcctctaggaccttaaggccctgrctcctttctggtatctcacaggacattttcttcccacagatagaaaaggagggagctactctcaggctgcaagtaagtatgaaggaggctgatgcctgag

SEQ ID NO: 24481 - DNA, 201 bp, Homo sapiens
aggccaaaaatccccccgggttggtcggggccggacggggctcgggggactgggctgaccgtggggtcggggccaggttctcacaccatccagatgatgtwtggctgcgacgtggggtcggacgggcgcttcctccgcgggtaccggcaggacgcctacgacggcaaggattacatcgccttgaacgaggacctgcgctct

SEQ ID NO: 24482 - DNA, 201 bp, Homo sapiens
cacacatttctggaaacttctctgaggtccaagacttggaggttcctctaggaccttaaggccctgactcctttctggtatctcacaggacattttcttcycacagatagaaaaggagggagctactctcaggctgcaagtaagtatgaaggaggctgatgcctgaggtccttgggatattgtgtttgggagcccatgggg

SEQ ID NO: 24483 - DNA, 201 bp, Homo sapiens
agccgcgccgggaggagggtcgggtgggtctcagccactcctcgcccccaggctcccactccatgaggtatttcaccacatccgtgtcccggcccggccgyggggagccccgcttcatcgccgtgggctacgtggacgacacgcagttcgtgcggtttgacagcgacgccgcgagccagaggatggagccgcgggcaccgt

SEQ ID NO: 24484 - DNA, 201 bp, Homo sapiens
tcttcccacagatagaaaaggagggagctactctcaggctgcaagtaagtatgaaggaggctgatgcctgaggtccttgggatattgtgtttgggagcccrtgggggagctcacccaccccacaattcctcctctagccacatcttctgtgggatctgaccaggttctgtttttgttctaccccaggcagtgacagtgccc

SEQ ID NO: 24485 - DNA, 201 bp, Homo sapiens
gccacatgtgtgctggaggagtgtcccatgacagatgcaaaatgcctgaatgatctgactcttcctgacagacgcccccaaaacgcatatgactcaccacsctgtctctgaccatgaagccaccctgaggtgctgggccctgagcttctaccctgcggagatcacactgacctggcagcgggatggggaggaccagaccca

SEQ ID NO: 24486 - DNA, 201 bp, Homo sapiens
gatagaaaaggagggagctactctcaggctgcaagtaagtatgaaggaggctgatgcctgaggtccttgggatattgtgtttgggagcccatgggggagcycacccaccccacaattcctcctctagccacatcttctgtgggatctgaccaggttctgtttttgttctaccccaggcagtgacagtgcccagggctctga

SEQ ID NO: 24487 - DNA, 201 bp, Homo sapiens
ggagggagctactctcaggctgcaagtaagtatgaaggaggctgatgcctgaggtccttgggatattgtgtttgggagcccatgggggagctcacccaccycacaattcctcctctagccacatcttctgtgggatctgaccaggttctgtttttgttctaccccaggcagtgacagtgcccagggctctgatgtgtctct

SEQ ID NO: 24488 - DNA, 201 bp, Homo sapiens
gaccaggcctgcaggggatggaaccttccagaagtgggcggctgtggtggtgccttctggacaggagcagagatacacctgccatgtgcagcatgagggtytgcccaagcccctcaccctgagatggggtaaggagggagacgggggtgtcatgtcttttagggaaagcaggagcctctctgacctttagcagggtcaggg

SEQ ID NO: 24489 - DNA, 201 bp, Homo sapiens
ctcgcccccaggctcccactccatgaggtatttcaccacatccgtgtcccggcccggccgcggggagccccgcttcatcgccgtgggctacgtggacgacwcgcagttcgtgcggtttgacagcgacgccgcgagccagaggatggagccgcgggcaccgtggatagagcaggaggggccggagtattgggacctgcagac

SEQ ID NO: 24490 - DNA, 201 bp, Homo sapiens; identical to SEQ ID NO: 4485

SEQ ID NO: 24491 - DNA, 201 bp, Homo sapiens; identical to SEQ ID NO: 4488

SEQ ID NO: 24492 - DNA, 201 bp, Homo sapiens; identical to SEQ ID NO: 4491

SEQ ID NO: 24493 - DNA, 201 bp, Homo sapiens
gggtgggtctcagccactcctcgcccccaggctcccactccatgaggtatttcaccacatccgtgtcccggcccggccgcggggagccccgcttcatcgcmgtgggctacgtggacgacacgcagttcgtgcggtttgacagcgacgccgcgagccagaggatggagccgcgggcaccgtggatagagcaggaggggccgg

SEQ ID NO: 24494 - DNA, 201 bp, Homo sapiens
acacaggcagcagccttgggcccgtgacttttcctctcaggccttgttctctgcttcacactcaatgtgtgtgggggtctgagtccagcacttctgagtcyctcagcctccactcaggtcaggaccagaagtcgctgttccctcttcagggactagaattttccacggaataggagattatcccaggtgcctgtgtccagg

SEQ ID NO: 24495 - DNA, 201 bp, Homo sapiens; identical to SEQ ID NO: 4498

SEQ ID NO: 24496 - DNA, 201 bp, Homo sapiens; identical to SEQ ID NO: 4500

SEQ ID NO: 24497 - DNA, 201 bp, Homo sapiens; identical to SEQ ID NO: 4501

SEQ ID NO: 24498 - DNA, 201 bp, Homo sapiens
ggacgacacgcagttcgtgcggtttgacagcgacgccgcgagccagaggatggagccgcgggcaccgtggatagagcaggaggggccggagtattgggacstgcagacacggaatgtgaaggcccagtcacagactgaccgagcgaacctggggaccctgcgcggctactacaaccagagcgaggccggtgagtgaccccg

SEQ ID NO: 24499 - DNA, 201 bp, Homo sapiens
gtcgcggttctaaagtccgcacgcacccaccgggactcagattctccccagacgccgaggatggccgtcatggcgccccgaaccctcctcctgctactctygggggccctggccctgacccagacctgggcgggtgagtgcggggtcgtggggaaaccgcctctgcggggagaagcaaggggcccgcccggcggggacgca

SEQ ID NO: 24500 - DNA, 201 bp, Homo sapiens
aggatggccgtcatggcgccccgaaccctcctcctgctactcttgggggccctggccctgacccagacctgggcgggtgagtgcggggtcgtggggaaacsgcctctgcggggagaagcaaggggcccgcccggcggggacgcaggacccgggtagccgcgccgggaggagggtcgggtgggtctcagccactcctcgccc

SEQ ID NO: 24501 - DNA, 201 bp, Homo sapiens
tgggctgaccgtggggtcggggccaggttctcacaccatccagatgatgtatggctgcgacgtggggtcggacgggcgcttcctccgcgggtaccggcagkacgcctacgacggcaaggattacatcgccttgaacgaggacctgcgctcttggaccgcggcggacatggcggctcagatcacccagcgcaagtgggaggc

SEQ ID NO: 24502 - DNA, 201 bp, Homo sapiens
cgcgccgggaggagggtcgggtgggtctcagccactcctcgcccccaggctcccactccatgaggtatttcaccacatccgtgtcccggcccggccgcggrgagccccgcttcatcgccgtgggctacgtggacgacacgcagttcgtgcggtttgacagcgacgccgcgagccagaggatggagccgcgggcaccgtgga

SEQ ID NO: 24503 - DNA, 201 bp, Homo sapiens
ttgggatattgtgtttgggagcccatgggggagctcacccaccccacaattcctcctctagccacatcttctgtgggatctgaccaggttctgtttttgtyctaccccaggcagtgacagtgcccagggctctgatgtgtctctcacagcttgtaaaggtgagagcttggagggcctgatgtgtgttgggtgttgggcgga

SEQ ID NO: 24504 - DNA, 201 bp, Homo sapiens
acccaccccacaattcctcctctagccacatcttctgtgggatctgaccaggttctgtttttgttctaccccaggcagtgacagtgcccagggctctgatrtgtctctcacagcttgtaaaggtgagagcttggagggcctgatgtgtgttgggtgttgggcggaacagtggacacagctgtgctatggggtttctttgca

SEQ ID NO: 24505 - DNA, 201 bp, Homo sapiens
attccccagtgcttaactcttcctcccttctccacagcttcctaaccaagcgaagccggcaggtctgtgctgaccccagtgaggagtgggtccagaaataygtcagcgacctggagctgagtgcctgaggggtccagaagcttcgaggcccagcgacctcggtgggcccagtggggaggagcaggagcctgagccttggga

SEQ ID NO: 24506 - DNA, 201 bp, Homo sapiens
ggctgcttacttcccagtggggtatgttgttcactctccagctcactctaggtctcccaggagctctgtcccttggatgtcttatgagagatgtccaaggyttctcttgggttggggtatgacttcttgaaccagacaaaattccctgaagagaactgagataagagaacagtccgttcaggtatctggatcacacagaga

SEQ ID NO: 24507 - DNA, 201 bp, Homo sapiens
caaatgccttccagtcacttggtctgagcaagcctgccttcctcaactgctcggggatcagaagctgcctggccttttcttctgagctgtgactcgggctyattctcttcctttctccacagttgctgctgacacgccgaccgcctgctgcttcagctacacctcccggcagattccacagaatttcatagctgactactt

SEQ ID NO: 24508 - DNA, 201 bp, Homo sapiens; identical to SEQ ID NO: 4671

SEQ ID NO: 24509 - DNA, 201 bp, Homo sapiens; identical to SEQ ID NO: 4672

SEQ ID NO: 24510 - DNA, 201 bp, Homo sapiens
ctggccttttcttctgagctgtgactcgggctcattctcttcctttctccacagttgctgctgacacgccgaccgcctgctgcttcagctacacctcccgrcagattccacagaatttcatagctgactactttgagacgagcagccagtgctccaagcccggtgtcatgtaagtgccagtcttcctgctcacctctatgg

SEQ ID NO: 24511 - DNA, 201 bp, Homo sapiens
acagagagcagaatggtggggccatggtgggcccaggattcccctgctggattccccagtgcttaactcttcctcccttctccacagcttcctaaccaagmgaagccggcaggtctgtgctgaccccagtgaggagtgggtccagaaatatgtcagcgacctggagctgagtgcctgaggggtccagaagcttcgaggccc

SEQ ID NO: 24512 - DNA, 201 bp, Homo sapiens
ttaccccattctttaacagatgatactttatccattgcaaccacttcctgtcaggattctgagttgacatagagtgtttgagcagtgattgttgaagccamttaaataggatctttaagtgtagacctgggaactgatatttttatcaagctcatgaggtgttccatagcatgttaatgactgagagccactgtcaataga

SEQ ID NO: 24513 - DNA, 201 bp, Homo sapiens
cccattctttaacagatgatactttatccattgcaaccacttcctgtcaggattctgagttgacatagagtgtttgagcagtgattgttgaagccacttamataggatctttaagtgtagacctgggaactgatatttttatcaagctcatgaggtgttccatagcatgttaatgactgagagccactgtcaatagaattc

SEQ ID NO: 24514 - DNA, 201 bp, Homo sapiens; identical to SEQ ID NO: 4678

SEQ ID NO: 24515 - DNA, 201 bp, Homo sapiens
ttttagagttataaacgatgctgggtcaggtatctttatgtttgaagatggctccatatttgggttgtttccacagaactctttcctagaaatgctttttstaggttaatggctacagatatttctaggcacctgacatattgacacccacctctaaagtatttttatgatccacaactagcgtttaacacagcgccctag

SEQ ID NO: 24516 - DNA, 201 bp, Homo sapiens
acagagactgatttgagctttagcaaaattatgttggatgctgtgtggtgggatagattaaaaagagacaaaactaggccaggcgtggtgactcactcctrtaatcaatcccagcactttgggaggccgaagcaggcagatcacttgaggccaggagttcaagaccagcctggccaacatggtgaaaccccatctccacga

SEQ ID NO: 24517 - DNA, 201 bp, Homo sapiens
ggcagcagacagtggtcagtcctttcttggctctgctgacactcgagcccacattccgtcacctgctcagaatcatgcaggtctccactgctgcccttgcygtcctcctctgcaccatggctctctgcaaccagttctctgcatcacgtgagtctgagtttcgttgtgggtatcaccactctctggccatggttagaccac

SEQ ID NO: 24518 - DNA, 201 bp, Homo sapiens
atgctgtgcatgtaactatatttcaatccaagcaaaacacatggcaaagggatagttcctggtttggggattgatagagaaagtcttacaaatatataaamactgagatagaattatatattcaataaatcatctttattataaagaacacaataataagagatagagactaggtcacgaggctcatcatgttaaaatcat

SEQ ID NO: 24519 - DNA, 201 bp, Homo sapiens
tataaacactgagatagaattatatattcaataaatcatctttattataaagaacacaataataagagatagagactaggtcacgaggctcatcatgttawaatcatcatgtgctaggatttggtttaaatcaaccaacaagacatggtctggagttggtttacaatctgagaagacactctaaaaaatctaccattatag

SEQ ID NO: 24520 - DNA, 201 bp, Homo sapiens
tcttgagaaaaagaaactaaaataaaatcaacagggcatggtctagatttttgaagagcaaattacatagataactaattataacacacggtgctgtaatsacagagatagaagatgtcccttatcagaacactgactgattcagcagtttccatttccttttctcactctccacaactcacagaagccagctctcagaaa

SEQ ID NO: 24521 - DNA, 201 bp, Homo sapiens; identical to SEQ ID NO: 4683

SEQ ID NO: 24522 - DNA, 201 bp, Homo sapiens
aaaatatgactacagagctttagtgagaaggaagtagctaagtgtggtctggggtaacaccaatatctcacctcctgttgctgtggaaaccacttccccayaaacagccccaagacaagtgagcacttgaactgttcctgcaaataccctgagccctgtggttacccaagacccccttgcatgtgcaagtcaacaagacac

SEQ ID NO: 24523 - DNA, 201 bp, Homo sapiens
ggagttacagtcccttttacagatagaaaaacagggttcgaaacgaatcagttagcaagaggcagaatccagggctgcttacttcccagtggggtatgttsttcactctccagctcactctaggtctcccaggagctctgtcccttggatgtcttatgagagatgtccaaggcttctcttgggttggggtatgacttcttg

SEQ ID NO: 24524 - DNA, 201 bp, Homo sapiens
atgtgtatcggatgcttttgttcagggctgtgatcggcctggggaaataataaagatgctcttttaaaaggtaaaccagtattgagtttggttttgttttyctggcaaatcaaaatcactggttaagaggaatcataggcaaagattaggaagaggtgaaatggagggaaattgggagagatggggagggctaccacagag

SEQ ID NO: 24525 - DNA, 201 bp, Homo sapiens
gctgtactctcatcgctcagtagctcaggctttgctaatacagctctgtccatctgtgtgtgattgaagttgggctgtgctgctcaggactcctggcatcrttgcataagtcaagtctacaccgttagaacagctgtgggataacagagaagtttctgctctgccagggaaaatatgactacagagctttagtgagaagga

SEQ ID NO: 24526 - DNA, 201 bp, Homo sapiens
tagctcaggctttgctaatacagctctgtccatctgtgtgtgattgaagttgggctgtgctgctcaggactcctggcatcattgcataagtcaagtctacrccgttagaacagctgtgggataacagagaagtttctgctctgccagggaaaatatgactacagagctttagtgagaaggaagtagctaagtgtggtctgg

SEQ ID NO: 24527 - DNA, 201 bp, Homo sapiens
ctgacacgccgaccgcctgctgcttcagctacacctcccggcagattccacagaatttcatagctgactactttgagacgagcagccagtgctccaagccyggtgtcatgtaagtgccagtcttcctgctcacctctatggaggtagggagggtcagggttggggcagagacaggccagaaggctatcctggaaaggccca

SEQ ID NO: 24528 - DNA, 201 bp, Homo sapiens
gccagtgctccaagcccggtgtcatgtaagtgccagtcttcctgctcacctctatggaggtagggagggtcagggttggggcagagacaggccagaaggcyatcctggaaaggcccagccttcaggagcctatcggggatacaggacgcagggctccgaggtgtgacctgacttggagctggagtgaggcatgtgttacag

SEQ ID NO: 24529 - DNA, 201 bp, Homo sapiens
ttaactcttcctcccttctccacagcttcctaaccaagcgaagccggcaggtctgtgctgaccccagtgaggagtgggtccagaaatatgtcagcgacctrgagctgagtgcctgaggggtccagaagcttcgaggcccagcgacctcggtgggcccagtggggaggagcaggagcctgagccttgggaacatgcgtgtga

SEQ ID NO: 24530 - DNA, 201 bp, Homo sapiens
gaagggctgccccagcccagaggaaagggacaggaagaaggaggcagcgggacactctgagggccacccctactgagtcactgagagaagctctctagacrgagataggcagggggcccctgaaagaggagcaagccctgagctgcccaggacagagagcagaatggtggggccatggtgggcccaggattcccctgctgg

SEQ ID NO: 24531 - DNA, 201 bp, Homo sapiens; identical to SEQ ID NO: 4669

SEQ ID NO: 24532 - DNA, 201 bp, Homo sapiens; identical to SEQ ID NO: 4670

SEQ ID NO: 24533 - DNA, 201 bp, Homo sapiens; identical to SEQ ID NO: 4673

SEQ ID NO: 24534 - DNA, 201 bp, Homo sapiens; identical to SEQ ID NO: 4674

SEQ ID NO: 24535 - DNA, 201 bp, Homo sapiens
cagtgcttaactcttcctcccttctccacagcttcctaaccaagcgaagccggcaggtctgtgctgaccccagtgaggagtgggtccagaaatatgtcagygacctggagctgagtgcctgaggggtccagaagcttcgaggcccagcgacctcggtgggcccagtggggaggagcaggagcctgagccttgggaacatgc

SEQ ID NO: 24536 - DNA, 201 bp, Homo sapiens
tagacagagataggcagggggcccctgaaagaggagcaagccctgagctgcccaggacagagagcagaatggtggggccatggtgggcccaggattcccckgctggattccccagtgcttaactcttcctcccttctccacagcttcctaaccaagcgaagccggcaggtctgtgctgaccccagtgaggagtgggtccag

SEQ ID NO: 24537 - DNA, 201 bp, Homo sapiens; identical to SEQ ID NO: 4679

SEQ ID NO: 24538 - DNA, 201 bp, Homo sapiens; identical to SEQ ID NO: 4680

SEQ ID NO: 24539 - DNA, 201 bp, Homo sapiens
  misc_feature (1)...(201): n = A,T,C or G, or insertion/deletion polymorphism (see Tables 1-2)
cccccttccctcacaccgcgtctggtgacaaccgagtggctgtcatcagcctgtgtaggcagtcatggcaccaaagccaccagactgacaaatgtgtatcngatgcttttgttcagggctgtgatcggcctggggaaataataaagatgctcttttaaaaggtaaaccagtattgagtttggttttgttttcctggcaaat

SEQ ID NO: 24540 - DNA, 201 bp, Homo sapiens
atagttcaaccagcacgtgcaataccttgtaatgggtatggcaaaaggtagtgcccagacaggacagcatggtgaatatcacctgggaacttgggagaaakgcatattctgagccccacttcctttcttaatagactagggcccagcaacctgtgttttcacaaggctccaggtaattctgatgcatgtaaggtttaaaac

SEQ ID NO: 24541 - DNA, 201 bp, Homo sapiens
gttgctgtggaaaccacttccccacaaacagccccaagacaagtgagcacttgaactgttcctgcaaataccctgagccctgtggttacccaagacccccktgcatgtgcaagtcaacaagacaccacggtgcttaaaaaacatcctgtctcatgagccccggtttccatcttcccatgactcagggcttacctctttaga

SEQ ID NO: 24542 - DNA, 201 bp, Homo sapiens
tggccaccattaagcagagtattctgtagggcatattcatgatgaatcaagctcttaatagcaattatttacattgttgaggcttactcctcctactgagygctttttatacattgctcatttaatcttaccaatgcaatagtacagcttaggtactattaatacctccacttgacagaaaagtaacccagggctcagaaa

SEQ ID NO: 24543 - DNA, 201 bp, Homo sapiens
ttggtctgagcaagcctgccttcctcaactgctcggggatcagaagctgcctggccttttcttctgagctgtgactcgggctcattctcttcctttctccrcagttgctgctgacacgccgaccgcctgctgcttcagctacacctcccggcagattccacagaatttcatagctgactactttgagacgagcagccagtg

SEQ ID NO: 24544 - DNA, 201 bp, Homo sapiens
cctgtgtaggcagtcatggcaccaaagccaccagactgacaaatgtgtatcggatgcttttgttcagggctgtgatcggcctggggaaataataaagatgytcttttaaaaggtaaaccagtattgagtttggttttgttttcctggcaaatcaaaatcactggttaagaggaatcataggcaaagattaggaagaggtga

SEQ ID NO: 24545 - DNA, 201 bp, Homo sapiens
tctccccaggcggggatgggggagacctgtagtcagagcccccgggcagcacagccaatgcccgtccttcccctgcagaacctagagctgctccgcatctscctgctgctcatccagtcgtggctggagcccgtgcagttcctcaggagtgtcttcgccaacagcctggtgtacggcgcctctgacagcaacgtctatgac

SEQ ID NO: 24546 - DNA, 201 bp, Homo sapiens; identical to SEQ ID NO: 4795

SEQ ID NO: 24547 - DNA, 201 bp, Homo sapiens
gcaccccatgccactgggccattctcacctgggaattgagaaagaacaatctgccccttatggaaagacaaaatcaggcaaagggccccttgtgttggggrcaggatccctgcactcagagagatttagaagctgaaataactgggttgggggcggtgactcacgccattaatctcagtactttgggaggccagggagggt

SEQ ID NO: 24548 - DNA, 201 bp, Homo sapiens; identical to SEQ ID NO: 4796

SEQ ID NO: 24549 - DNA, 201 bp, Homo sapiens
cccttatggaaagacaaaatcaggcaaagggccccttgtgttggggacaggatccctgcactcagagagatttagaagctgaaataactgggttgggggcrgtgactcacgccattaatctcagtactttgggaggccagggagggtggatcacctaaagtcaagagttcgagaccagcctggccaacatagtgaaacccc

SEQ ID NO: 24550 - DNA, 201 bp, Homo sapiens; identical to SEQ ID NO: 4798

SEQ ID NO: 24551 - DNA, 201 bp, Homo sapiens
caaaatcaggcaaagggccccttgtgttggggacaggatccctgcactcagagagatttagaagctgaaataactgggttgggggcggtgactcacgccaktaatctcagtactttgggaggccagggagggtggatcacctaaagtcaagagttcgagaccagcctggccaacatagtgaaaccccgtctctactaaaaa

SEQ ID NO: 24552 - DNA, 201 bp, Homo sapiens
tattatggggtggaaggtggtggtatggagcaaggggtaggtggaaagaagacctggagggccttcaaggtctattgggaactaggccactgaaatataaraggtttggctgttcctgggccagaaaaaagctgacacatcactgctgtctattactcactaaggccattccaccagctcagtggtcccagcttgctggtc

SEQ ID NO: 24553 - DNA, 201 bp, Homo sapiens
actgctgtctattactcactaaggccattccaccagctcagtggtcccagcttgctggtcacagcccattggtcatctcagagatgacttgaaggcatttyttcctcccccaccatcaccagcaacaccaaacctagccccccaggagcggaaagaaatgaaaacaagatgggctattaagtgcagaggcaaaaactcccc

SEQ ID NO: 24554 - DNA, 201 bp, Homo sapiens
ggtctgcagaaacagtatcccaaggagctgagttcagtgcaccacactccctccctacttcaccccctgctccctctcctcccctcacccaaatgctgtcmcctccacccaacagctttccttcccaagggagcactagcagctccctgctttgagccaactcttctttcccactttccgtatgggcagggagtcccagat

SEQ ID NO: 24555 - DNA, 201 bp, Homo sapiens
cccaactactctcgggaaatgagaacaatgcaaaaatgagtttgagacatacagaaccagagcatttggaatctgaattagggcaagggaagtggaagagwgattttatttggggttgtaaatgcagtgccaacaggttccaggtagataacaatgtaagcaatgagggctggatgggaggggataaatcccagatgacac

SEQ ID NO: 24556 - DNA, 201 bp, Homo sapiens
ctaggaagaagcctatatcctgaaggagcagaagtattcattcctgcagaacccccagacctccctctgcttctcagagtctattccaacaccttccaacwgggtgaaaacgcagcagaaatctgtgagtggatgccttctccccaggtggggatggggtagacctgtggtcagagcccccgggcagcacagccactgccg

SEQ ID NO: 24557 - DNA, 201 bp, Homo sapiens
gaaagtctgagagtacaaggatcacccaccccagcccaccaggcccacttctgagtctcattcttcccaacctagtagaatctttcttattttcatgcttrgataagaatcccaaacccctgaggggtttccatcctgggcctggcagcagggcagcaaaggttaccttgaacaatgacagcaatgtctttgctgacagag

SEQ ID NO: 24558 - DNA, 201 bp, Homo sapiens
tgctcaattcagggaaggtggatgatttatattagactcacatgatgaaggagcagtagctccacctagtggaaacattgaggttgaaaagttcatgttcsgggatgatgctattttacaaagtcaagatatttcgtgtccctccgggaagccttccttgatccgagttatgctttctcttaacaatctgttttcccagtc

SEQ ID NO: 24559 - DNA, 201 bp, Homo sapiens
ctccgcgcccgtcgcctgtaccagctggcatatgacacctatcaggagtttgtaagctcttgggtaatgggtgcgcttcagaggtggcaggaaggggtgamtttcccccgctgggaagtaatgggaggagactaaggagctcagggttgttttctgaagtgaaaatgcaggcagatgagcatacgctgagtgaggttccca

SEQ ID NO: 24560 - DNA, 201 bp, Homo sapiens; identical to SEQ ID NO: 4832

SEQ ID NO: 24561 - DNA, 201 bp, Homo sapiens; identical to SEQ ID NO: 4836

SEQ ID NO: 24562 - DNA, 201 bp, Homo sapiens
tgagtagcaccacaccacctgctctggagaaaggacttttgttgttgttgttgttgttgtcgtcgttgttgtggttgttgaaatggagtctcactctggcrcccaggctggagtgccatggcccaatcttggctcacggcaacctctgcgtcctgggttcaagcgattctacctcctcaccctccggagtaactgggattg

SEQ ID NO: 24563 - DNA, 201 bp, Homo sapiens
tccctgtccttctgattttaaaataactataccagcaggaggacgtccagacacagcataggctacctggccatgcccaaccggtgggacatttgagttgyttgcttggcactgtcctctcatgcgttgggtccactcagtagatgcctgttgaattcctgggcctagggctgtgccagctgcctcgtcccgtcaccttct

SEQ ID NO: 24564 - DNA, 201 bp, Homo sapiens
catgttacaggcaacaactacttgtggaattggtgaatgcatgaatagaagaatgagtgaatgaatgaatagacaaaaggcagaaatccagcctcaaagarcttacagtctggtaagaggaataaaatgtctgcaaatagccacaggacaggtcaaaggaaggaggggctatttccagctgagggcaccccatcaggaaag

SEQ ID NO: 24565 - DNA, 201 bp, Homo sapiens
agtttgagacatacagaaccagagcatttggaatctgaattagggcaagggaagtggaagagagattttatttggggttgtaaatgcagtgccaacaggtkccaggtagataacaatgtaagcaatgagggctggatgggaggggataaatcccagatgacactcacttcccttcgggggatgcaacacagaggggtggga

SEQ ID NO: 24566 - DNA, 201 bp, Homo sapiens
atggagttttgccatgttggctagtctggccttgaactgacctcaagtgatccacccacctcagtcttccaaagtgctgggattacaggcatgagccaccrtgcccggcctggagaaaggactttaaatgatgcaatgtgggaagagcaaggttgtggagatctgctgccctggctgaggtagctcatgcaatcagtctct

SEQ ID NO: 24567 - DNA, 201 bp, Homo sapiens
cgagctacgctgggtgcttcttttctaccactttccttaatgcctatggacacctcattctgtggctgaagttccttgtgttcaattccccccatcttcaytgaacatcctgtgtagggacctcacccctgtcctgctagctttgcactgaggcaagttctgtccatgcctagtagtgccaccacctttactagatgagac

SEQ ID NO: 24568 - DNA, 201 bp, Homo sapiens
aaccagagcatttggaatctgaattagggcaagggaagtggaagagagattttatttggggttgtaaatgcagtgccaacaggttccaggtagataacaaygtaagcaatgagggctggatgggaggggataaatcccagatgacactcacttcccttcgggggatgcaacacagaggggtgggaaccagcacaatctgca

SEQ ID NO: 24569 - DNA, 201 bp, Homo sapiens
ttgaactgacctcaagtgatccacccacctcagtcttccaaagtgctgggattacaggcatgagccaccgtgcccggcctggagaaaggactttaaatgaygcaatgtgggaagagcaaggttgtggagatctgctgccctggctgaggtagctcatgcaatcagtctctctgagcctcagtctcctgatctgtgaaatgg

SEQ ID NO: 24570 - DNA, 201 bp, Homo sapiens
tacaggcatgagccactgcgcccggcctattctgagccttttgaagctgacgccagaggcgcgaagcccagcctctccccactggccatgtggaggctctygctgagtagtctctcagcctgcaggagccaaggatctggacccaagtgatgccccaacagtgggcaacttcccagtactgttaggagaatcccaagtcta

SEQ ID NO: 24571 - DNA, 201 bp, Homo sapiens
atgagggctggatgggaggggataaatcccagatgacactcacttcccttcgggggatgcaacacagaggggtgggaaccagcacaatctgcagaactcargcccctgctgaggtgggacccacccagcctgtcaccatcaggactgcagggacacggcttccagaccttctgaccttttgagacagccaggacatccaga

SEQ ID NO: 24572 - DNA, 201 bp, Homo sapiens
catgagccaccgtgcccggcctggagaaaggactttaaatgatgcaatgtgggaagagcaaggttgtggagatctgctgccctggctgaggtagctcatgyaatcagtctctctgagcctcagtctcctgatctgtgaaatgggatgatagtcatagctcctacacaagataagtggcaggtcagacgtgagaatgcacag

SEQ ID NO: 24573 - DNA, 201 bp, Homo sapiens
acaggcatgagccactgcgcccggcctattctgagccttttgaagctgacgccagaggcgcgaagcccagcctctccccactggccatgtggaggctcttsctgagtagtctctcagcctgcaggagccaaggatctggacccaagtgatgccccaacagtgggcaacttcccagtactgttaggagaatcccaagtctaa

SEQ ID NO: 24574 - DNA, 201 bp, Homo sapiens
agcaaggttgtggagatctgctgccctggctgaggtagctcatgcaatcagtctctctgagcctcagtctcctgatctgtgaaatgggatgatagtcatasctcctacacaagataagtggcaggtcagacgtgagaatgcacaggcaggcctttgacaactggataagctctacacaggtctggaaaggaggaagagaca

SEQ ID NO: 24575 - DNA, 201 bp, Homo sapiens
gaccttttgagacagccaggacatccagacttttacaggaattctaacatttaaacactggcaacacatattgaaaatcttttaagggcaaaaattaaccsaaacacacatggtctccaagctgtctgtgagcaattttgttctaagagatgttgattggggtaacttggtgtaagggaaagaatcagaaagatttgggct

SEQ ID NO: 24576 - DNA, 201 bp, Homo sapiens
cttcgggggatgcaacacagaggggtgggaaccagcacaatctgcagaactcaggcccctgctgaggtgggacccacccagcctgtcaccatcaggactgmagggacacggcttccagaccttctgaccttttgagacagccaggacatccagacttttacaggaattctaacatttaaacactggcaacacatattgaaa

SEQ ID NO: 24577 - DNA, 201 bp, Homo sapiens
tggcgggcgactgtaatcccagctactaaacagggtgaggcaggagaatcacttgaacccaggaggtggaggttgctgtgaggcaacatcatgccactgcmctccagcctgggtgacagaatgagactccaactgaaaaaaaagaaagaaagagagagagagagacaaagaggaaggaaagaaagaaagaaagaaagagaa

SEQ ID NO: 24578 - DNA, 201 bp, Homo sapiens
gagaatgcacaggcaggcctttgacaactggataagctctacacaggtctggaaaggaggaagagacaaaagaggacgggcttccatggctggatagggcmtctttcggcatgatgtgttctgagttccaaagctgggaagagactcaaatcttcttttttttttctttttttttaattattattattcttttactttaag

SEQ ID NO: 24579 - DNA, 201 bp, Homo sapiens
aattctaacatttaaacactggcaacacatattgaaaatcttttaagggcaaaaattaaccgaaacacacatggtctccaagctgtctgtgagcaattttrttctaagagatgttgattggggtaacttggtgtaagggaaagaatcagaaagatttgggctgtatgtaatttagtgcccccgaataaattacttgaccaa

SEQ ID NO: 24580 - DNA, 201 bp, Homo sapiens
taactgagtaacaccacactacctgttctggagaaaggacttttttcttgttgttgtggttgttgaaatggagtcacactctgtcgcccaggctggagtgsagtggcgcgatcttggctcacagcaacctctgcctcctggattcaagtgattctaccacctcaccctccggagtaactgggattacaggcttgcgccacc

SEQ ID NO: 24581 - DNA, 201 bp, Homo sapiens; identical to SEQ ID NO: 4820

SEQ ID NO: 24582 - DNA, 201 bp, Homo sapiens
catgctggtgtgctgcacccattaacttgtcatttagcattaggtatatctcctaaagctatccctccccctccccccaccccacaacagtctccagagtrtgatgttcccctgagactcaaatattcaagagctcttccaaccttgagattctctgatggtttcagggctgtgggaggaagcgcttgtggtccgtgtctg

SEQ ID NO: 24583 - DNA, 201 bp, Homo sapiens
atttggccttaaaattatttagaaatctcagtctttagaagttgatggaatgagcacaattataattatctctcggcttgcgtgttttaaaaggaaatgtgagccatcttaataagtatttgttgaatgcacgtgacagtggaatgacaatgtccagcgcctacttgggtggctaagagggttctaaagtggggtggtcat

SEQ ID NO: 24584 - DNA, 201 bp, Homo sapiens; identical to SEQ ID NO: 4821

SEQ ID NO: 24585 - DNA, 201 bp, Homo sapiens
acttgtcatttagcattaggtatatctcctaaagctatccctccccctccccccaccccacaacagtctccagagtatgatgttcccctgagactcaaatmttcaagagctcttccaaccttgagattctctgatggtttcagggctgtgggaggaagcgcttgtggtccgtgtctgttcccgggatttctgtttcttggt

SEQ ID NO: 24586 - DNA, 201 bp, Homo sapiens
ttaataagtatttgttgaatgcacgtgacagtggaatgacaatgtccagcgcctacttgggtggctaagagggttctaaagtggggtggtcataacatgtwactgaactgcagggggagccacactccagagactgtccacccagctcccctcgggtataggaaactccactcaaccactgctggttgagaattagaaaga

SEQ ID NO: 24587 - DNA, 201 bp, Homo sapiens
ctgccctggcttcaagagggcagtgccttcccaaccattcccttatccaggctttttgacaacgctatgctccgcgcccatcgtctgcaccagctggcctwtgacacctaccaggagtttgtaagctcttggggaatgggtgcgcatcaggggtggcaggaaggggtgactttcccccgctgggaaataagaggaggagac

SEQ ID NO: 24588 - DNA, 201 bp, Homo sapiens
ggacaaggtcgagacattcctgcgcatcgtgcagtgccgctctgtggagggcagctgtggcttctagctgcccgggtggcatccctgtgacccctccccastgcctctcctggtcgtggaaggtgctactccagtgcccaccagccttgtcctaataaaattaagttgcatcattttgtttgactaggtgtccttgtataa

SEQ ID NO: 24589 - DNA, 201 bp, Homo sapiens
ttgaatgcacgtgacagtggaatgacaatgtccagcgcctacttgggtggctaagagggttctaaagtggggtggtcataacatgtaactgaactgcaggsggagccacactccagagactgtccacccagctcccctcgggtataggaaactccactcaaccactgctggttgagaattagaaagatactaccaactttg

SEQ ID NO: 24590 - DNA, 201 bp, Homo sapiens
ttaaactctttgatttacccactgttagtctacatttcagctcatcaacttggtgtggacagcaatttccgctgcaaatttgagatgcctagggtgttttytaaacgatgcattcgtgagccctcactccctgagattctgatataattagactggaatgtggtccaggcaagagtaatttgaaaactttcccaggtgatt

SEQ ID NO: 24591 - DNA, 201 bp, Homo sapiens
ctcaaactcctggcctcaggtgatccacccaccttggcctcccaaagtgataggatcataggcaggagccaccaggcctggcccttaatggtattttctawcgaaaactcttcctgaagataagattagtgagactcgcacagggaagagttcagcaggcagagctccagtcatccttgacccctggcataatgttttact

SEQ ID NO: 24592 - DNA, 201 bp, Homo sapiens
agtcagagcccccgggcagcacagccaatgcccgtccttcccctgcagaacctagagctgctccgcatctccctgctgctcatccagtcgtggctggagcycgtgcagttcctcaggagtgtcttcgccaacagcctggtgtacggcgcctctgacagcaacgtctatgacctcctaaaggacctagaggaaggcatccaa

SEQ ID NO: 24593 - DNA, 201 bp, Homo sapiens
ctgtttggcagagcaactggattcctctaaccgtggttggtctgcagaaacagtatcccaaggagctgagttcagtgcaccacactccctccctacttcaycccctgctccctctcctcccctcacccaaatgctgtcccctccacccaacagctttccttcccaagggagcactagcagctccctgctttgagccaactc

SEQ ID NO: 24594 - DNA, 201 bp, Homo sapiens; identical to SEQ ID NO: 4797

SEQ ID NO: 24595 - DNA, 201 bp, Homo sapiens
ggaaagatgacaagccagggggcatgatcccagcatgtgtgggaggagcttctaaattatccattagcacaagcccgtcagtggccccatgcataaatgtrcacagaaacaggtgggggcaacagtgggagagaaggggccagggtataaaaagggcccacaagagaccagctcaaggatcccaaggcccaactccccgaa

SEQ ID NO: 24596 - DNA, 201 bp, Homo sapiens
tggctgttcctgggccagaaaaaagctgacacatcactgctgtctattactcactaaggccattccaccagctcagtggtcccagcttgctggtcacagcycattggtcatctcagagatgacttgaaggcatttcttcctcccccaccatcaccagcaacaccaaacctagccccccaggagcggaaagaaatgaaaaca

SEQ ID NO: 24597 - DNA, 201 bp, Homo sapiens
gggaagagcaaggctgtggagatctgctgccctggctgaggtagctcatgcaatcagtctctctgagcctcagtctcctgatatgtgaaatgggatgatamtcatacctcctacacaagacaagtggcaggtcagacgtgagaatgcacaggcaggcccttcgcaactggataggctctatacaggtgtggaaaggaggag

SEQ ID NO: 24598 - DNA, 201 bp, Homo sapiens
ccgtgtctgttcccgggatttcggtttcttggtttgtgtctctgctgcaggtccagggagctggggcaataccttgagagtctgagttcttcgtccccagkgacctgggggagccccccacccaaccccccctccgccccgccccaaggctcagggaaaggggagatcaaagtgtggggttggttccctctagtggtcagt

SEQ ID NO: 24599 - DNA, 201 bp, Homo sapiens
ccaaccttgagattctctgatggtttcagggctgtgggaggaagcgcttgtggtccgtgtctgttcccgggatttctgtttcttggtttgtgtctctgctrcaggtccaaggagctgaggcaataccttgagtctgggttcttcgtccccagtgacctgggggagccccaccgcctccgccccaaggttcagggaaagggg

SEQ ID NO: 24600 - DNA, 201 bp, Homo sapiens
ggtggaggttaaacatgcggggaggaggaaaggaataggatagagagtgggatgtggtcgataggggtctcaaggactggctatcctgacatccttctcckcattcaggttggccaccatggcctgctgccagagggcacccacctgaaccttaaagagaggacaagttgggtggtgtctgtggttgacactctgtgcaca

SEQ ID NO: 24601 - DNA, 201 bp, Homo sapiens
gcctaaacatgcagagaaacaggtgaggagaagcagcgagagagaaggggccaggtataaaaagggcccacaagagaccagctcaaggatcccaaggcccractccccgaaccactcagggtcctgtggacagctcacctagcggcaatggctgcaggtaagcgcccctaaaatccctttgggcacaatgtgtcctgaggg

SEQ ID NO: 24602 - DNA, 201 bp, Homo sapiens
gaagcgcttgtggtccgtgtctgttcccgggatttctgtttcttggtttgtgtctctgctacaggtccaaggagctgaggcaataccttgagtctgggttmttcgtccccagtgacctgggggagccccaccgcctccgccccaaggttcagggaaaggggagagcaatgtgtggggttggttctctctagtggtcagtgt

SEQ ID NO: 24603 - DNA, 201 bp, Homo sapiens
agcccatcgcgcacaccagctggccattgacacctaccaggagtttataagctcttggggaatgggtgcgggtcaggggtggcaagaaggggtgactttcycccactggggaagtaatgggaggagactaaggagctcagggttgttttctgaagtgaaaatgcaggcagatgagcataggctgagccaggttcccagaag

SEQ ID NO: 24604 - DNA, 201 bp, Homo sapiens; identical to SEQ ID NO: 4793

SEQ ID NO: 24605 - DNA, 201 bp, Homo sapiens
attgacacctaccaggagtttataagctcttggggaatgggtgcgggtcaggggtggcaagaaggggtgactttcccccactggggaagtaatgggaggasactaaggagctcagggttgttttctgaagtgaaaatgcaggcagatgagcataggctgagccaggttcccagaagagtaacagtgggagctggtctccag

SEQ ID NO: 24606 - DNA, 201 bp, Homo sapiens
tgtttggcagagcaactggattcctctaaccatggcttgtctgcaaaaacagtttcccaaagagctgagttcagtgcaccacactccctccctaccttcaycccctgctccctctcctcccctcacccaaatgctgtccccttcacccaacagctttccttcccaagggagcactagcagctccctgctttgagccaactc

SEQ ID NO: 24607 - DNA, 201 bp, Homo sapiens
tcaaactcctggcctcaggtgatccacccaccttggcctcccaaagtgataggatcataggcaggagccaccaggcctggcccttaatggtattttctatygaaaactcttcctgaagataagattagtgagactcgcacagggaagagttcagcaggcagagctccagtcatccttgacccctggcataatgttttactg

SEQ ID NO: 24608 - DNA, 201 bp, Homo sapiens; identical to SEQ ID NO: 4794

SEQ ID NO: 24609 - DNA, 201 bp, Homo sapiens
tagaaaaaccggaaagctgtgctcggtgtatatgacctttgatggccctcatggttatcatggatttctgattcttgctttgagtttactgtgattataawgatgtgcttaattaccactagaattatcagtgtaataataaaaaacaactaatgtgaacacatatctccagcaccatgctagtttattacatgtattgtg

SEQ ID NO: 24610 - DNA, 201 bp, Homo sapiens
tggggaatgggtgcgggtcaggggtggcaagaaggggtgactttcccccactggggaagtaatgggaggagactaaggagctcagggttgttttctgaagygaaaatgcaggcagatgagcataggctgagccaggttcccagaagagtaacagtgggagctggtctccagcatagaaagcagtggtccttcttggtgggg

SEQ ID NO: 24611 - DNA, 201 bp, Homo sapiens
tgctccacatctccctgctgctcatcgagtcgcggctggagcccgtgcggttcctcaggagtaccttcaccaacaacctggtgtatgacacctcggacagygatgactatcacctcctaaaggacctagaggaaggcatccaaatgctgatgggggtgagggtggcaccaggggtccccaatcctggaagcccactggctt

SEQ ID NO: 24612 - DNA, 201 bp, Homo sapiens
cgagacaagcctggccaacatggtggcaccccgtctcttactaaaaatacaaaaattaccaggtgtgatggtgcacacctgtattcccagctactgaggcrcgagaatcacttgagcccaggaggcagagttgcactgagcccatcatgccactgccctccagctggatggctgagcaagattctctctcaaaaatagtaa

SEQ ID NO: 24613 - DNA, 201 bp, Homo sapiens
gggtccccaatcctggaagcccactggcttcgagggctgggggagagaaacactgctgccctcttttcagcagtcaggcgctgacccaagagaactcaccwtattcttcatttcccctcgtgaatcctccaggcctttctctacaccctgaaggggaaggaggaaaatggataaatgagagagggagggaacagtgcccaa

SEQ ID NO: 24614 - DNA, 201 bp, Homo sapiens
cgggtgtggtggcgcacatctggaatcccagctactccagaggctgaggcaggaaaattgcttgaagctgggaagcagaagttgcagtgagccgagattgygccactgcactccagcctgggagacagagcgagactctgtctccaaaaaaaaaaaaaaagaaaagaaaaaaaagaatcaatgagaaggggctgcctgcct

SEQ ID NO: 24615 - DNA, 201 bp, Homo sapiens
cactgctgccctcttttcagcagtcaggcgctgacccaagagaactcaccttattcttcatttcccctcgtgaatcctccaggcctttctctacaccctgraggggaaggaggaaaatggataaatgagagagggagggaacagtgcccaagcgcttggtctctccttctcttgcttcactttgcagaggctggaagacgg

SEQ ID NO: 24616 - DNA, 201 bp, Homo sapiens
tgaaaacaagatgggctattaagtgcagaggcaaaaactccccaacaggtgaggaaacaatggcatagaattacttgtgttcagaagaattttaggatgartattccttaagcccaactactctcgggaaatgagaacaatgcaaaaatgagtttgagacatacagaaccagagcatttggaatctgaattagggcaaggg

SEQ ID NO: 24617 - DNA, 201 bp, Homo sapiens
cctgtggcagtgagaagcaaaggcagcagccggctaagcctccaggatctccctgctggaactagaaagtccaagtggcccccttcttccctctttttttkgttttgtttgttttgttttttgtttgtttgcttttgtttttgttttcttcaagatggggtgtcactctgttgcccaggctggagtgcaatggtgcaatct

SEQ ID NO: 24618 - DNA, 201 bp, Homo sapiens
gaaggacatggacaaggtcgagacattcctgcgcatggtgcagtgccgctctgtggagggcagctgtggcttctaggggcccgcgtggcatcctgtgaccyctccccagtgcctctcctggccctgaaggtgccactccagtgcccaccagccttgtcctaataaaattaagttgtattgtttcatctgactaggtgtcct

SEQ ID NO: 24619 - DNA, 201 bp, Homo sapiens
tgcaatggtgcaatcttggctcactgcaacctcagtatcccgggttcaagcgattcttctgcctcagcctccccagtagctgggattacaggtgcacaccrccatgcctggctcatttttcccttcctttttggattcgctgtgcttcaaggcactgaggccatgaggcagggtttgcagatacagggtaactacagccct

SEQ ID NO: 24620 - DNA, 201 bp, Homo sapiens
gcctgccctggcttcaagagggcagtgccttcccaaccattcccttatccaggctttttgacaacgctatgctccgcgcccatcgtctgcaccagctggcmtttgacacctaccaggagtttgtaagctcttggggaatgggtgcgcatcaggggtggcaggaaggggtgactttcccccgctgggaaataagaggaggag

SEQ ID NO: 24621 - DNA, 201 bp, Homo sapiens
gcaatggtgcaatcttggctcactgcaacctcagtatcccgggttcaagcgattcttctgcctcagcctccccagtagctgggattacaggtgcacaccascatgcctggctcatttttcccttcctttttggattcgctgtgcttcaaggcactgaggccatgaggcagggtttgcagatacagggtaactacagccctg

SEQ ID NO: 24622 - DNA, 201 bp, Homo sapiens
aagctcttggggaatgggtgcgcatcaggggtggcaggaaggggtgactttcccccgctgggaaataagaggaggagactaaggagctcagggtttttccygaagcgaaaatgcaggcagatgagcacacgctgagtgaggttcccagaaaagtaacaatgggagctggtctccagcgtagaccttggtgggcggtccttc

SEQ ID NO: 24623 - DNA, 201 bp, Homo sapiens
ttccccaaatgctcaattcagggaaggtggatgatttatattagactcacatgatgaaggagcagtagctccacctagtggaaacattgaggttgaaaagktcatgttcggggatgatgctattttacaaagtcaagatatttcgtgtccctccgggaagccttccttgatccgagttatgctttctcttaacaatctgtt

SEQ ID NO: 24624 - DNA, 201 bp, Homo sapiens
gcataaatgtacacagaaacaggtgggggcaacagtgggagagaaggggccagggtataaaaagggcccacaagagaccagctcaaggatcccaaggcccractccccgaaccactcagggtcctgtggacagctcacctagctgcaatggctacaggtaagcgcccctaaaatccctttgggcacaatgtgtcctgaggg

SEQ ID NO: 24625 - DNA, 201 bp, Homo sapiens
atatatttttggaagccaggaacaatgttttgttcaccactgtatccccactgccttgtatgtggtgaaaccaaagggttacttttacacttaatctatarcaccagactcaggggaggtctgggaagaatgggaaaacgttttccctctgctgtctgatgccatggttttttctagctggtatctgcaatttggaaggct

SEQ ID NO: 24626 - DNA, 201 bp, Homo sapiens
cgctgcaaccctccacctcccgtgctcaagtgatcctcccacctcagactctcaagtagctgggactacatgcatgtgccactatacctggctaagttttrtgttttttgtagaaatggggttttgccatgttgcccaggctattcgcaaactccagggctcaagtgattcacctgcctcagcctcccaaagtgctgggat

SEQ ID NO: 24627 - DNA, 201 bp, Homo sapiens; identical to SEQ ID NO: 4711

SEQ ID NO: 24628 - DNA, 201 bp, Homo sapiens
cgcccccgccccaaggctcaggtaaaggggagagcaaagtgtggagtttgttccctctagtggtcagtattagcactgcatccaggcgggcctgtctcagrcgagcccaggagtcagcaaaagtggaattcagcactgaatcatgcccagaacccccgcaatctattggctgtgctttggccccttttcccaacacacaca

SEQ ID NO: 24629 - DNA, 201 bp, Homo sapiens
tgaaaacaagatgggctattaagtgcagaggcaaaaactccccaacaggtgaggaaacaatggcatagaattacttgtgttcggaagaattttaagatgartattccttaagcccaactactctcgggaaatgagaacaatgcaaaaatgagtttgagacatatggaaccagagcatttggaatctgaattagggcaaggg

SEQ ID NO: 24630 - DNA, 201 bp, Homo sapiens; identical to SEQ ID NO: 4837

SEQ ID NO: 24631 - DNA, 201 bp, Homo sapiens
ccgtcagtggccccatgcataaatgtacacagaaacaggtgggggcaacagtgggagagaaggggccagggtataaaaagggcccacaagagaccagctchaggatcccaaggcccaactccccgaaccactcagggtcctgtggacagctcacctagctgcaatggctacaggtaagcgcccctaaaatccctttgggca

SEQ ID NO: 24632 - DNA, 201 bp, Homo sapiens
ggcagctgtggcttctaggggcccgcgtggcatcctgtgacccctccccagtgcctctcctggccctgaaggtgccactccagtgcccaccagccttgtcytaataaaattaagttgtattgtttcatctgactaggtgtccttctataatattatggggtggaaggtggtggtatggagcaaggggtaggtgggaagacg

SEQ ID NO: 24633 - DNA, 201 bp, Homo sapiens
cttgtcctaataaaattaagttgtattgtttcatctgactaggtgtccttctataatattatggggtggaaggtggtggtatggagcaaggggtaggtggraagacgacctggagggccttcagggtctattgggaactaggccactgaaatataagaggtttggctgttcctgggccagaaaaaggctgacatatcactg

SEQ ID NO: 24634 - DNA, 201 bp, Homo sapiens
agaattacttgtgttcggaagaattttaagatgagtattccttaagcccaactactctcgggaaatgagaacaatgcaaaaatgagtttgagacatatggwaccagagcatttggaatctgaattagggcaagggaagtggaagagagattttatttgcgggttgtaaatgcagtgccaacaggtgccaggtagataacaa

SEQ ID NO: 24635 - DNA, 201 bp, Homo sapiens
ggtttggggcttatgaatgttagtatcgccatctaagcccagtatttggccaatctctgaatgttcctggtccctggagggaggcagagagagagagagaraaaaaaaaacccagctcctggaacagggagagcgctggcctcttgctctccagctccctctgttgccctccggtttctccccaggctcccggacgtccct

SEQ ID NO: 24636 - DNA, 201 bp, Homo sapiens
gaattacttgtgttcggaagaattttaagatgagtattccttaagcccaactactctcgggaaatgagaacaatgcaaaaatgagtttgagacatatggawccagagcatttggaatctgaattagggcaagggaagtggaagagagattttatttgcgggttgtaaatgcagtgccaacaggtgccaggtagataacaac

SEQ ID NO: 24637 - DNA, 201 bp, Homo sapiens
acatactgaaaatcttttaagggcaaaaattaacccaaacacacatggtctccaagctgtctgtgagcaattttgttctaagagatgttgattggggtaayttggtgtaagggaaagaatcagaaagatttgggctgtatgcaatttagtgtcgctgaataaattacttgaccaagctgagataataatatattgctttac

SEQ ID NO: 24638 - DNA, 201 bp, Homo sapiens
gctggtcatggtggtgggcgcctgtaatcccagctactcttaatctatagaggctgaggcagagaattgcttcaacccgggggtggagtttgaagtggacygaaatcacaccactgcactccagcctaggcaaagagcgagactccatctaaaaaaaaaagttataaaatgcagccatttgacataagagcttttagcaat

SEQ ID NO: 24639 - DNA, 201 bp, Homo sapiens
tagatgaggtactcagagcagtcaaattcgtagagacaaaaagtaggatggtggctgccagtggctgtggggagggatggaatagggagccatttaacgascacagggtttcagctgtgcaagatgaaaagggttctggagatggttggtggtgagggttgcatgacgatgtcaatgtacttgacgtgaccgaactgtaca

SEQ ID NO: 24640 - DNA, 201 bp, Homo sapiens
gttaagatggaaatgtttatatcttctcacaactaaaaattgttaatagtttcttttgtttttgtttttgtttttgagacagaggctggagtgcagtggtggatcttggctcactgcaacctccgcctcctcctgggttcaagtgattctcatgcctcagcctcctgagtagctgggattataagtgtgcaccaccacaca

SEQ ID NO: 24641 - DNA, 201 bp, Homo sapiens
ccaaggacagggaaagaagctgaaacataaaatcatatgaacattttcacaagaagattcctcttgaagcttcaaggaaattgtttacagacagaagaaartatgcacttattgatgaaaagggagagtaaagattggaactttaacctagatgcccatatgggtaaaaaaaagaaaactggcaaatgcgaactcacagtt

SEQ ID NO: 24642 - DNA, 201 bp, Homo sapiens
taaaaattgttaatagtttcttttgtttttgtttttgtttttgagacagaggctggagtgcagtggtggatcttggctcactgcaacctccgcctcctccygggttcaagtgattctcatgcctcagcctcctgagtagctgggattataagtgtgcaccaccacacagggcagatttttgtatttttggtaaagacaggg

SEQ ID NO: 24643 - DNA, 201 bp, Homo sapiens
atgtttggagctcttaacctatgaggccaatttcatggaagaactctaccttctccttcagagacagaatactgagctagataggatgcccgtctggcccraagtggaatttcttaccatctgtatactcccccaagacccgcaacagatggttactgagttgaagcttgccactgatccttaatgatgtcaacaagctca

SEQ ID NO: 24644 - DNA, 201 bp, Homo sapiens
aacctaaaatgaccacttctgaatatcttccatgagcattgttgaaatacacatggttggttttgtccctttatacacagttgagagcagaactgaccccktcctttttcttctgaattgtagggtctgggcttctcagccaagacaagctgacactttgcctggatgcttctttaattcagaaggccctggagtgctgag

SEQ ID NO: 24645 - DNA, 201 bp, Homo sapiens
aggggggaagatttcaccactagagagggtgctctttcctgctgccatctctgggggcatctgatgcttgtgacctccagattatattgaaatagccccarctctgggcaccaggagacaggaggctcagtcctggccttctctgccttcaccttttcctgctgtgaggtttccacaaggcaccccatgccactgggccat

SEQ ID NO: 24646 - DNA, 201 bp, Homo sapiens
agttgaagcttgccactgatccttaatgatgtcaacaagctcagctctgggagctggccctccagaagcccaggtcaggggagcaagggaaagtggagatrggaacagagctctgattcctggccccatatttgatacttactcccttcaaagtcctgtccttggactacagatttagttcccagttagtaatcagaaaac

SEQ ID NO: 24647 - DNA, 201 bp, Homo sapiens
gtgagccatcttaataagtatttgttgaatgcacgtgacagtggaatgacaatgtccagcgcctacttgggtggctaagagggttctaaagtggggtggtsataacatataactgaactgcagggggagccacatgccagagactgtccacccagctcccctcgggtgtaggagaatccactcaaccactgctggttgaga

SEQ ID NO: 24648 - DNA, 201 bp, Homo sapiens
acaaaaattagccaggtgtggtggtgcacacctgtattcccagctacgaaggcatgagaatcgcttgagcccgggaggcagtgttgggctgggcccatcawgccactgcactccagctgggtggctgaggaagattctctctcaaaaataataagaaagaagataaaattttggagtattaaaggccactcttcctctgga

SEQ ID NO: 24649 - DNA, 201 bp, Homo sapiens
tcttacaaatcaaacattgagactgagattcctaatgaatagagtgagctctaaagagaaaggtggctgggcgcggtggctcacacctgtaatcccagcaytttgggaggccaaggtggccggatcacttgaggtcaggagtttgagaccagcccagccaacatggtgaaaccccatctctacgaaaagtacaaaaattag

SEQ ID NO: 24650 - DNA, 201 bp, Homo sapiens
agactgagattcctaatgaatagagtgagctctaaagagaaaggtggctgggcgcggtggctcacacctgtaatcccagcactttgggaggccaaggtggscggatcacttgaggtcaggagtttgagaccagcccagccaacatggtgaaaccccatctctacgaaaagtacaaaaattagacaggcatggtggtgtgca

SEQ ID NO: 24651 - DNA, 201 bp, Homo sapiens
aggggtttccatcctgggcctggcagcagggcagcaaaggttaccttgaacaatgacagcaatgtctttgctgacagagcccagctggttagtggctgtgyagcggtaggttccagtgtggttctgggttgccttctgtggcacttcaaggtcaaagaccaccccattccaggtacacaccaaggctggagctgggtttcc

SEQ ID NO: 24652 - DNA, 201 bp, Homo sapiens
gcagggcagcaaaggttaccttgaacaatgacagcaatgtctttgctgacagagcccagctggttagtggctgtgcagcggtaggttccagtgtggttctrggttgccttctgtggcacttcaaggtcaaagaccaccccattccaggtacacaccaaggctggagctgggtttccctttgggacgcaggtgagcgtgtgt

SEQ ID NO: 24653 - DNA, 201 bp, Homo sapiens
gtgtggttctgggttgccttctgtggcacttcaaggtcaaagaccaccccattccaggtacacaccaaggctggagctgggtttccctttgggacgcaggygagcgtgtgttccatcccttccagccaggtctgtttggcagagcaactggattcctctaaccgtggttggtctgcagaaacagtatcccaaggagctgag

SEQ ID NO: 24654 - DNA, 201 bp, Homo sapiens
gttctgggttgccttctgtggcacttcaaggtcaaagaccaccccattccaggtacacaccaaggctggagctgggtttccctttgggacgcaggtgagcktgtgttccatcccttccagccaggtctgtttggcagagcaactggattcctctaaccgtggttggtctgcagaaacagtatcccaaggagctgagttcag

SEQ ID NO: 24655 - DNA, 201 bp, Homo sapiens
gatccacccacctcagtcttccaaagtgctgggattacaggcatgagccaccatgcccggcctggagaaaggactttaaatgacgcaatgtgggaagagcmaggttgtggagatctgctgccctggctgaggtagctcatgcaatcagtctctctgagcctcagtctcctgatctgtgaaatgggatgatactcatacctc

SEQ ID NO: 24656 - DNA, 201 bp, Homo sapiens
aggcaggcctttgacaactggataagctctacacaggtctggaaaggaggaagagacaaaagaggacgggcttccatggctggatagggcctctttcggcrtgatgtgttctgagttccaaagctgggaagagactcaaatcttcttttttttttctttttttttaattattattattcttttactttaagttttagggta

SEQ ID NO: 24657 - DNA, 201 bp, Homo sapiens
tggacaaggtcgagacattcctgcgcatcgtgcagtgccgctctgtggagggcagctgtggcttctagctgcccgggtggcatccctgtgacccctccccmgtgcctctcctggtcgtggaaggtgctactccagtgcccaccagccttgtcctaataaaattaagttgcatcattttgtttgactaggtgtccttgtata

SEQ ID NO: 24658 - DNA, 201 bp, Homo sapiens
gcctccaggctcgccctgctggaactagaaagtccaagtggcccccttcttcctccctttttggttttgtttgcttttgtttttgttttgttcaagatggkgtctcgctttgttgcccaggctggagtgcaatggcacgatctcagatcactgcaacttctgcctcccacagtcaagcgattctcctgcctcagcctcccc

SEQ ID NO: 24659 - DNA, 201 bp, Homo sapiens
caagcccgtcagtggccccatgcataaatgtacacagaaacaggtgggggcaacagtgggagagaaggggccagggtataaaaagggcccacaagagaccrgctcaaggatcccaaggcccaactccccgaaccactcagggtcctgtggacagctcacctagctgcaatggctacaggtaagcgcccctaaaatcccttt

SEQ ID NO: 24660 - DNA, 201 bp, Homo sapiens
cttctgcctcccacagtcaagcgattctcctgcctcagcctccccagtagctgggattacaggtgcacaccaccatgcctggctcattttccccttccttkttggattcgctgtgcttcaaggcactgaggccatgaggcagggtttgcagatacaggatatctacagccctgatgcgactgatcctgacaccaaaatggc

SEQ ID NO: 24661 - DNA, 201 bp, Homo sapiens
ggggcatgatcccagcatgtgtgggaggagcttctaaattatccattagcacaagcccgtcagtggccccatgcataaatgtacacagaaacaggtggggkcaacagtgggagagaaggggccagggtataaaaagggcccacaagagaccagctcaaggatcccaaggcccaactccccgaaccactcagggtcctgtgg

SEQ ID NO: 24662 - DNA, 201 bp, Homo sapiens
acaggtgcacaccaccatgcctggctcattttccccttccttgttggattcgctgtgcttcaaggcactgaggccatgaggcagggtttgcagatacaggrtatctacagccctgatgcgactgatcctgacaccaaaatggctgtggatccctgcatggtgtggctgtatactcctgtctcttaaacctgcttcttaact

SEQ ID NO: 24663 - DNA, 201 bp, Homo sapiens
ggtgcacaccaccatgcctggctcattttccccttccttgttggattcgctgtgcttcaaggcactgaggccatgaggcagggtttgcagatacaggatawctacagccctgatgcgactgatcctgacaccaaaatggctgtggatccctgcatggtgtggctgtatactcctgtctcttaaacctgcttcttaacttac

SEQ ID NO: 24664 - DNA, 201 bp, Homo sapiens
actttagaaggccgaagtgggtggatcacgagatcaggacttcaagaccagcctggccaagatggtgaaaccctgtctctactaaaaatacaaaaaattakctgggcatggtgatgggcacctgtaatcccagctacttgggaggctgaggcagagaaatccttgaacccaggaggtagaggtggaagtgagccaaaatca

SEQ ID NO: 24665 - DNA, 201 bp, Homo sapiens
cacagaagggaagggaactgcatttggacatcataaaaccacttttatttttaccatagcaacattccagtgaacatttcttgactgacttgggagaaaakatctggttttgtgattcctcacgccttctccgagggtgaatatactctttccgaaggacagggaaggaggctgaaccataaaatcatatgaacattttca

SEQ ID NO: 24666 - DNA, 201 bp, Homo sapiens
acaccagaatgtcaccctgaccatccttgagaggataaacggccaggcacggtggctcacgccagttatctcagcactttggagggctgaggcgggaggasgtcacaagttcgagacaagcctggccaacatggtggcaccccgtctcttactaaaaatacaaaaattaccaggtgtgatggtgcacacctgtattcccag

SEQ ID NO: 24667 - DNA, 201 bp, Homo sapiens
tttccgaaggacagggaaggaggctgaaccataaaatcatatgaacattttcacaagaggattcctcttgaagcttcaaggaaattgtttacagtcagaaraaaatatgcacttcttgatgaaaacagagagtaaacattgcaactctaacctagacacctatatgggtaaaaaaaagaaaactggcaaatgcgaactcac

SEQ ID NO: 24668 - DNA, 201 bp, Homo sapiens
tgaaaaggaattcagagatgtttggagctcttaacctaagaggccaatttcatggaagaactctaccttctacttcagagacagaacactgggctagatasgatgcttgtctggcccgaagtggaatttcttaccatctgtatactcccccaagacccacaacagatggttactgagttgcagcttgccactgatccttaa

SEQ ID NO: 24669 - DNA, 201 bp, Homo sapiens
ggctggagctgggtttccctttgggacgcaggtgagcgtgtgttccatcccttccagccaggtctgtttggcagagcaactggattcctctaaccgtggtkggtctgcagaaacagtatcccaaggagctgagttcagtgcaccacactccctccctacttcaccccctgctccctctcctcccctcacccaaatgctgtc

SEQ ID NO: 24670 - DNA, 201 bp, Homo sapiens
gtatactcccccaagacccacaacagatggttactgagttgcagcttgccactgatccttaatgatgtcaacaagctcagctctgggagctggcactccasaagcccaggtcaggggagcaagggaaagtggagatgggaacagagctctgattcctagccccatatttgatacttactcccttcaaagtcctgtccatgg

SEQ ID NO: 24671 - DNA, 201 bp, Homo sapiens
cttaatgatgtcaacaagctcagctctgggagctggcactccagaagcccaggtcaggggagcaagggaaagtggagatgggaacagagctctgattcctrgccccatatttgatacttactcccttcaaagtcctgtccatggactacaaatttagctcccagttagtaatcaaaaacccatgaaatatgagttgtattt

SEQ ID NO: 24672 - DNA, 201 bp, Homo sapiens; identical to SEQ ID NO: 4792

SEQ ID NO: 24673 - DNA, 201 bp, Homo sapiens
caggtctgtttggcagagcaactggattcctctaaccgtggttggtctgcagaaacagtatcccaaggagctgagttcagtgcaccacactccctccctacttcaccccctgctccctctcctcccctcacccaaatgctgtcccctccacccaacagctttccttcccaagggagcactagcagctccctgctttgagcc

SEQ ID NO: 24674 - DNA, 201 bp, Homo sapiens
ctccctgctttgagccaactcttctttcccactttccgtatgggcagggagtcccagatgaaacctagggtgttcttatggatttggactaaatgataacsctgctctgtccatggtggccctggggcccctgcttcccatgtttgtttctcggtgggtaaggagctaggtaacggtgaactcagagatgaggatttttct

SEQ ID NO: 24675 - DNA, 201 bp, Homo sapiens
cccagatgaaacctagggtgttcttatggatttggactaaatgataaccctgctctgtccatggtggccctggggcccctgcttcccatgtttgtttctcrgtgggtaaggagctaggtaacggtgaactcagagatgaggatttttctacttttctttttggttttttttggttgtttgtttgttttggagacaaagtca

SEQ ID NO: 24676 - DNA, 201 bp, Homo sapiens
cttatggatttggactaaatgataaccctgctctgtccatggtggccctggggcccctgcttcccatgtttgtttctcggtgggtaaggagctaggtaacrgtgaactcagagatgaggatttttctacttttctttttggttttttttggttgtttgtttgttttggagacaaagtcagtctcactccttcgcccagggt

SEQ ID NO: 24677 - DNA, 201 bp, Homo sapiens
tatggatttggactaaatgataaccctgctctgtccatggtggccctggggcccctgcttcccatgtttgtttctcggtgggtaaggagctaggtaacggkgaactcagagatgaggatttttctacttttctttttggttttttttggttgtttgtttgttttggagacaaagtcagtctcactccttcgcccagggtgg

SEQ ID NO: 24678 - DNA, 201 bp, Homo sapiens
ggagctaggtaacggtgaactcagagatgaggatttttctacttttctttttggttttttttggttgtttgtttgttttggagacaaagtcagtctcactycttcgcccagggtggagtgcagtggcgcgatctcggctcatgacaacctctgcctcccaggttcaagcaattcttgtgcctcagccgctccagtaactag

SEQ ID NO: 24679 - DNA, 201 bp, Homo sapiens
taacggtgaactcagagatgaggatttttctacttttctttttggttttttttggttgtttgtttgttttggagacaaagtcagtctcactccttcgcccwgggtggagtgcagtggcgcgatctcggctcatgacaacctctgcctcccaggttcaagcaattcttgtgcctcagccgctccagtaactaggattacaag

SEQ ID NO: 24680 - DNA, 201 bp, Homo sapiens
cggtgaactcagagatgaggatttttctacttttctttttggttttttttggttgtttgtttgttttggagacaaagtcagtctcactccttcgcccaggstggagtgcagtggcgcgatctcggctcatgacaacctctgcctcccaggttcaagcaattcttgtgcctcagccgctccagtaactaggattacaagcgc

SEQ ID NO: 24681 - DNA, 201 bp, Homo sapiens
ttttggagacaaagtcagtctcactccttcgcccagggtggagtgcagtggcgcgatctcggctcatgacaacctctgcctcccaggttcaagcaattctygtgcctcagccgctccagtaactaggattacaagcgcatgccaccacacccggctaatttttctatttttagtagagatcagtttcaccatgttggccac

SEQ ID NO: 24682 - DNA, 201 bp, Homo sapiens
acctgcggagttatgcagtggtccccaactagggcccctgccaccctcattcctaagggaggctggagacttcttccatggccgaaaatccacatcgaagyccccagaactggctaaaaggacctgtcatgggggctccctgtcccagctgacattggaggaaggatggtgggggaggcagaaagctacatggagctcagg

SEQ ID NO: 24683 - DNA, 201 bp, Homo sapiens
gaggacaagttgggtggtatctctggctgacactctgtgcacaaccctcacaacactggtgacggtgggaagggaaagatgacaagccagggggcatgatsccagcatgtgtgggaggagcttctaaattatccattagcacaagcccgtcagtggccccatgcataaatgtacacagaaacaggtgggggcaacagtggg

SEQ ID NO: 24684 - DNA, 201 bp, Homo sapiens
cacattttaaaatataaaaagaccttaaagaccatctactttaaactctttgatttacccactgttagtctacatttcagctcatcaacttggtgtggacrgcaatttccgctgcaaatttgagatgcctagggtgttttctaaacgatgcattcgtgagccctcactccctgagattctgatataattagactggaatgt

SEQ ID NO: 24685 - DNA, 201 bp, Homo sapiens
tgaagcacctggcaaggagcaagaggccttcttacaaatcaaacattgagactgagattcctaatgactagggtgagctctaaagagaaaggtggctgggygcggtggctcacacctgtaatcccagcattttggggggccaaggtgggcggatcacttgaggtcaggagtttgagaacagcctagccaacatggtgaaac

SEQ ID NO: 24686 - DNA, 201 bp, Homo sapiens
agagaaaggtggctgggcgcggtggctcacacctgtaatcccagcattttggggggccaaggtgggcggatcacttgaggtcaggagtttgagaacagccyagccaacatggtgaaaccccatctctacgaaaaatacaaaaattagacaggcatggtggtatgcacctgtaatctcagctactggggaggctgaggcagg

SEQ ID NO: 24687 - DNA, 201 bp, Homo sapiens
taggcgacaacagtgagactccatctcaaaaaaaaaaagagagagagagagaatggtgagattgtggacatattggacacacaggacatggggcatggggrcctgaaacaccgttttacaggacagatgtacacaaataggaatgcagcctgccattgtgtttcttcctttctcctctatcccttctcccatccctgggaa

SEQ ID NO: 24688 - DNA, 201 bp, Homo sapiens
agtgagactccatctcaaaaaaaaaaagagagagagagagaatggtgagattgtggacatattggacacacaggacatggggcatgggggcctgaaacacygttttacaggacagatgtacacaaataggaatgcagcctgccattgtgtttcttcctttctcctctatcccttctcccatccctgggaaaccacagtagc

SEQ ID NO: 24689 - DNA, 201 bp, Homo sapiens
attgtgtttcttcctttctcctctatcccttctcccatccctgggaaaccacagtagcagaactctcattcaatcaaatagctgtcaattatatgagttgyacttttctcttcctgaacagcaaactggctttcctcctctttgtcctcctctttctgcctgtagagcaatttcttcctgtctactttgcagggccgatag

SEQ ID NO: 24690 - DNA, 201 bp, Homo sapiens
caaatagctgtcaattatatgagttgcacttttctcttcctgaacagcaaactggctttcctcctctttgtcctcctctttctgcctgtagagcaatttcytcctgtctactttgcagggccgatagctcaaatacagtgctatggtgatgacacccactccaagggcaacggtaataatgacaaagagggtagagctgat

SEQ ID NO: 24691 - DNA, 201 bp, Homo sapiens
tgtcaattatatgagttgcacttttctcttcctgaacagcaaactggctttcctcctctttgtcctcctctttctgcctgtagagcaatttcttcctgtcyactttgcagggccgatagctcaaatacagtgctatggtgatgacacccactccaagggcaacggtaataatgacaaagagggtagagctgattccttcat

SEQ ID NO: 24692 - DNA, 201 bp, Homo sapiens; identical to SEQ ID NO: 4839

SEQ ID NO: 24693 - DNA, 201 bp, Homo sapiens
tcttcctgtctactttgcagggccgatagctcaaatacagtgctatggtgatgacacccactccaagggcaacggtaataatgacaaagagggtagagctkattccttcatccagtcctgcccaagcacagaagatagagttaggaaagtctgagagtacaaagatcacccaccccagcccaccaggcccacttctgagtc

SEQ ID NO: 24694 - DNA, 201 bp, Homo sapiens
gtgtggttctgggttgccttctgtggcacttcaaggtcaaagaccaccccattccaggtacacaccaaggctggagctgggtttccctttgggacgcaggygagcgtgtgttccatcccttccagccaggtctgtttggcagagcaactggattcctctaaccatggcttgtctgcaaaaacagtttcccaaagagctgag

SEQ ID NO: 24695 - DNA, 201 bp, Homo sapiens
accaaggctggagctgggtttccctttgggacgcaggtgagcgtgtgttccatcccttccagccaggtctgtttggcagagcaactggattcctctaaccrtggttggtctgcagaaacagtatcccaaggagctgagttcagtgcaccacactccctccctacttcaccccctgctccctctcctcccctcacccaaatg

SEQ ID NO: 24696 - DNA, 201 bp, Homo sapiens
tggagctgggtttccctttgggacgcaggcgagcgtgtgttccatcccttccagccaggtctgtttggcagagcaactggattcctctaaccatggcttgyctgcaaaaacagtttcccaaagagctgagttcagtgcaccacactccctccctaccttcatcccctgctccctctcctcccctcacccaaatgctgtccc

SEQ ID NO: 24697 - DNA, 201 bp, Homo sapiens
gatgccttctccccaggcggggatgggggagacctgtagtcagagcccccgggcagcacagccaatgcccgtccttcccctgcagaacctagagctgctcygcatctccctgctgctcatccagtcgtggctggagcccgtgcagttcctcaggagtgtcttcgccaacagcctggtgtacggcgcctctgacagcaacgt

SEQ ID NO: 24698 - DNA, 201 bp, Homo sapiens
ggtataaaaagggcccacaagagaccagctcaaggatcccaaggcccaactccccgaaccactcagggtcctgtggacagctcacctagctgcaatggctrcaggtaagcgcccctaaaatccctttgggcacaatgtgtcctgaggggagaggcagcgacctgtagatgggacgggggcactaaccctcaggtttggggc

SEQ ID NO: 24699 - DNA, 201 bp, Homo sapiens
aaggggccagggtataaaaagggcccacaagagaccagctcaaggatcccaaggcccaactccccgaaccactcagggtcctgtggacagctcacctagckgcaatggctacaggtaagcgcccctaaaatccctttgggcacaatgtgtcctgaggggagaggcagcgacctgtagatgggacgggggcactaaccctca

SEQ ID NO: 24700 - DNA, 201 bp, Homo sapiens
gttaatagtttctttttgttttgtttttgtttttgtttttgagacagaggctggagtgcagtggtgggatcttggctcactgcaacctccgcctcctcccrggttcaagtgattctcatgcctcagcctcctgagtagctgggattataagtgtgcaccaccacacagggcagatttttgtatttttggtaaagacagggt

SEQ ID NO: 24701 - DNA, 201 bp, Homo sapiens
gaacagcccacagcacagtgccctcccagcaggtgatgagtctggggtgctggtccgataatgtttcaggaatgatggcagaaaatggagctctgtcttcygctctgaaagtggggagatggcagggccccagcattcacatcctaggccacaggggtgtgggttttcaatgttggttgccaacaccacagccaaccactt

SEQ ID NO: 24702 - DNA, 201 bp, Homo sapiens
tctgaaagtggggagatggcagggccccagcattcacatcctaggccacaggggtgtgggttttcaatgttggttgccaacaccacagccaaccacttctrgaagcatttgcttgtttgcttgcttgtgtttctacagagtcaagtgctagatgctcttaaactcaggggggaagatttcaccactagagagggtgctctt

SEQ ID NO: 24703 - DNA, 201 bp, Homo sapiens
cctttgggacgcaggtgagcgtgtgttccatcccttccagccaggtctgtttggcagagcaactggattcctctaaccgtggttggtctgcagaaacagtwtcccaaggagctgagttcagtgcaccacactccctccctacttcaccccctgctccctctcctcccctcacccaaatgctgtcccctccacccaacagct

SEQ ID NO: 24704 - DNA, 201 bp, Homo sapiens
ttgcttgtttgcttgcttgtgtttctacagagtcaagtgctagatgctcttaaactcaggggggaagatttcaccactagagagggtgctctttcctgctstcatctctgggggtatctgatgcttgtgacctccagattatattgaagtagccccaaccctgggcaccaggagacaggaggctcagtcctggccttctct

SEQ ID NO: 24705 - DNA, 201 bp, Homo sapiens
cacccaaatgctgtcccctccacccaacagctttccttcccaagggagcactagcagctccctgctttgagccaactcttctttcccactttccgtatggrcagggagtcccagatgaaacctagggtgttcttatggatttggactaaatgataaccctgctctgtccatggtggccctggggcccctgcttcccatgtt

SEQ ID NO: 24706 - DNA, 201 bp, Homo sapiens
cttaaactcaggggggaagatttcaccactagagagggtgctctttcctgctctcatctctgggggtatctgatgcttgtgacctccagattatattgaartagccccaaccctgggcaccaggagacaggaggctcagtcctggccttctctgccttcaccttgtcctgctctgaggtttccacaaggcaccccatgcca

SEQ ID NO: 24707 - DNA, 201 bp, Homo sapiens
atgcttgtgacctccagattatattgaagtagccccaaccctgggcaccaggagacaggaggctcagtcctggccttctctgccttcaccttgtcctgctstgaggtttccacaaggcaccccatgccactgggccattctcacctgagaattgagaaagaacaatctgccccttatggaaagacaaaatgaggcaaaggg

SEQ ID NO: 24708 - DNA, 201 bp, Homo sapiens
ttgtcctgctctgaggtttccacaaggcaccccatgccactgggccattctcacctgagaattgagaaagaacaatctgccccttatggaaagacaaaatsaggcaaagggccccttgtgttgggggcaggatccctgcactcagagggatatagaagctgaaataactgggttgggagcagtggctcacgcaagtaatct

SEQ ID NO: 24709 - DNA, 201 bp, Homo sapiens
acaggtgcacaccggcatgcctggctcatttttcccttcctttttggattcgctgtgcttcaaggcactgaggccatgaggcagggtttgcagatacaagrtaactatagccttgatgtggctgatcctgacaccgaaatgtctgtggatccctgcatggggcagctctatactcctgtctcttaaacctgcttcttaact

SEQ ID NO: 24710 - DNA, 201 bp, Homo sapiens
ttttatttggggttgtaaatgcagtgccaacaggttccaggtagataacaatgtaagcaatgagggctggatgggaggggataaatcccagatgacactcrcttcccttcgggggatgcaacacagaggggtgggaaccagcacaatctgcagaactcaggcccctgctgaggtgggacccacccagcctgtcaccatcag

SEQ ID NO: 24711 - DNA, 201 bp, Homo sapiens
gccaacatagtgaaacccccgtctctactaaaaaagtgcaaatcttagcccggcatagtggtggacgcctgtaatcccagctacttgggaggctgaggcgrgagaatcaccggaacccaaaggtggaggttgctgtgaagcaacatcatgccactgaactccagcctgggtgacagaatgagactccatctcaaaaaaaaa

SEQ ID NO: 24712 - DNA, 201 bp, Homo sapiens
ctctctgagcctcagtctcctgatctgtgaaatgggatgatagtcatagctcctacacaagacaagtggcaggtcagacgtgagaatgcacaggcaggccyttggcaactggataagctctacacaggtctggaaaggaggaggagacaaaagaggaggggcttccatggctggatagggcgtcttttggcgtgatgtgtt

SEQ ID NO: 24713 - DNA, 201 bp, Homo sapiens
ctgagcctcagtctcctgatctgtgaaatgggatgatagtcatagctcctacacaagacaagtggcaggtcagacgtgagaatgcacaggcaggcccttgrcaactggataagctctacacaggtctggaaaggaggaggagacaaaagaggaggggcttccatggctggatagggcgtcttttggcgtgatgtgttctga

SEQ ID NO: 24714 - DNA, 201 bp, Homo sapiens
tacaggacagatgtacacaaataggaatgcagcctgccattgtgtttcttcctttctcctctatcccttctcccatccctgggaaaccacagtagcagaastctcattcaatcaaatagctgtcaattatatgagttgcacttttctcttcctgaacagcaaactggctttcctcctctttgtcctcctctttctgcctgt

SEQ ID NO: 24715 - DNA, 201 bp, Homo sapiens
gctgggattacaggtatgagccactgggcccttccctgtcctgtgattttaaaataattataccagcagaaggacgtccagacacagcatgggctacctgrccatgcccagccagttggacatttgagttgtttgcttggcactgtcctctcatgcattgggtccactcagtagatgcttgttgaattcctgggcctgggg

SEQ ID NO: 24716 - DNA, 201 bp, Homo sapiens
gggacgcaggcgagcgtgtgttccatcccttccagccaggtctgtttggcagagcaactggattcctctaaccatggcttgtctgcaaaaacagtttcccraagagctgagttcagtgcaccacactccctccctaccttcatcccctgctccctctcctcccctcacccaaatgctgtccccttcacccaacagctttcc

SEQ ID NO: 24717 - DNA, 201 bp, Homo sapiens
tgtgcacaaccctcacaacactggtgacggtgggaagggaaagatgacaagccagggggcatgatcccagcatgtgtgggaggagcttctaaattatccaytagcacaagcccgtcagtggccccatgcataaatgtacacagaaacaggtgggggcaacagtgggagagaaggggccagggtataaaaagggcccacaag

SEQ ID NO: 24718 - DNA, 201 bp, Homo sapiens
tccctgtgacccctccccagtgcctctcctggtcgtggaaggtgctactccagtgcccaccagccttgtcctaataaaattaagttgcatcattttgtttsactaggtgtccttgtataatattatggggtggaggcgggtggtatggagcaaggggcaggttgggaagacaacctgtagggccttcagggtctattggga

SEQ ID NO: 24719 - DNA, 201 bp, Homo sapiens
aaacagtttcccaaagagctgagttcagtgcaccacactccctccctaccttcatcccctgctccctctcctcccctcacccaaatgctgtccccttcacycaacagctttccttcccaagggagcactagcagctccctgctttgagccaactcttctttcccactttccgtatgggcagggagtcccagatgaaaccta

SEQ ID NO: 24720 - DNA, 201 bp, Homo sapiens
gcttgtgtttctacagagtcaagtgctagatgctcttaaactcaggggggaagatttcaccactagagagggtgctctttcctgctctcatctctgggggyatctgatgcttgtgacctccagattatattgaagtagccccaaccctgggcaccaggagacaggaggctcagtcctggccttctctgccttcaccttgtc

SEQ ID NO: 24721 - DNA, 201 bp, Homo sapiens
cgctctgtggagggcagctgtggcttctagctgcccgggtggcatccctgtgacccctccccagtgcctctcctggtcgtggaaggtgctactccagtgcmcaccagccttgtcctaataaaattaagttgcatcattttgtttgactaggtgtccttgtataatattatggggtggaggcgggtggtatggagcaagggg

SEQ ID NO: 24722 - DNA, 201 bp, Homo sapiens
ctagcagctccctgctttgagccaactcttctttcccactttccgtatgggcagggagtcccagatgaaacctagggtgttcttatggatttggactaaawtataatgctgctctgtccatggtggccctggggcccctgcttcccatgtttgtttctcggtgggtaaggagctaggtaacagtgaactcagagatgagga

SEQ ID NO: 24723 - DNA, 201 bp, Homo sapiens
ggacatttgagttgtttgcttggcactgtcctctcatgcattgggtccactcagtagatgcttgttgaattcctgggcctggggctgtgtcagctgcctcrtcccatcaccttctggcttattctctccctccgtatcttagctttttacttcatgggaatgtttccaattcgaaatttctattttaccgttatatattta

SEQ ID NO: 24724 - DNA, 201 bp, Homo sapiens
tttgtttgtttgcttgtttttgagacaaagtcagtctcacttcttcgccctggctggagtgcagtagtgtgatctcggctcatgacaacctctgcctcccrggttcaagcaattctcgtgcctcagccgctccagtaactaggattatcggcaaatgccaccacccccgctaatttttctatttttagtagagatcagttt

SEQ ID NO: 24725 - DNA, 201 bp, Homo sapiens
atccacatgtctcagcctcccaaagtgttgggattacaggcatgagccaccacgccggcctatcctgagccttttgaagctgacgccagaggtgcaaagcscagcctctccccactggccacgtagaggctcttgttgggtagtctctcagcctgcagcagccagggatctggcctcaagtgatgccccaacagtgagcga

SEQ ID NO: 24726 - DNA, 201 bp, Homo sapiens
tggagaacagcccacagcacagtgccctcccagcaggtgatgagtctggggtgctggtccgataatgtttcaggaatgatggcagaaaatggagctctgtyttccgctctgaaagtggggagatggcagggccccagcattcacatcctaggccacaggggtgtgggttttcaatgttggttgccaacaccacagccaacc

SEQ ID NO: 24727 - DNA, 201 bp, Homo sapiens
taaaaatacaaaacattagccgggcatggcggtaggctcctgtagtccgagctactagggagcctgaggcaggagaatggcatgaacccaggggggcggascttgcagtgagccaagatcgcgccactgcactccagcctgggcgacagagcaagactcggtctcaaaaaaaaaaaaaaaagaaatccagcctcaaagagc

SEQ ID NO: 24728 - DNA, 201 bp, Homo sapiens
aagtgttgggattacaggcatgagccaccacgccggcctatcctgagccttttgaagctgacgccagaggtgcaaagcgcagcctctccccactggccacrtagaggctcttgttgggtagtctctcagcctgcagcagccagggatctggcctcaagtgatgccccaacagtgagcgacttcccagtactgtcaggggaa

SEQ ID NO: 24729 - DNA, 201 bp, Homo sapiens
aaaaatacaaaacattagccgggcatggcggtaggctcctgtagtccgagctactagggagcctgaggcaggagaatggcatgaacccaggggggcggagsttgcagtgagccaagatcgcgccactgcactccagcctgggcgacagagcaagactcggtctcaaaaaaaaaaaaaaaagaaatccagcctcaaagagct

SEQ ID NO: 24730 - DNA, 201 bp, Homo sapiens
tcagtggccccatgcataaatgtacacagaaacaggtgggggcaacagtgggagagaaggggccagggtataaaaagggcccacaagagaccagctcaagsatcccaaggcccaactccccgaaccactcagggtcctgtggacagctcacctagctgcaatggctacaggtaagcgcccctaaaatccctttgggcacaa

SEQ ID NO: 24731 - DNA, 201 bp, Homo sapiens
caatgaatgatagacatggtctccattgctcaaggctctgggaagatctagactagagaaaatgatcattgacttctacccacacctgtgggcctcagttmttccctctggtccatggttggcatggtaaccccttacaaaggtgtttccccaggggttcctagagtcctctgagtcaccataattctgcggtcaacagaa

SEQ ID NO: 24732 - DNA, 201 bp, Homo sapiens
gtccccaactagggcccctgccaccctctttcctaagggaggctgcagacttcttccatggccaaaaatccacatctaagtccccagcactggctaaaagrccctgtcatgggggctccctgtcccagctgacactggaggaaggatggtgggggaggcagggaccctcttctacttggagctcagggaccctcttccatt

SEQ ID NO: 24733 - DNA, 201 bp, Homo sapiens
aagggaggctgcagacttcttccatggccaaaaatccacatctaagtccccagcactggctaaaagaccctgtcatgggggctccctgtcccagctgacaytggaggaaggatggtgggggaggcagggaccctcttctacttggagctcagggaccctcttccattcccacctggctcctcctctttgctggtgctggaa

SEQ ID NO: 24734 - DNA, 201 bp, Homo sapiens
cttctggaagcgtttgcctgtttgtttgcttgtgtttctacagagtcaagtgctagatgctcttaaactcaggggggaagatttcaccactagagagggtsctctttcctgctgccatctctgggggcatctgatgcttgtgacctccagattatattgaaatagccccagctctgggcaccaggagacaggaggctcagt

SEQ ID NO: 24735 - DNA, 201 bp, Homo sapiens
agcccatcgcgcgcaccagctggccattgacacctaccaggagtttgtaagttcttggggaatgggtgcgggtcaggggtggcaagaaggggtgactttcycccactggggaagtaatgggaggagactaaggagctcagggttgttttctgaagcgaaaatgcaggcagatgagcataggctgagccaggttcccagaaa

SEQ ID NO: 24736 - DNA, 201 bp, Homo sapiens
accatagcaacattccagtgaacatttcttgactgatttgggagaaaacatctggttctgtgattcctcacgccttctccgagggtgaatatactctttcycaaggacagggaaagaagctgaaacataaaatcatatgaacattttcacaagaagattcctcttgaagcttcaaggaaattgtttacagacagaagaaaa

SEQ ID NO: 24737 - DNA, 201 bp, Homo sapiens
ccaactttgagattctctgttggtttcaggactatgggaggaagcgcttgtggtccgtgtctgttcccgggatttctgtttcttggtttgtatctctgctwcaggtccaaggagctggggcaataccttgagtctgggttattcgtccccagggacctgggggagccccaccgcctccgccccaaggttcagggaaagggg

SEQ ID NO: 24738 - DNA, 201 bp, Homo sapiens
ctcacacaggcttccctggagaacagcccacagcacagtgccctcccagcaggtgatgagtctgtggtgctggtccggtaatgcttcaggaatgatggcaraaaaaggagctctgtcttccgctctgaaagtggggagatggcagggccccagcattcacatcctaggccacaggggtgtgggttttcaatgttggttgcc

SEQ ID NO: 24739 - DNA, 201 bp, Homo sapiens; identical to SEQ ID NO: 4830

SEQ ID NO: 24740 - DNA, 201 bp, Homo sapiens
cagtgccttcccaaccattcccttatccaggctttttgacaacgctatgctccgcgcccgtcgcctgtaccagctggcatatgacacctatcaggagtttrtaagctcttgggtaatgggtgcgcttcagaggtggcaggaaggggtgactttcccccgctgggaagtaatgggaggagactaaggagctcagggttgttt

SEQ ID NO: 24741 - DNA, 201 bp, Homo sapiens; identical to SEQ ID NO: 4709

SEQ ID NO: 24742 - DNA, 201 bp, Homo sapiens
atgggaggagactaaggagctcagggttgttttctgaagtgaaaatgcaggcagatgagcatacgctgagtgaggttcccagaaaagtaacaatgggagcwggtctccagcatagaccttggtgggcggtccttctcctaggaagaagcctatatcctgaaggagcagaagtattcattcctgcagaacccccagacctcc

SEQ ID NO: 24743 - DNA, 201 bp, Homo sapiens
ttctggaagcgtttgcctgtttgtttgcttgtgtttctacagagtcaagtgctagatgctcttaaactcaggggggaagatttcaccactagagagggtgstctttcctgctgccatctctgggggcatctgatgcttgtgacctccagattatattgaaatagccccagctctgggcaccaggagacaggaggctcagtc

SEQ ID NO: 24744 - DNA, 201 bp, Homo sapiens
ggtttggctgttcctgggccagaaaaaggctgacatatcactgctgtctattactcactaaggccattccaccagctcagtggtcccagcttgctggtcayagctcattggtcatcccagagatgacttgaaggcatttcttcctcccccaccatcaccagcaacaccaaacctagccccccaggagcgggaagaaatgaa

SEQ ID NO: 24745 - DNA, 201 bp, Homo sapiens; identical to SEQ ID NO: 4959

SEQ ID NO: 24746 - DNA, 201 bp, Homo sapiens
tattcattcctgcatgactcccagacctccttctgcttctcagactctattccgacaccctccaacatggaggaaacgcaacagaaatccgtgagtggatkccgtctcccctaggcggggatgggggagacctgtggtcagggctcccgggcagcacagccactgccggtccttcccctgcagaatctagagctgctccgc

SEQ ID NO: 24747 - DNA, 201 bp, Homo sapiens
atgccagtaatctcagtactttgggaggccagggagggtggatcacctaaagtcaagagctcgagaccagcctggccaacatagtgaaaccccgtctctayttaaaaagtacaaaacttagcccggcatagtggcgggcgcctgtaatcccagctactagggaggctgaggcgggagaatcactggaacccaggaggtgga

SEQ ID NO: 24748 - DNA, 201 bp, Homo sapiens; identical to SEQ ID NO: 4960

SEQ ID NO: 24749 - DNA, 201 bp, Homo sapiens
tgtaatcccagctactagggaggctgaggcgggagaatcactggaacccaggaggtggaggttgctgtgaggcaacatcatgccactgcactccagcctcrgagacagaatgagactccatcaaaaacaagaaagaaagaaagacaaagagagaaagaaagaaagaaagaaagaaagaaagagagagagagagagagagag

SEQ ID NO: 24750 - DNA, 201 bp, Homo sapiens; identical to SEQ ID NO: 4961

SEQ ID NO: 24751 - DNA, 201 bp, Homo sapiens
catgccactgcactccagcctcggagacagaatgagactccatcaaaaacaagaaagaaagaaagacaaagagagaaagaaagaaagaaagaaagaaagaragagagagagagagagagagagagaaagaaagaaagaaagaaagaaagaaagaaagaaagaaagaaagaaagaaagaaagaaggaaagaaagaaaggaaa

SEQ ID NO: 24752 - DNA, 201 bp, Homo sapiens
cattcctgcgcatcgtgcagtgccgctctgtggagggcagctgtggcttctagctgcccgggtggcatccctgtgacccctccccagtgcctctcctggtsgtggaaggtgctactccagtgcccaccagccttgtcctaataaaattaagttgcatcattttgtttgactaggtgtccttgtataatattatggggtgga

SEQ ID NO: 24753 - DNA, 201 bp, Homo sapiens
gggaagagcaaggttgtggagatctgctgccctggctgaggtagctcatgcaatcagtctctctgagcctcagtctcctgatctgtgaaatgggatgatastcatacctcctacacaagacaagttgcaggtcagacgtgagaatgcacaggcaggcctttgacaactggataagctctacacaggtctggaaaggaggaa

SEQ ID NO: 24754 - DNA, 201 bp, Homo sapiens
gggagtcccagatgaaacctagggtgttcttatggatttggactaaatgataaccctgctctgtccatggtggccctggggcccctgcttcccatgtttgyttctcggtgggtaaggagctaggtaacggtgaactcagagatgaggatttttctacttttctttttggttttttttggttgtttgtttgttttggagaca

SEQ ID NO: 24755 - DNA, 201 bp, Homo sapiens
tgcagaaacagtatcccaaggagctgagttcagtgcaccacactccctccctacttcaccccctgctccctctcctcccctcacccaaatgctgtcccctycacccaacagctttccttcccaagggagcactagcagctccctgctttgagccaactcttctttcccactttccgtatgggcagggagtcccagatgaaa

SEQ ID NO: 24756 - DNA, 201 bp, Homo sapiens
tgttggtttcaggactatgggaggaagcgcttgtggtccgtgtctgttcccgggatttctgtttcttggtttgtatctctgctacaggtccaaggagctgrggcaataccttgagtctgggttattcgtccccagggacctgggggagccccaccgcctccgccccaaggttcagggaaaggggagagcaatgtgtggggt

SEQ ID NO: 24757 - DNA, 201 bp, Homo sapiens
acatctccctgctgctcatcgagtcgcggctggagcccgtgcggttcctcaggagtaccttcaccaacaacctggtgtatgacacctcggacagtgatgamtatcacctcctaaaggacctagaggaaggcatccaaatgctgatgggggtgagggtggcaccaggggtccccaatcctggaagcccactggcttcgaggg

SEQ ID NO: 24758 - DNA, 201 bp, Homo sapiens
tccgaggcccttcctccgtgcctgaaccccctggacatatcatgtggcaaactgaagggtccaacgacatacaggaagcgaaacacgatgtacactgaaaygtgcaatacaaatatgcagcatgaagtgcctcggttcactaacccgagctacgttgggtgcctcttttctaccacttttcttaatgcctatggacacctc

SEQ ID NO: 24759 - DNA, 201 bp, Homo sapiens
cgcttgtggtccgtgtctgttcccgggatttctgtttcttggtttgtatctctgctacaggtccaaggagctggggcaataccttgagtctgggttattcrtccccagggacctgggggagccccaccgcctccgccccaaggttcagggaaaggggagagcaatgtgtggggttggttctctctagtggtcagtgttagc

SEQ ID NO: 24760 - DNA, 201 bp, Homo sapiens
gaaacacgatgtacactgaaatgtgcaatacaaatatgcagcatgaagtgcctcggttcactaacccgagctacgttgggtgcctcttttctaccactttycttaatgcctatggacacctcattctgtggctgaagttccttgtgttcaattccccccatcttcattgaacatcctctgtgcagggacttgacccctgtc

SEQ ID NO: 24761 - DNA, 201 bp, Homo sapiens
gtccgtgtctgttcccgggatttctgtttcttggtttgtatctctgctacaggtccaaggagctggggcaataccttgagtctgggttattcgtccccagkgacctgggggagccccaccgcctccgccccaaggttcagggaaaggggagagcaatgtgtggggttggttctctctagtggtcagtgttagcactgcatc

SEQ ID NO: 24762 - DNA, 201 bp, Homo sapiens; identical to SEQ ID NO: 4802

SEQ ID NO: 24763 - DNA, 201 bp, Homo sapiens; identical to SEQ ID NO: 4804

SEQ ID NO: 24764 - DNA, 201 bp, Homo sapiens
acaggcttccctggagaacagcccacagcacagtgccctcccagcaggtgatgagtctgtggtgctggtccggtaatgcttcaggaatgatggcaaaaaawggagctctgtcttccgctctgaaagtggggagatggcagggccccagcattcacatcctaggccacaggggtgtgggttttcaatgttggttgccaacac

SEQ ID NO: 24765 - DNA, 201 bp, Homo sapiens
atcacttaggaactgggagagctccaggcaagccaccttatctctttgggcctcagtatcctcactcacatccccatggtcagtagagtgccaagcacatrgtggacacgcagaagtattgatcatcttcctcacctcccctaggagagcccttgggaatccccatataatattctctgaagacctcaatccaatgagcca

SEQ ID NO: 24766 - DNA, 201 bp, Homo sapiens
tcacatccctatggtcagtagagtgccaagcacatggtggacacacagaagtattgatcatcttcctcacctcccctaggagagcccttgggaatccccayataatattctctgaagacctcaatccaatgagccgagtaattgactcagtagcaaactcatagaaaggacattagaagccaaaaggaggtagagtatgtc

SEQ ID NO: 24767 - DNA, 201 bp, Homo sapiens
atacagagtcttactctgtcacccaggctggagtgcagtggcatgatctcggctcgctacaacctccacctcccgggttcaagcaattccctgccacagcsacctgagtagctcggattacatgcgcctgccaccacgcgcagctaatttttgtatttttagtagagacgggatttcaccatcttgaccaggttggtctta

SEQ ID NO: 24768 - DNA, 201 bp, Homo sapiens
gtctaattcaaagttgattttttactagcaatgaatgatagacatggtctccattgctcaagggaagatctagactagagaaaaggatcaccaacttctayccacacctgtgggcctcagttcttccctctggtccatggttgccatggtaaccccttataaaggtgtttccccaggggtccctaacgtcctctgagtcac

SEQ ID NO: 24769 - DNA, 201 bp, Homo sapiens; identical to SEQ ID NO: 4805

SEQ ID NO: 24770 - DNA, 201 bp, Homo sapiens; identical to SEQ ID NO: 4833

SEQ ID NO: 24771 - DNA, 201 bp, Homo sapiens
tacacagaaacaggtgggggcaacagtgggagagaaggggccagggtataaaaagggcccacaagagaccagctcaaggatcccaaggcccaactccccgmaccactcagggtcctgtggacagctcacctagctgcaatggctacaggtaagcgcccctaaaatccctttgggcacaatgtgtcctgaggggagaggcag

SEQ ID NO: 24772 - DNA, 201 bp, Homo sapiens
cccctgcccccctcattcctaagggaggcttcccttacgaatggccaaaaatccacatctaagtccccagaactggctaaaaggtcctgtcatgggggctccctgtcccagctgacattggaagaaggatggtgagggaggcagggaccctcttctacttggagctcagggacccacttccattcccacctggctcctcct

SEQ ID NO: 24773 - DNA, 201 bp, Homo sapiens; identical to SEQ ID NO: 4806

SEQ ID NO: 24774 - DNA, 201 bp, Homo sapiens; identical to SEQ ID NO: 4838

SEQ ID NO: 24775 - DNA, 201 bp, Homo sapiens
gggaggcttcccttacgaatggccaaaaatccacatctaagtccccagaactggctaaaaggtcctgtcatgggggctccctgtcccagctgacattggargaaggatggtgagggaggcagggaccctcttctacttggagctcagggacccacttccattcccacctggctcctcctctttgctggtgctgggaggagc

SEQ ID NO: 24776 - DNA, 201 bp, Homo sapiens; identical to SEQ ID NO: 4807

SEQ ID NO: 24777 - DNA, 201 bp, Homo sapiens; identical to SEQ ID NO: 4841

SEQ ID NO: 24778 - DNA, 201 bp, Homo sapiens; identical to SEQ ID NO: 4843

SEQ ID NO: 24779 - DNA, 201 bp, Homo sapiens
cagagctggtatcattgatgacacccctcttggatcctcacacaggcttccctggagaacagcccacagcacagtgccctcccagcaggtgatgagtctgkggtgctggtccggtaatgcttcaggaatgatggcaaaaaaaggagctctgtcttccgctctgaaagtggggagatggcagggccccagcattcacatcct

SEQ ID NO: 24780 - DNA, 201 bp, Homo sapiens; identical to SEQ ID NO: 4808

SEQ ID NO: 24781 - DNA, 201 bp, Homo sapiens; identical to SEQ ID NO: 4712

SEQ ID NO: 24782 - DNA, 201 bp, Homo sapiens; identical to SEQ ID NO: 4844

SEQ ID NO: 24783 - DNA, 201 bp, Homo sapiens
cctctgttgccctctggtttctccccaggctcccggacgtccctgctcctggcttttggcctgctctgcctgccctggcttcaagagggcagtgccttccmaaccattcccttatccaggctttttgacaacgctatgctccgcgcccatcgtctgcaccagctggcctttgacacctaccaggagtttgtaagctcttgg

SEQ ID NO: 24784 - DNA, 201 bp, Homo sapiens
cctaggccacaggggtgtgggttttcaatgttggttgccaacaccacagccaaccacttctagaagcatttgcctgtttgcttgcttgtgtttctacagcrtcaagtgctacatgctcttaaactcagggtgggagaagatttcaccactacagagggtgttctttcctgctctcatctctgggggcatctgatgcttgtg

SEQ ID NO: 24785 - DNA, 201 bp, Homo sapiens
cttggcaaaaccccgtcactactaaaaatacaaaaattagctaggcgtggtggcacatgcctgtaatcccagctacttgggaggctgaggcaaggagaatygcttgaacctgggaggcagaggttgcaatgagctgagatagcgccattgcactccagcctgggcaacaagagagaaactctgtctcaaaagaaaaaaaaa

SEQ ID NO: 24786 - DNA, 201 bp, Homo sapiens
gtgggtggatcacctgaggtcaggagttcgagaccagtctggccaacttggcaaaaccccgtcactactaaaaatacaaaaattagctaggcgtggtggcrcatgcctgtaatcccagctacttgggaggctgaggcaaggagaattgcttgaacctgggaggcagaggttgcaatgagctgagatagcgccattgcactc

SEQ ID NO: 24787 - DNA, 201 bp, Homo sapiens
gggggtctcaccacgttggtcaggctagtctcgaactcctgacctcaggtgatccacccacctcggcctcccaaagtattgggattacaggcgtgagccaygcacccagcctaggacttggtttttctaacttttattcctctgaatccaggttggtcatgcagcattaaactttgacaaggccactgacatcgtgacagg

SEQ ID NO: 24788 - DNA, 201 bp, Homo sapiens
gataagaggttgttgtgttggtggtatatttagtttggatttaggagaatatatattatgtggttcactgacacttctatatctagttaactgattgatarctgccttagtgtagaaatggcttccaggaaaactcctaccacccactgtgccaatttcacctggcattatgatactaaattgcaggtgtgttcagcagct

SEQ ID NO: 24789 - DNA, 201 bp, Homo sapiens
gcgccaccatgcccagctaattttgaatttttagtagagatgggggtctcaccacgttggtcaggctagtctcgaactcctgacctcaggtgatccacccmcctcggcctcccaaagtattgggattacaggcgtgagccacgcacccagcctaggacttggtttttctaacttttattcctctgaatccaggttggtcat

SEQ ID NO: 24790 - DNA, 201 bp, Homo sapiens
gcaattctcctgccttagcctcccgagtaactgggattacaggcatgcgccaccatgcccagctaattttgaatttttagtagagatgggggtctcaccaygttggtcaggctagtctcgaactcctgacctcaggtgatccacccacctcggcctcccaaagtattgggattacaggcgtgagccacgcacccagcctag

SEQ ID NO: 24791 - DNA, 201 bp, Homo sapiens
gctgtcctcgaagacagtcttagattcttaaaattaaatcttattttatttttttggagacagtgtcttgctctgttgcccaggctggagtgcagtggtgygatctcagctcactgcaacctctgctgcctcctgggttcaagcgattcttatgcctcagcatcccatgtggctggaattacaagcatgcaccaccacgcg

SEQ ID NO: 24792 - DNA, 201 bp, Homo sapiens
tcatctgcctctatttcacatctactttctctgttggttttttagattggacaagctgtcctcgaagacagtcttagattcttaaaattaaatcttatttwatttttttggagacagtgtcttgctctgttgcccaggctggagtgcagtggtgtgatctcagctcactgcaacctctgctgcctcctgggttcaagcgat

SEQ ID NO: 24793 - DNA, 201 bp, Homo sapiens
tctcccgagtgtctgggattacaggcgcccaccaccacacttggctaatttttgtatttttagcagagatggggtttcaccatgttggccaggctggtctygaactcctgatctcaagtgatccacccgccttggcttcccaaggtgctgggattacaggcgtgagccactgcgcctggccaaaaagctgcctttaaaaaa

SEQ ID NO: 24794 - DNA, 201 bp, Homo sapiens
agtgattctccttcctcagtctcccgagtgtctgggattacaggcgcccaccaccacacttggctaatttttgtatttttagcagagatggggtttcaccrtgttggccaggctggtcttgaactcctgatctcaagtgatccacccgccttggcttcccaaggtgctgggattacaggcgtgagccactgcgcctggcca

SEQ ID NO: 24795 - DNA, 201 bp, Homo sapiens
tcgagtgattctccttcctcagtctcccgagtgtctgggattacaggcgcccaccaccacacttggctaatttttgtatttttagcagagatggggtttcrccatgttggccaggctggtcttgaactcctgatctcaagtgatccacccgccttggcttcccaaggtgctgggattacaggcgtgagccactgcgcctgg

SEQ ID NO: 24796 - DNA, 201 bp, Homo sapiens
cctgtgcaggtagaagcaaactgctgctttgcaaagatctcagggatagaaaagctgctttatttatttatttattttatttattttgagacggagtctcrctctgtcacccaggctggaatgcagtggcgcgacctgggctcactgcgacctcctgggttcgagtgattctccttcctcagtctcccgagtgtctgggat

SEQ ID NO: 24797 - DNA, 201 bp, Homo sapiens
gaaagaaagaaagaaagaaagaaagagaaagagagagaaagaaagaaagaaagaaagaaagaaagaaagaaagaaagaaagaaagaaagaaagaaaggaargaaggaaggaaggaaagaaagaaaaagaaagaaagagaaagagaaggaaaatatgtgtatggtatatataccattttaatcatttcttaaagtaaacatt

SEQ ID NO: 24798 - DNA, 201 bp, Homo sapiens
tgctagctacacaaataaagaatagaccactagctacactaataaagaaaaaagagagacaatccaaaaaacacaatcagaaatggcaaagaggacattaygactgaccgcacagaaattaaaaaaaaaaaaaccctcagagactactatgaacatctctatgcacacaaactaaaaaaaaaaacaacctagaagaaatgg

SEQ ID NO: 24799 - DNA, 201 bp, Homo sapiens
tgtagagtctcctatcatttgcattgaaaagatcatttaaatgcatgttctccagaagaattcacaaaataataacattacctctggggatctggaggggyaggaggatttgctttttactattgtactgttgtactttcagattttgtaccatatacatatattacctatttagaaagtaattttctaataagatagata

SEQ ID NO: 24800 - DNA, 201 bp, Homo sapiens
tcttgttaggagctgttactgttattattcttattattactcttattgttattatcatcattattattagttcagtcctgtgctgggtcttatgaaggatrtctatggggttcctacctttaagaaacttccagtatcactggcaacaggcaattacaaggggatcttgaagagaaaaaactaatagttcttgcatgttgt

SEQ ID NO: 24801 - DNA, 201 bp, Homo sapiens
aaatcatgttttttaatatttgtaaagcaatttgaaagagaaagatgattccatgccgattattgggctcatcaagaccagttagttaaaaaatacaactrtgggtcagatgagaggacagaggcaaataacatgcaattgttcatgttgtcaaatcacaagtatttggaatttcaatctgttttcattttctgtcatctc

SEQ ID NO: 24802 - DNA, 201 bp, Homo sapiens
ggtttaatgggagctaatacatatgtacttgctatgtgccaggcatttttctaatttatttacatgttcttatttaatccttaaaacaaccctatgtggtragtactatttttatccccattttacaggtgggaaagctgaaacagagagaggttaagaaattttcccttgtcggacattgtggctcacgcctgtaatccc

SEQ ID NO: 24803 - DNA, 201 bp, Homo sapiens
aaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaac

SEQ ID NO: 24804 - DNA, 201 bp, Homo sapiens
agaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaa

SEQ ID NO: 24805 - DNA, 201 bp, Homo sapiens
aagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagta

SEQ ID NO: 24806 - DNA, 201 bp, Homo sapiens; identical to SEQ ID NO: 5099

SEQ ID NO: 24807 - DNA, 201 bp, Homo sapiens
taaatcccatccagtcccgaaacacggtgagttgactttctagcaaagcatctgagatctggtcatgagcaggaagtgcacaggtggacattgtgtcaggstgacatttctcctttcacagacagtggagtatgtgacattcaccagcattgctggtctcactggagtgatcatgacaatagccttgattctcatggtaac

SEQ ID NO: 24808 - DNA, 201 bp, Homo sapiens
aaagaaagaaagaaagaaagaaagaaagaaagagaaagagagagaaagaaagaaagaaagaaagaaagaaagaaagaaagaaagaaagaaagaaagaaagraaggaaggaaggaaggaaggaaagaaagaaaaagaaagaaagagaaagagaaggaaaatatgtgtatggtatatataccattttaatcatttcttaaagt

SEQ ID NO: 24809 - DNA, 201 bp, Homo sapiens
aggaagaaaagaaagaaagaaagaaagaaagaaagaaagaaagagaaagagagagaaagaaagaaagaaagaaagaaagaaagaaagaaagaaagaaagaragaaagaaagaaaggaaggaaggaaggaaggaaagaaagaaaaagaaagaaagagaaagagaaggaaaatatgtgtatggtatatataccattttaatca

SEQ ID NO: 24810 - DNA, 201 bp, Homo sapiens
tgaccttgcataattctttgtcccaaaccatccttctttgtctatttcagtggaattgtccggggtcaaacagaggagagcatgaatgagagtcatcctcrcaagtgtgcagagtcttttgagatgtgggatgatcgtgactcccactgtaggcgccctaagtttgaagggcatccccctgaggtaagagccctacgggca

SEQ ID NO: 24811 - DNA, 201 bp, Homo sapiens
cttggcttcccaaagtgttgggattacaggcgtgagccaccgcacccggccttgaaacatttgttttaaaatagttggccaggagtggtggctcatgcctrtaatcccagcactttgggaggctgaggcaggtggatcattcgaggccagcagttccagaccagcctggccagcatggtgaatctccatctctactgaaaa

SEQ ID NO: 24812 - DNA, 201 bp, Homo sapiens
gagacagtctccctctgttactcaggctagagtgcagtggtgtgatcttgtctcactgcaacctctgcctcctgggttcaagtgattctcctgcctcagcytcccaagtagctgggactacaggcgcgcaccaccacgccctgctaatttttgtatatttagtagagacggggttttgccacgttgaccagactggtctcg

SEQ ID NO: 24813 - DNA, 201 bp, Homo sapiens
actctgaagccatcttggtaaatttccccaacagtgtgaagttagcattccttcagggtgatgccaggttctatttggaatttatatacaacctgcttggrtggagaagccattgtcttcagaaaccttggtgtaattgaattgatagttactgttgtgacctgaagttcaccattaaaagggactacccaagcaaaatca

SEQ ID NO: 24814 - DNA, 201 bp, Homo sapiens
tccaacaaagggttttaatgtagattttttttgcacccatgcaaaaaattgctatatgtgatagtctgatcatgacgctgaataaatgtctttttttttttaatgtgctgtgtaaagttagtctactctgaagccatcttggtaaatttccccaacagtgtgaagttagcattccttcagggtgatgccaggttctatttg

SEQ ID NO: 24815 - DNA, 201 bp, Homo sapiens
tcttaaattcatgctctgctcaccttgggaaaatacagataacaatttgattcgctatgaagtagagcagataagcagcagaggaagaagtttaaatccayagtcaattatgcattaatgacagcaggagttcaattataacaccagtgagtggagatctagagaaatgaacatacattggcatatttaaatgtgctgcaa

SEQ ID NO: 24816 - DNA, 201 bp, Homo sapiens
ttaattgggaatcaaagcttagcaggagaggagagccagagaagtgacagagaagctacaggttacaacagattcatgaactcagccaaacacagtggtgrcagggcctagctgccacaaagaagacatgttttatacaaatactcatgtttatgggcaaaaaagtcaaggactgtatttgtgactaattgtataacaggt

SEQ ID NO: 24817 - DNA, 201 bp, Homo sapiens
actcacaatctgaaaacagaaaaatgtgtgtcagggtgtaattaaaaaggcaggcccatctggaatggtttagttcttttcagttaggtattgttataggygctaaatttgttctttgtttcttcagatatccatttattcacttattgccatcttttaggtgcaacagtttgaatgctctagtccaagaaatggcaaatg

SEQ ID NO: 24818 - DNA, 201 bp, Homo sapiens
tgtccctgtcgtcattagagtttgctttctttggtctatgtgcttcattcacaggttgttatgcacccatccaaagttttggaattgcagatgaacaagcrtggcttcagcatggaagtggggcagtatatctttgttaattgcccctcaatctctctcctggaatggcatccttttactttgacctctgctccagaggaa

SEQ ID NO: 24819 - DNA, 201 bp, Homo sapiens
aacatggtgaaaccccatctctaataaaaatacaaaatttagctgggcatgctggtgcgtgcctgtagtcccagctactcaggaggctgaggcaggaaaawtgcttgaacctgggaggtggaggttgcagtgaaccgagattgtgccactgcactccagctgggggacagagcaagactccatctcaaaaaaagaaaagaa

SEQ ID NO: 24820 - DNA, 201 bp, Homo sapiens
gccaacatggtgaaaccccatctctaataaaaatacaaaatttagctgggcatgctggtgcgtgcctgtagtcccagctactcaggaggctgaggcaggaraattgcttgaacctgggaggtggaggttgcagtgaaccgagattgtgccactgcactccagctgggggacagagcaagactccatctcaaaaaaagaaaa

SEQ ID NO: 24821 - DNA, 201 bp, Homo sapiens
aaaaacacaaattatcccataacaaagtgtgcaaagtctcaaaaaaaaaaaaaagtgggcaaaggacataaagaaacacttttcaaaagaagacacacacrcagccaacaagcatatgaaaaaatgctcaacatcgccgatcattagagaaatgcaaatccaaaccacaatgacacaccatctcacgccagtcagaatggc

SEQ ID NO: 24822 - DNA, 201 bp, Homo sapiens
gaggttaagaaattttcccttgtcggacattgtggctcacgcctgtaatcccagcacttagggaggctgaggcaggcggatcacttgaggtcaggagtttkagaccagcctggccaacatggtgaaaccccatctctaataaaaatacaaaatttagctgggcatgctggtgcgtgcctgtagtcccagctactcaggagg

SEQ ID NO: 24823 - DNA, 201 bp, Homo sapiens
gcagcacatcaaaaagctaatccaccacgatcaagtaggctttatccctgggatgcaagtttggttcaacatatgcaaatcaataaatgtgattcatcacrtaaagagaactaaagacaaaaatcatatgatcatctcagtagatacacaaaaggctttcaataaaattcaacattccttcatatgaaaaactctcagcaa

SEQ ID NO: 24824 - DNA, 201 bp, Homo sapiens
ggtggctcacacctgtaatcccagcaatttgggaggctgaggtgggtggattgcttgagcccaggagtttgagaccagcctgggcaacatggcaaaaccckatctctacaaaaaatacaaaaattagttgggcatggtggtgtggagggtgaggtgaaaggattacttgagcctgggaggctgaggctgcagtgagctgta

SEQ ID NO: 24825 - DNA, 201 bp, Homo sapiens
gggccgggcacggtggctcacacctgtaatcccagcaatttgggaggctgaggtgggtggattgcttgagcccaggagtttgagaccagcctgggcaacayggcaaaaccccatctctacaaaaaatacaaaaattagttgggcatggtggtgtggagggtgaggtgaaaggattacttgagcctgggaggctgaggctgc

SEQ ID NO: 24826 - DNA, 201 bp, Homo sapiens
gcctgggcaacatggcaaaaccctgtctctaccaaaaatacaaaaattggctgggtatggtggtgcacgcctgtagtcccagctactcaggaggctgaggygggaggatggcttgagcccaggaggcagaggatgcagtgagccgatatctcgccactgcactccagcctgggcaatagtgccagaccttgtctcaaaaag

SEQ ID NO: 24827 - DNA, 201 bp, Homo sapiens
atttcagtggaattgtccggggtcaaacagaggagagcatgaatgagagtcatcctcgcaagtgtgcagagtcttttgagatgtgggatgatcgtgactcycactgtaggcgccctaagtttgaagggcatccccctgaggtaagagccctacgggcaaggacagactcttgttaggagctgttactgttattattcttat

SEQ ID NO: 24828 - DNA, 201 bp, Homo sapiens
gctcaggagttccagaccagcctgggcaacatggcaaaaccctgtctctaccaaaaatacaaaaattggctgggtatggtggtgcacgcctgtagtcccasctactcaggaggctgaggtgggaggatggcttgagcccaggaggcagaggatgcagtgagccgatatctcgccactgcactccagcctgggcaatagtgc

SEQ ID NO: 24829 - DNA, 201 bp, Homo sapiens
agtctattgccttcttgggctaagctctttacaattgataagggagcaacctatccctggagttatgagaataagtgatcacttctcttggccaggacatycacttctacagatttatcataagaacagggtcttcttttcaatttggagtttaagatcaccctgaccaaagatgttggaaggctcgttcctaaggaaaat

SEQ ID NO: 24830 - DNA, 201 bp, Homo sapiens
gcgggcgcctgtagtcccagctactcgggagactgaggcagaagaatggcgtgaacccagaaggcggagcttgcagtgagccgagatcgcgccactgcacyccagcctgggcgacagagccagactctgtctcaaaaataaatacataaataaataaatactttttttttgtagacatgaggtctccgtgttgctcaggct

SEQ ID NO: 24831 - DNA, 201 bp, Homo sapiens
tgttaattgcccctcaatctctctcctggaatggcatccttttactttgacctctgctccagaggaagatttcttctccattcatatccgagcagcagggractggacagaaaatctcataagggctttcgaacaacaatattcaccaattcccaggtaggtccttgagaccaggagagtcccagaccaggatgcagactg

SEQ ID NO: 24832 - DNA, 201 bp, Homo sapiens
gaggccgaggcgggcggatcacgaggtcaggagatcgagaccacggtgaaaccccatctctactaaaaatacaaaaaattagccaggcgtggtggcgggcscctgtagtcccagctactcgggagactgaggcagaagaatggcgtgaacccagaaggcggagcttgcagtgagccgagatcgcgccactgcactccagcc

SEQ ID NO: 24833 - DNA, 201 bp, Homo sapiens
agtagctgctgccctctttagagaggacttgtgtttgtagttcaccactgtcaccagccctccagcttcactcatttgctttatctgcctgtccctgtcgycattagagtttgctttctttggtctatgtgcttcattcacaggttgttatgcacccatccaaagttttggaattgcagatgaacaagcgtggcttcagca

SEQ ID NO: 24834 - DNA, 201 bp, Homo sapiens
tttaaaaacatttttttgccaggcgctgtggctcacgcctgtaatcccagcactttgggaggccgaggcgggcggatcacgaggtcaggagatcgagaccmcggtgaaaccccatctctactaaaaatacaaaaaattagccaggcgtggtggcgggcgcctgtagtcccagctactcgggagactgaggcagaagaatgg

SEQ ID NO: 24835 - DNA, 201 bp, Homo sapiens
cagtggcgcgacctgggctcactgcgacctcctgggttcgagtgattctccttcctcagtctcccgagtgtctgggattacaggcgcccaccaccacactyggctaatttttgtatttttagcagagatggggtttcaccatgttggccaggctggtcttgaactcctgatctcaagtgatccacccgccttggcttccca

SEQ ID NO: 24836 - DNA, 201 bp, Homo sapiens
aaatccataatttaaaaacatttttttgccaggcgctgtggctcacgcctgtaatcccagcactttgggaggccgaggcgggcggatcacgaggtcaggaratcgagaccacggtgaaaccccatctctactaaaaatacaaaaaattagccaggcgtggtggcgggcgcctgtagtcccagctactcgggagactgaggc

SEQ ID NO: 24837 - DNA, 201 bp, Homo sapiens
acccaggctggaatgcagtggcgcgacctgggctcactgcgacctcctgggttcgagtgattctccttcctcagtctcccgagtgtctgggattacaggcrcccaccaccacacttggctaatttttgtatttttagcagagatggggtttcaccatgttggccaggctggtcttgaactcctgatctcaagtgatccacc

SEQ ID NO: 24838 - DNA, 201 bp, Homo sapiens
tttagtttggatttaggagaatatatattatgtggttcactgacacttctatatctagttaactgattgatagctgccttagtgtagaaatggcttccagraaaactcctaccacccactgtgccaatttcacctggcattatgatactaaattgcaggtgtgttcagcagctaatgaaaatgttgtttttatgggttttg

SEQ ID NO: 24839 - DNA, 201 bp, Homo sapiens
agaggttaagaaattttcccttgtcggacattgtggctcacgcctgtaatcccagcacttagggaggctgaggcaggcggatcacttgaggtcaggagttygagaccagcctggccaacatggtgaaaccccatctctaataaaaatacaaaatttagctgggcatgctggtgcgtgcctgtagtcccagctactcaggag

SEQ ID NO: 24840 - DNA, 201 bp, Homo sapiens
tgaaacagagagaggttaagaaattttcccttgtcggacattgtggctcacgcctgtaatcccagcacttagggaggctgaggcaggcggatcacttgagrtcaggagtttgagaccagcctggccaacatggtgaaaccccatctctaataaaaatacaaaatttagctgggcatgctggtgcgtgcctgtagtcccagc

SEQ ID NO: 24841 - DNA, 201 bp, Homo sapiens
gccaacatggcgaaaccccatctctaataaaaaaaaaaaaattagctgagcgtggtggtgcccacctgtaattccagctacttgggaggctgaggcgggaraatcgcttgaacccgggaggcagaggttgcagtgagttgaaatagcgccactacactccagcctgggtgacagagagaggctctgtctcaaaaaaaaaag

SEQ ID NO: 24842 - DNA, 201 bp, Homo sapiens
attaaaaaaaaaaaaggtgaaaagaattagctgggcatggtggcgggcacctgtaatcccagctactagggaggctgaggcaggagaatcgcttgaacccrggaggtggaggttgcagtgaccccagatcataccattgtactccagcccgggtgacagtgcaagactctgtctcaaaaaaaaaaaaaaaaaaaaaacaca

SEQ ID NO: 24843 - DNA, 201 bp, Homo sapiens
ggctcatgcctgtaatcccagcactttgggaggccgaggtgggtggatcacgaggtcaggagatcgagaccatcctggctaacacggtgaaaccctgtctytactaaacatacaaaaaaaaattagccgggtgcggtggcgggcgcctgtagtcccagctacttgggaagctgaggcaggagagtggcgtgaacccaggag

SEQ ID NO: 24844 - DNA, 201 bp, Homo sapiens
atggtggctcgcgcctgtaatcccagcactttgggaggccaaggcagatggatcacgaggtcaggagttcaagaccagcctggccaacatagtgaaacctygtctctactaaaaatacaaaaaattaggccgggcgtggtggctcatgcctgtaatcccagcactttgggaggccgaggtgggtggatcacgaggtcagga

SEQ ID NO: 24845 - DNA, 201 bp, Homo sapiens
gggcatggtggctcgcgcctgtaatcccagcactttgggaggccaaggcagatggatcacgaggtcaggagttcaagaccagcctggccaacatagtgaamccttgtctctactaaaaatacaaaaaattaggccgggcgtggtggctcatgcctgtaatcccagcactttgggaggccgaggtgggtggatcacgaggtc

SEQ ID NO: 24846 - DNA, 201 bp, Homo sapiens
caaagtgttaaacacagtttccagctgggcatggtggctcgcgcctgtaatcccagcactttgggaggccaaggcagatggatcacgaggtcaggagttcragaccagcctggccaacatagtgaaaccttgtctctactaaaaatacaaaaaattaggccgggcgtggtggctcatgcctgtaatcccagcactttggga

SEQ ID NO: 24847 - DNA, 201 bp, Homo sapiens
ctttggcagttcctcaaagtgttaaacacagtttccagctgggcatggtggctcgcgcctgtaatcccagcactttgggaggccaaggcagatggatcacraggtcaggagttcaagaccagcctggccaacatagtgaaaccttgtctctactaaaaatacaaaaaattaggccgggcgtggtggctcatgcctgtaatc

SEQ ID NO: 24848 - DNA, 201 bp, Homo sapiens
gggaaaactctttggcagttcctcaaagtgttaaacacagtttccagctgggcatggtggctcgcgcctgtaatcccagcactttgggaggccaaggcagrtggatcacgaggtcaggagttcaagaccagcctggccaacatagtgaaaccttgtctctactaaaaatacaaaaaattaggccgggcgtggtggctcatg

SEQ ID NO: 24849 - DNA, 201 bp, Homo sapiens
atgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctc

SEQ ID NO: 24850 - DNA, 201 bp, Homo sapiens
ttctcatctattacctgagttaagttatagttggtctatttggtatccttaaaacttaggggttgctttggttggtcgtgtaatactctaagagagagaayaccagttttgccacctgaatgtattgctttgtttcttccataaacatttaaaaaatactctctccatattcaccccatttaaaaattagaaaaataatat

SEQ ID NO: 24851 - DNA, 201 bp, Homo sapiens
ttttttgcacccatgcaaaaaattgctatatgtgatagtctgatcatgacgctgaataaatgtctttttttttttaatgtgctgtgtaaagttagtctacwctgaagccatcttggtaaatttccccaacagtgtgaagttagcattccttcagggtgatgccaggttctatttggaatttatatacaacctgcttgggtg

SEQ ID NO: 24852 - DNA, 201 bp, Homo sapiens
tgttctatggaaagtgtaaagcattccaacaaagggttttaatgtagattttttttgcacccatgcaaaaaattgctatatgtgatagtctgatcatgacrctgaataaatgtctttttttttttaatgtgctgtgtaaagttagtctactctgaagccatcttggtaaatttccccaacagtgtgaagttagcattcctt

SEQ ID NO: 24853 - DNA, 201 bp, Homo sapiens
gtttaaatccataatttaaaaacatttttttgccaggcgctgtggctcacgcctgtaatcccagcactttgggaggccgaggcgggcggatcacgaggtcrggagatcgagaccacggtgaaaccccatctctactaaaaatacaaaaaattagccaggcgtggtggcgggcgcctgtagtcccagctactcgggagactg

SEQ ID NO: 24854 - DNA, 201 bp, Homo sapiens
tctctttcttcctttctttattcttccttccttttctttctctttcttctctctctctttctttccttccttccttccttctttccttctctctttctctytttcttcttttcttttccttccttccttccttctttctttctttgttttcattctttttattttgagacagggtctttctctgttacccaggctggcatg

SEQ ID NO: 24855 - DNA, 201 bp, Homo sapiens
tgcttcaaagagaataaaatacctaggaatccaacttacaagggatgtgaaggacctcttcaaggagaactacaaaccgctgctcaaggaaataaaagagkatacaaacaaatggaagaacattccatactcatggataggaagaatcaatatcgtgaaaatggccatactgcccaaggtaatttacagattcaatgccat

SEQ ID NO: 24856 - DNA, 201 bp, Homo sapiens
aatcaataaatgtaatccagcatataaacagagccaaagacaaaaaccacatgattatctcaatagatgcagaaaaggcctttgacaaaattcaacaaccyttcatgctaaaaactctcaataaattaggtattgatgggacatatttcaaaataataagagctatctatgacaaacccacagccaatatcatactgaatg

SEQ ID NO: 24857 - DNA, 201 bp, Homo sapiens
cctgctcctgctcctgcccctatttcttttttttttttttttacaaggaggaactggtaccattcttctgaaactatttcaatcaatagaaaaagagggaytcctccctaactcattttatgaggccagcatcattctgataccaaagcctggcagagacacaaccaaaaaagagaattttagaccaatatccttgatgaa

SEQ ID NO: 24858 - DNA, 201 bp, Homo sapiens
caggatgcagactggcagaaaagagaaagcaattcttcgttgaatcttaagtttggtacaatagaataggattataataaatatgcagaagtcagccatgrgaacaactatatttctgggaggatgtttgaggttggaggtggaggggagtcttcagttgcccgttatcttctgtcttctgccaggattgaagtggatggt

SEQ ID NO: 24859 - DNA, 201 bp, Homo sapiens
tcattgtatcacaaaaacagccataaacaatacaaaaatgagtagcagtggctaagttccaataccactttatttatggtcactgaaatttgaatttcatrtaactttcacatgccacaaaatattcttctttcgattttctcaaccattagcaaatttgaaaatataaaatataaaaaacaattctgagcttgcaggctg

SEQ ID NO: 24860 - DNA, 201 bp, Homo sapiens
gttagggaatgataagagaccttgggtggagatggtggtgtagtcaggagggaggtagtatgattttgtgacatgttctcaataaagattttgagtcttcratctctagataaccatactcccatgtgccttgttctatgactcttcatcatatttcatctcaggtggctgcagtgggacaagagccacaggtatttggaa

SEQ ID NO: 24861 - DNA, 201 bp, Homo sapiens
agagttttcatctagcattttcttataaatctattcctatgtatccttagatagaaaccatagaatttcaaacctggaaattttgagctcatagagaccarctgcctcatctgacagagaaggaaactgaggccaagaccctaaatgctgaaactgcacagttacatatggctagagacacacttggggttagaaccctgg

SEQ ID NO: 24862 - DNA, 201 bp, Homo sapiens
gggaacagagggactgggcgcgcctcacaactcaccacctcgcccgctggtccttcctggctcgcctggctctgaagctgcacctggaggggaaacctcaraacagtaggcgggattgcctagtaaatatctcccattcagggaggcccaggtcgtgtgacgtcgacagttgctgggtagatgaggccaacacaggttgca

SEQ ID NO: 24863 - DNA, 201 bp, Homo sapiens
tctctctctcacacacacatacacacattgttccttctcattcttgatataccctctccctgtctctctctctctgtctctgtctctctctctctctctcwcacacacacacacacacaattgtttttctcattcttgatatacctcaggagcaaaatattgtcctccttaccttaagaaaaacctagagttttcatctag

SEQ ID NO: 24864 - DNA, 201 bp, Homo sapiens
gtgtagtcaggagggaggtagtatgattttgtgacatgttctcaataaagattttgagtcttcgatctctagataaccatactcccatgtgccttgttctrtgactcttcatcatatttcatctcaggtggctgcagtgggacaagagccacaggtatttggaagaagtcttcaagaaaatattgcctatggcctgaccca

SEQ ID NO: 24865 - DNA, 201 bp, Homo sapiens
atatggggatacctgggaccttcagtctgttccctgaacacaccctgatcccctttttttccgggttctttatagtgcagtgctggagttcgtgggtgacrggatctataacaacaccatgggccacgtgcacagccacttgcagggagaggtgtttggggctgtcctgcgccaggagacggagtttttccaacagaacca

SEQ ID NO: 24866 - DNA, 201 bp, Homo sapiens
ctctctctcacacacacatacacacattgttccttctcattcttgatataccctctccctgtctctctctctctgtctctgtctctctctctctctctctyacacacacacacacacaattgtttttctcattcttgatatacctcaggagcaaaatattgtcctccttaccttaagaaaaacctagagttttcatctagc

SEQ ID NO: 24867 - DNA, 201 bp, Homo sapiens
agtctgttccctgaacacaccctgatcccctttttttccgggttctttatagtgcagtgctggagttcgtgggtgacgggatctataacaacaccatgggycacgtgcacagccacttgcagggagaggtgtttggggctgtcctgcgccaggagacggagtttttccaacagaaccagacaggtttctcctgaaactctt

SEQ ID NO: 24868 - DNA, 201 bp, Homo sapiens
cgtgcacagccacttgcagggagaggtgtttggggctgtcctgcgccaggagacggagtttttccaacagaaccagacaggtttctcctgaaactctttcrttatacgccatgtactgttcatatcctcatacatctgctttgatctcccccctccccgctctctctctctcacacacacatacacacattgttccttctc

SEQ ID NO: 24869 - DNA, 201 bp, Homo sapiens
ttttgagtggcgcagccttgacccaaattcaggtctgcctgacttgaatgctcatctctttactactaagttatatttccttaaaatcgaatataaaaatkccaagtccatgggtagagaagaggactattcaatagtctttattcttctgtcacgtgtttcaccctagggttctcatttttatcctacttttgcaccctt

SEQ ID NO: 24870 - DNA, 201 bp, Homo sapiens
aggtcatatagcttttgagtggcgcagccttgacccaaattcaggtctgcctgacttgaatgctcatctctttactactaagttatatttccttaaaatckaatataaaaatgccaagtccatgggtagagaagaggactattcaatagtctttattcttctgtcacgtgtttcaccctagggttctcatttttatcctac

SEQ ID NO: 24871 - DNA, 201 bp, Homo sapiens
gagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccaggtatgttcatggagttggcccgctctacacagaccctcatctcccag

SEQ ID NO: 24872 - DNA, 201 bp, Homo sapiens; identical to SEQ ID NO: 5136

SEQ ID NO: 24873 - DNA, 201 bp, Homo sapiens
tgaccctggcatcctggctcattgttagttcgtctcatcacttggaacctgtctgattcacctcactctcttctccccaaccctgcaggtaacatcatgtytcgggtaacagaggacacgtccaccctgagtgattctctgagtgagaatctgagcttatttctgtggtacctggtgcgaggcctatgtctcttggggatc

SEQ ID NO: 24874 - DNA, 201 bp, Homo sapiens
gtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaag

SEQ ID NO: 24875 - DNA, 201 bp, Homo sapiens
cttcccatgtttcaaagccctccccaggtacccttccacttggctggttaccgtctgtggtgaagcgcctgcactcctcgggagacatgcctggcttataygctgcatccacataaccatagataaaggtgctgccggagccaccaatggcaaaaggctgtcgagtcagcattcctcccagggttccatatacctgggaaa

SEQ ID NO: 24876 - DNA, 201 bp, Homo sapiens
ttccaacttgcctagtggaatcctctccactgtagagaggtggagatgaggctcctacaggtagaagtgaagcagctccgcaagtgaaaattatctccaayggaagggctcatagtatgtgcagatgtggtgtagacccaacacagagtaattgactatgatcttgggaaacaaggtcagtctatttttttttttttggtc

SEQ ID NO: 24877 - DNA, 201 bp, Homo sapiens
ttcttttctagcttctccccacaatctgtctttaagaatttgatccccaacccgttctgagtcattttcctcttcctcgtatttctttagcatccaagggscatagctgtgtctctttctcttttctccttttcctctgtctcttctcacctttaatttccaaataggtaactcaggtattagtgtccctgatggtttgcc

SEQ ID NO: 24878 - DNA, 201 bp, Homo sapiens
cccgagggcagcggccggaatcggctctcccggttgcgggaagcgggcgtcgctcggacccaggacactacagtttctctatgcgatctccagagctcgcyttaccccggggaatgcaggtcggggcagtagggaagcccctagggatgcagggaggcgggcgctgaggagtggagggtcgcctgagaggaggaggcgaga

SEQ ID NO: 24879 - DNA, 201 bp, Homo sapiens
ttcttctctaacatgagggcatcaaggctgttcttgccctgacattccatattctgtgtctctgcagaccaccatcatggcagtggagtttgacgggggcrttgtgatgggttctgattcccgagtgtctgcagggtgagtaaaagtgaagatgtatgcatttggaaagaagctaatggcctcaaatacacactttcctta

SEQ ID NO: 24880 - DNA, 201 bp, Homo sapiens
gctttcaattgctcactcttttgctcagccccacccacataactttcttttggctgcaaggaccctgctcttatggggaaaagcagataaggttacttccrtcccaacgaccttgatttctcgtatggtaactgcctgatattatggtgggtcacaatatcaccttcttcctgattatttatatcaggatagtgatttaca

SEQ ID NO: 24881 - DNA, 201 bp, Homo sapiens
ggaacgcagggcaagaggggaggacacaaggggactgggacaggaatcaaaggtaattgtcagtaaggtagagtagcgtgggttctgggaaatgtggagcrggagaaggactcctagcgtgggtcttggaacaccacttcggtgtagaagaaacggcactggactggcgggggccagaggttctgggctccattgctgacc

SEQ ID NO: 24882 - DNA, 201 bp, Homo sapiens
ccggcggtcagggcggctctggaaaccctgtgcgtcggcttctaggctgcctgggctcggagacgcgccgcctctcgctgttcctggtcctggtggtcctstcctctcttggtaaggggaacgcagggcaagaggggaggacacaaggggactgggacaggaatcaaaggtaattgtcagtaaggtagagtagcgtgggtt

SEQ ID NO: 24883 - DNA, 201 bp, Homo sapiens
ctgtggcctatgcagtcaactcctggaccactagtgtgagcacctgaagatgaatacccattcccttgtccttaagatgccgtgactccattcccattccyatgaccctgctcccactcctcctttactgggaaatggttggttcagtattttcgtcctagcaacctgaggctcaatgactctactcagtgtccctagccc

SEQ ID NO: 24884 - DNA, 201 bp, Homo sapiens
gcactgagatttgcagacctctggagaaccctaaccttgtttcctgcagcctccttagaaccccatgttgacacccctgaccctggcatcctggctcattkttagttcgtctcatcacttggaacctgtctgattcacctcactctcttctccccaaccctgcaggtaacatcatgtctcgggtaacagaggacacgtcca

SEQ ID NO: 24885 - DNA, 201 bp, Homo sapiens
cctgatcaccctgcctctgcttttccttctgcccaagaaggtgggaaaatggtaccaggtatgttcatggagttggcccgctctacacagaccctcatctyccagacttggcagactcagttcctctcacattgctttcagtccagctttcctggcacccttactgattctccatcttcatggaacaccctgtccctgtgg

SEQ ID NO: 24886 - DNA, 201 bp, Homo sapiens
ttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcc

SEQ ID NO: 24887 - DNA, 201 bp, Homo sapiens; identical to SEQ ID NO: 5110

SEQ ID NO: 24888 - DNA, 201 bp, Homo sapiens
atcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggct

SEQ ID NO: 24889 - DNA, 201 bp, Homo sapiens
gaacagagggactgggcgcgcctcacaactcaccacctcgcccgctggtccttcctggctcgcctggctctgaagctgcacctggaggggaaacctcagarcagtaggcgggattgcctagtaaatatctcccattcagggaggcccaggtcgtgtgacgtcgacagttgctgggtagatgaggccaacacaggttgcaag

SEQ ID NO: 24890 - DNA, 201 bp, Homo sapiens; identical to SEQ ID NO: 5233

SEQ ID NO: 24891 - DNA, 201 bp, Homo sapiens; identical to SEQ ID NO: 5139

SEQ ID NO: 24892 - DNA, 201 bp, Homo sapiens
acttgcagggagaggtgtttggggctgtcctgcgccaggagacggagtttttccaacagaaccagacaggtttctcctgaaactctttcattatacgccaygtactgttcatatcctcatacatctgctttgatctcccccctccccgctctctctctctcacacacacatacacacattgttccttctcattcttgatat

SEQ ID NO: 24893 - DNA, 201 bp, Homo sapiens; identical to SEQ ID NO: 5141

SEQ ID NO: 24894 - DNA, 201 bp, Homo sapiens
cacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttact

SEQ ID NO: 24895 - DNA, 201 bp, Homo sapiens
gggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatgtccttccattctttacccttcttgcttc

SEQ ID NO: 24896 - DNA, 201 bp, Homo sapiens; identical to SEQ ID NO: 5123

SEQ ID NO: 24897 - DNA, 201 bp, Homo sapiens
ggaatcggctctcccggttgcgggaagcgggcgtcgctcggacccaggacactacagtttctctatgcgatctccagagctcgctttaccccggggaatgmaggtcggggcagtagggaagcccctagggatgcagggaggcgggcgctgaggagtggagggtcgcctgagaggaggaggcgagagcgggagcgcggggta

SEQ ID NO: 24898 - DNA, 201 bp, Homo sapiens
gagatggtggtgtagtcaggagggaggtagtatgattttgtgacatgttctcaataaagattttgagtcttcgatctctagataaccatactcccatgtgycttgttctatgactcttcatcatatttcatctcaggtggctgcagtgggacaagagccacaggtatttggaagaagtcttcaagaaaatattgcctatgg

SEQ ID NO: 24899 - DNA, 201 bp, Homo sapiens
aggtccctccaccttcactccccagtgtgattccttcctctggcccagcaccatctgtgtgatgtccttccattctttacccttcttgcttcacataatgmtggcaagcagactacctcactttcactattcttacctccctctaggtactgctctccatctaccccagagtacagaaggctgtgggctcctcagagaaaa

SEQ ID NO: 24900 - DNA, 201 bp, Homo sapiens
ggtgctgggtctctgcccttgtctttgccgcttcttctatctctactccttggggaggcatcacccagaaatctgtgcatgtgggagggtaggagtttctrtatttccctgtttttcttctggggtaagacatcatgctatgtaacaaggcaatgacactctcaaggttagaggccttggtagcctcttatcgtgtgcttc

SEQ ID NO: 24901 - DNA, 201 bp, Homo sapiens
tttttccctttcctggtggtatctgacatcaagtgtgtggcatagtggtgctgggtctctgcccttgtctttgccgcttcttctatctctactccttgggraggcatcacccagaaatctgtgcatgtgggagggtaggagtttctatatttccctgtttttcttctggggtaagacatcatgctatgtaacaaggcaatg

SEQ ID NO: 24902 - DNA, 201 bp, Homo sapiens
ttaacctccatactctctgggtcttcttttctagcttctccccacaatctgtctttaagaatttgatccccaacccgttctgagtcattttcctcttcctygtatttctttagcatccaaggggcatagctgtgtctctttctcttttctccttttcctctgtctcttctcacctttaatttccaaataggtaactcaggt

SEQ ID NO: 24903 - DNA, 201 bp, Homo sapiens
cctggaccactagtgtgagcacctgaagatgaatacccattcccttgtccttaagatgccgtgactccattcccattcctatgaccctgctcccactcctyctttactgggaaatggttggttcagtattttcgtcctagcaacctgaggctcaatgactctactcagtgtccctagccccctccctctctttaaagatgc

SEQ ID NO: 24904 - DNA, 201 bp, Homo sapiens
cttttcctttgtaatttggaatgtgatttttccctttcctggtggtatctgacatcaagtgtgtggcatagtggtgctgggtctctgcccttgtctttgcygcttcttctatctctactccttggggaggcatcacccagaaatctgtgcatgtgggagggtaggagtttctatatttccctgtttttcttctggggtaag

SEQ ID NO: 24905 - DNA, 201 bp, Homo sapiens; identical to SEQ ID NO: 5112

SEQ ID NO: 24906 - DNA, 201 bp, Homo sapiens
gaactccagagcttcatacccatggagctccagctggtaggcggccatgtcggccacggcttgggcatcagcagctgaaccagagagtgcacagtagatgygctcgtgcagcggggacagcttgtcaaacactcggttcaccaccgcctcgctgtcaggagggagtcaacagtcaccaagttaaaactcaggttttttttt

SEQ ID NO: 24907 - DNA, 201 bp, Homo sapiens
tccagggtcccctggccgctgcatctcctccacccctctgccaaccctcaagcccagacccattaccccggtgtggacttctcccgcccggggtaagtccycggttggtgctcccgcccgcagcatccctgcaaggcaccgctctcctcgccgcctggggcactggtttccaacctgggacagcgcacaacgcgcagccga

SEQ ID NO: 24908 - DNA, 201 bp, Homo sapiens
ccttgtctttgccgcttcttctatctctactccttggggaggcatcacccagaaatctgtgcatgtgggagggtaggagtttctatatttccctgtttttsttctggggtaagacatcatgctatgtaacaaggcaatgacactctcaaggttagaggccttggtagcctcttatcgtgtgcttctctggcctctaggggc

SEQ ID NO: 24909 - DNA, 201 bp, Homo sapiens
tctctactccttggggaggcatcacccagaaatctgtgcatgtgggagggtaggagtttctatatttccctgtttttcttctggggtaagacatcatgctrtgtaacaaggcaatgacactctcaaggttagaggccttggtagcctcttatcgtgtgcttctctggcctctaggggctgacattcaccctacgccctggc

SEQ ID NO: 24910 - DNA, 201 bp, Homo sapiens
ttcctttcagtatggtacataaaatccacccaaccatgtggattggagagatgcgtgtcttccagtcctagggccttcctttgcctctcaggggaagtgcmgggcgccataaattcttgcacctgggactgcttcatgctggtaccttgtagatttgttagtgagagtgatgggaatagtggaagccagggatgagggaca

SEQ ID NO: 24911 - DNA, 201 bp, Homo sapiens
gggaggcatcacccagaaatctgtgcatgtgggagggtaggagtttctatatttccctgtttttcttctggggtaagacatcatgctatgtaacaaggcartgacactctcaaggttagaggccttggtagcctcttatcgtgtgcttctctggcctctaggggctgacattcaccctacgccctggcgaggtgacggcgc

SEQ ID NO: 24912 - DNA, 201 bp, Homo sapiens; identical to SEQ ID NO: 5142

SEQ ID NO: 24913 - DNA, 201 bp, Homo sapiens
tttcagtatggtacataaaatccacccaaccatgtggattggagagatgcgtgtcttccagtcctagggccttcctttgcctctcaggggaagtgcagggmgccataaattcttgcacctgggactgcttcatgctggtaccttgtagatttgttagtgagagtgatgggaatagtggaagccagggatgagggacatctg

SEQ ID NO: 24914 - DNA, 201 bp, Homo sapiens
tgagcactctgaaagaggggttagggaatgataagagaccttgggtggagatggtggtgtagtcaggagggaggtagtatgattttgtgacatgttctcartaaagattttgagtcttcgatctctagataaccatactcccatgtgccttgttctatgactcttcatcatatttcatctcaggtggctgcagtgggacaa

SEQ ID NO: 24915 - DNA, 201 bp, Homo sapiens
acccaaccatgtggattggagagatgcgtgtcttccagtcctagggccttcctttgcctctcaggggaagtgcagggcgccataaattcttgcacctgggmctgcttcatgctggtaccttgtagatttgttagtgagagtgatgggaatagtggaagccagggatgagggacatctgtgatgcactggaaagagagctac

SEQ ID NO: 24916 - DNA, 201 bp, Homo sapiens
cctatttaggttcgggattgagacgtcagtgtttcctttctgctgatgccctccaggataatggtgagggggaggaggcgtggtggggccagtctgactgraactgacctacttagacttaatatttgtgcgtgacctctcttctctttctccaggggagatggccattccattctttacgggccgcctcactgactggat

SEQ ID NO: 24917 - DNA, 201 bp, Homo sapiens; identical to SEQ ID NO: 5118

SEQ ID NO: 24918 - DNA, 201 bp, Homo sapiens
tgtggcctatgcagtcaactcctggaccactagtgtgagcacctgaagatgaatacccattcccttgtccttaagatgccgtgactccattcccattcctrtgaccctgctcccactcctcctttactgggaaatggttggttcagtattttcgtcctagcaacctgaggctcaatgactctactcagtgtccctagcccc

SEQ ID NO: 24919 - DNA, 201 bp, Homo sapiens; identical to SEQ ID NO: 5125

SEQ ID NO: 24920 - DNA, 201 bp, Homo sapiens; identical to SEQ ID NO: 5116

SEQ ID NO: 24921 - DNA, 201 bp, Homo sapiens
atcttcccagaatctcccctatccagctacaaccgtcagatcttggtgtgtgtgagtgcgtgaatgcatgagtgtgtctgtgtgcatgtacatgcgtgcayacatgtggctataccgttctcatcttggccctttgctctgcagaggtagacgaggctgggagccagctgtcagggggtcagcgacaggcagtggcgttgg

SEQ ID NO: 24922 - DNA, 201 bp, Homo sapiens
tcttggccctttgctctgcagaggtagacgaggctgggagccagctgtcagggggtcagcgacaggcagtggcgttggcccgagcattgatccggaaaccrtgtgtacttatcctggatgatgccaccagtgccctggatgcaaacagccagttacaggtgaggcagtcatcttcttaatggctatatcccacccaatctt

SEQ ID NO: 24923 - DNA, 201 bp, Homo sapiens
agcattgatccggaaaccgtgtgtacttatcctggatgatgccaccagtgccctggatgcaaacagccagttacaggtgaggcagtcatcttcttaatggmtatatcccacccaatcttgcttcttttatacatcttctgttagttttactaacatcataattatacaaaccagtccttgcagttctcagttcccaaatcc

SEQ ID NO: 24924 - DNA, 201 bp, Homo sapiens
tgtgagtgcgtgaatgcatgagtgtgtctgtgtgcatgtacatgcgtgcacacatgtggctataccgttctcatcttggccctttgctctgcagaggtagrcgaggctgggagccagctgtcagggggtcagcgacaggcagtggcgttggcccgagcattgatccggaaaccgtgtgtacttatcctggatgatgccacc

SEQ ID NO: 24925 - DNA, 201 bp, Homo sapiens
cattgatccggaaaccgtgtgtacttatcctggatgatgccaccagtgccctggatgcaaacagccagttacaggtgaggcagtcatcttcttaatggctrtatcccacccaatcttgcttcttttatacatcttctgttagttttactaacatcataattatacaaaccagtccttgcagttctcagttcccaaatccag

SEQ ID NO: 24926 - DNA, 201 bp, Homo sapiens
gcatgtacatgcgtgcacacatgtggctataccgttctcatcttggccctttgctctgcagaggtagacgaggctgggagccagctgtcagggggtcagcracaggcagtggcgttggcccgagcattgatccggaaaccgtgtgtacttatcctggatgatgccaccagtgccctggatgcaaacagccagttacaggtg

SEQ ID NO: 24927 - DNA, 201 bp, Homo sapiens; identical to SEQ ID NO: 5114

SEQ ID NO: 24928 - DNA, 201 bp, Homo sapiens; identical to SEQ ID NO: 5117

SEQ ID NO: 24929 - DNA, 201 bp, Homo sapiens
caccctgcaaatgagggagttggaagttggggctgctgtccgaaatgcacttatatggggatacctgggaccttcagtctgttccctgaacacaccctgaycccctttttttccgggttctttatagtgcagtgctggagttcgtgggtgacgggatctataacaacaccatgggccacgtgcacagccacttgcagggag

SEQ ID NO: 24930 - DNA, 201 bp, Homo sapiens
aatgcacttatatggggatacctgggaccttcagtctgttccctgaacacaccctgatcccctttttttccgggttctttatagtgcagtgctggagttcktgggtgacgggatctataacaacaccatgggccacgtgcacagccacttgcagggagaggtgtttggggctgtcctgcgccaggagacggagtttttcca

SEQ ID NO: 24931 - DNA, 201 bp, Homo sapiens
agcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatt

SEQ ID NO: 24932 - DNA, 201 bp, Homo sapiens
aaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaaccc

SEQ ID NO: 24933 - DNA, 201 bp, Homo sapiens
tctctaccagatgcagttcacccaggctgtggaggtgaggtccctccaccttcactccccagtgtgattccttcctctggcccagcaccatctgtgtgatktccttccattctttacccttcttgcttcacataatgctggcaagcagactacctcactttcactattcttacctccctctaggtactgctctccatctac

SEQ ID NO: 24934 - DNA, 201 bp, Homo sapiens
ctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaatt

SEQ ID NO: 24935 - DNA, 201 bp, Homo sapiens
gctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaat

SEQ ID NO: 24936 - DNA, 201 bp, Homo sapiens
actccattcccattcctatgaccctgctcccactcctcctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcg

SEQ ID NO: 24937 - DNA, 201 bp, Homo sapiens
ctcaggattctgttcatcttcccagaatctcccctatccagctacaaccgtcagatcttggtgtgtgtgagtgcgtgaatgcatgagtgtgtctgtgtgcytgtacatgcgtgcacacatgtggctataccgttctcatcttggccctttgctctgcagaggtagacgaggctgggagccagctgtcagggggtcagcgac

SEQ ID NO: 24938 - DNA, 201 bp, Homo sapiens; identical to SEQ ID NO: 5115

SEQ ID NO: 24939 - DNA, 201 bp, Homo sapiens; identical to SEQ ID NO: 24897

SEQ ID NO: 24940 - DNA, 201 bp, Homo sapiens
agcctagtggttaatccctggatctctcagatcattgctccttactcttgtcctatgtggtccatcttagtgctaatagtatatttcacaaaacagctttytggtgataagacccttctcccaaatctcagcctgtgctccactcataagccagatagtacgtcaggtatttagcactgacacatccaccctggcgggaca

SEQ ID NO: 24941 - DNA, 201 bp, Homo sapiens
tctctatgggcagtatgatctgtggctgggataagaaggtgggtgctctccattcttcatgttcccccaccatgttccctatggatgacagatctgtttcycatcatatactcctactccctccctgacaagatgcatggcatatagagtgcttggttatagaactgtttcagtatatccatggactatttattggcccag

SEQ ID NO: 24942 - DNA, 201 bp, Homo sapiens
aaggtgattgagattaacccttacctgcttggcaccatgtctggctgtgcagcagactgtcagtactgggagcgcctgctggccaaggaatgcaggtaagygaggcctctcatcttcctttcttagcctagtggttaatccctggatctctcagatcattgctccttactcttgtcctatgtggtccatcttagtgctaat

SEQ ID NO: 24943 - DNA, 201 bp, Homo sapiens
ttctaaagttcgatgactttaccaaagtggtttcctaattccaatgttcttgtggtaatattaattcttttgttcactttttatgtctcatatttgaaccyccatgttaccaacatcttcctctccaatttcagcctgaaatctttcatcttatagggtcctggactctactacgtggatgaacatgggactcggctctca

SEQ ID NO: 24944 - DNA, 201 bp, Homo sapiens; identical to SEQ ID NO: 24862

SEQ ID NO: 24945 - DNA, 201 bp, Homo sapiens
agcactgacacatccaccctggcgggacagtatcatttactaggctgcctttgtatgtttcagatactttaaattccaaatctttctctgatctttagatmctacaaaataattcctttccaatgcttatctctttaatcatttcctgccccatcaagttggaaagagctaacctctctttcctcactccaccttgtcctc

SEQ ID NO: 24946 - DNA, 201 bp, Homo sapiens
ttttcctttttcatttctaaagttcgatgactttaccaaagtggtttcctaattccaatgttcttgtggtaatattaattcttttgttcactttttatgtmtcatatttgaacccccatgttaccaacatcttcctctccaatttcagcctgaaatctttcatcttatagggtcctggactctactacgtggatgaacatg

SEQ ID NO: 24947 - DNA, 201 bp, Homo sapiens
gggacagtatcatttactaggctgcctttgtatgtttcagatactttaaattccaaatctttctctgatctttagatcctacaaaataattcctttccaaygcttatctctttaatcatttcctgccccatcaagttggaaagagctaacctctctttcctcactccaccttgtcctcacccaggctgtactatctgcgaa

SEQ ID NO: 24948 - DNA, 201 bp, Homo sapiens; identical to SEQ ID NO: 24889

SEQ ID NO: 24949 - DNA, 201 bp, Homo sapiens
tgctgtccaacatgatgtgccagtaccggggcatgggcctctctatgggcagtatgatctgtggctgggataagaaggtgggtgctctccattcttcatgytcccccaccatgttccctatggatgacagatctgtttcccatcatatactcctactccctccctgacaagatgcatggcatatagagtgcttggttatag

SEQ ID NO: 24950 - DNA, 201 bp, Homo sapiens
ggaggcgttgtcaatagtaagagaccaatgctcccaccaccatgcctgggaggagtcggcgggtggtggggggggtgatttaagattgagaaaccagcctkgccaacatggcgaaaccccgtctctactaaaactacaaaaattagccggacgtggtgacgggtgcctgtagtcccagctacttgggaggctgaggcagga

SEQ ID NO: 24951 - DNA, 201 bp, Homo sapiens
gcaggtcggggcagtagggaagcccctagggatgcagggaggcgggcgctgaggagtggagggtcgcctgagaggaggaggcgagagcgggagcgcggggkacagggtcgggggtagccttcagtcccggagagcgccagacccaaagaagaggccacatggggatggggcctgagaggaggaagtgcaagttaggacaaa

SEQ ID NO: 24952 - DNA, 201 bp, Homo sapiens; identical to SEQ ID NO: 5233

SEQ ID NO: 24953 - DNA, 201 bp, Homo sapiens
gaaagtagaaagtacagatgtcagtgacctgctgcaccagtaccgggaagccaatcaataatggtggtggtggcagctgggcaggtctcctctgggaggtyttggccgactcagggacctaagccacgttaagtccaaggagaagaagaggcctagcctgagccaaagagagagtacgggctcagcagccagaggaggccg

SEQ ID NO: 24954 - DNA, 201 bp, Homo sapiens; identical to SEQ ID NO: 24878

SEQ ID NO: 24955 - DNA, 201 bp, Homo sapiens
aaaactgccaaaaaaaattacatcaatgcctctaaacccaaaggactctacccccacaggtccctggttgttgtggtgattttcattgtgtaaaatacttyccacatcttttgacaccaagtctttctgcagccatgtttgaaaattaactttcaggctacagagtctttcttataccaaagttgaagaaagttttaagaa

SEQ ID NO: 24956 - DNA, 201 bp, Homo sapiens; identical to SEQ ID NO: 5391

SEQ ID NO: 24957 - DNA, 201 bp, Homo sapiens
gagaaggcaactagaacaaacaggaatccttgccttggtgaaatgtatttgaactgggtcagaaatgaggccattgggtatcaggccttaactccagcgcmccctggaggtcactgatgtggctccaggctgacctgctcctgtcaaagaatattgagcaagatgcctctcgtggaatgttctgggaccttaaaacagata

SEQ ID NO: 24958 - DNA, 201 bp, Homo sapiens
aatggtgagcagactgcaaatctgcctgataggacccatattcccacagcactaattcaacatataccttactgagagcatgttttatcattaccattaakaagttaaatgaacatcagaatttaaaatcataaatataatctaatacactttaaccattttctttgtgtgccatcacaaatactccttaaccaaatacgg

SEQ ID NO: 24959 - DNA, 201 bp, Homo sapiens
tagaaaactaaaatagagtagagaatatcaaagaaattgtcatgggaagcaaagaatcgccttccaaagggccctgtcctgatcttattgcagatgagggygtcctcccacatttccaggagcagatcatgcctcttacacgtgtgattctagaacatagaatggaacagaatttttgagatcattttatgaggttggttc

SEQ ID NO: 24960 - DNA, 201 bp, Homo sapiens
tcacccgggtactagttacatgggtgcttgcggtgataaccattcaacgtacattctattggtttgtgtgtttcttccaaatgtcccctagttcacaataraaagggcttaaatagagaagtaaaggagaatttgggaatttgaagcaaaagcaagaagccactgaatcaagcacaaatattgagctttgataaagattgg

SEQ ID NO: 24961 - DNA, 201 bp, Homo sapiens
ccacactcagagtggggcaattgaacaggcaggggcggatggatggcagaggaggaggaatctggactcaaggagctggggggctctgggcctggaatttyagggtctggggcccaaggcaccaggagaagaggcaggtcaggatatctgagtcaagacctgggatcttgccttagcaatgacactggagactaaaggtgg

SEQ ID NO: 24962 - DNA, 201 bp, Homo sapiens
aggtttgtagggggaatgagatgaggcagtggagccatgtgacagggactgagggtagattactggagctccctgcgtagaatgaatgttcaatcaaaacytgctggagggagagctggagccataggggagtgggtaaagtgggcagggctgattccacaattccctgcatgctcccccaactccacacacatccccaac

SEQ ID NO: 24963 - DNA, 201 bp, Homo sapiens
aaattctctctctgcgtggtgagaaaacaggcctggagaggctctgcgacccgcttaggaccacagaactcggtactaggaaaactcctattttaaaatcyagccctgggtgggaagatttgggaagaatcgttaatattgagagagagagggagaaagaggattagatgagagtggcgcctccgctcatgtccgccccct

SEQ ID NO: 24964 - DNA, 201 bp, Homo sapiens
ctacctcctggcctaaggaggggcacagggatgctggcaacagtctatttcttcacccgggtactagttacatgggtgcttgcggtgataaccattcaacrtacattctattggtttgtgtgtttcttccaaatgtcccctagttcacaatagaaagggcttaaatagagaagtaaaggagaatttgggaatttgaagcaa

SEQ ID NO: 24965 - DNA, 201 bp, Homo sapiens
tctctgcgtggtgagaaaacaggcctggagaggctctgcgacccgcttaggaccacagaactcggtactaggaaaactcctattttaaaatccagccctgrgtgggaagatttgggaagaatcgttaatattgagagagagagggagaaagaggattagatgagagtggcgcctccgctcatgtccgccccctccccgcag

SEQ ID NO: 24966 - DNA, 201 bp, Homo sapiens
tcaatttcttttacacagtaagaataggatcagctgtgctaaactaacaaatacccagatatccaggtttggctcatgctacacgtccaaagtaagtcatscaggaagctctgcttatcatcgtactcaggaagccaggctgacagtctttctcctgcacatctgctcccagaacctccccagcagaatgaagggaaccta

SEQ ID NO: 24967 - DNA, 201 bp, Homo sapiens
tgcatgaggctgagtgtggcgcatcctcctcggggctgagatggattttacttgtcttgggttccccacggctgtcacagggcagtgtctcagttcattcrtctttttccttcaggaagtctgggtgtaaagggatggagagaggtgaggtgtgtgcagtaagaggatttctcaaggatgggacaggaaggccttggagct

SEQ ID NO: 24968 - DNA, 201 bp, Homo sapiens
cgtggtgagaaaacaggcctggagaggctctgcgacccgcttaggaccacagaactcggtactaggaaaactcctattttaaaatccagccctgggtgggwagatttgggaagaatcgttaatattgagagagagagggagaaagaggattagatgagagtggcgcctccgctcatgtccgccccctccccgcagagaatt

SEQ ID NO: 24969 - DNA, 201 bp, Homo sapiens
aggaaggatgcagtgcagagacaggtcccagaggagacaagagctgagagaccatccaaactgggaccaccttgtcactagacttcaaattttcaatattkatagagtgttttctaagagtcaggccctttgctgagtgctatgtgcagcaggatcaaaggcagccaggaggtagaggagtcttgaggtacatcagtcatt

SEQ ID NO: 24970 - DNA, 201 bp, Homo sapiens
caattgaacaggcaggggcggatggatggcagaggaggaggaatctggactcaaggagctggggggctctgggcctggaattttagggtctggggcccaasgcaccaggagaagaggcaggtcaggatatctgagtcaagacctgggatcttgccttagcaatgacactggagactaaaggtggactccatggtgcccttg

SEQ ID NO: 24971 - DNA, 201 bp, Homo sapiens
gaggtttgtagggggaatgagatgaggcagtggagccatgtgacagggactgagggtagattactggagctccctgcgtagaatgaatgttcaatcaaaayctgctggagggagagctggagccataggggagtgggtaaagtgggcagggctgattccacaattccctgcatgctcccccaactccacacacatccccaa

SEQ ID NO: 24972 - DNA, 201 bp, Homo sapiens
gtgggatgagggacagtgttgggagccaccaaggaaacccagaggtgggggagcagagagcagaagggggcatgtgatgctgggcagtgaaagggaggacrggcaaaggctgggttgaggtttgtagggggaatgagatgaggcagtggagccatgtgacagggactgagggtagattactggagctccctgcgtagaatg

SEQ ID NO: 24973 - DNA, 201 bp, Homo sapiens
tcagccctgggaactgcagaggggtgaggctggggagagaggaggctggagcagcactggtgacactgaacagtgtcaggaggaagtgacggatgcagcgyccccatcccataggcagagctgtcatgtgggatgagggacagtgttgggagccaccaaggaaacccagaggtgggggagcagagagcagaagggggcatg

SEQ ID NO: 24974 - DNA, 201 bp, Homo sapiens
ctcagccctgggaactgcagaggggtgaggctggggagagaggaggctggagcagcactggtgacactgaacagtgtcaggaggaagtgacggatgcagcrcccccatcccataggcagagctgtcatgtgggatgagggacagtgttgggagccaccaaggaaacccagaggtgggggagcagagagcagaagggggcat

SEQ ID NO: 24975 - DNA, 201 bp, Homo sapiens
cggctcagccctgggaactgcagaggggtgaggctggggagagaggaggctggagcagcactggtgacactgaacagtgtcaggaggaagtgacggatgcrgcgcccccatcccataggcagagctgtcatgtgggatgagggacagtgttgggagccaccaaggaaacccagaggtgggggagcagagagcagaaggggg

SEQ ID NO: 24976 - DNA, 201 bp, Homo sapiens
taaccagcaggacggctcagccctgggaactgcagaggggtgaggctggggagagaggaggctggagcagcactggtgacactgaacagtgtcaggaggargtgacggatgcagcgcccccatcccataggcagagctgtcatgtgggatgagggacagtgttgggagccaccaaggaaacccagaggtgggggagcagag

SEQ ID NO: 24977 - DNA, 201 bp, Homo sapiens
tgggagggggtgcatgaggctgagtgtggcgcatcctcctcggggctgagatggattttacttgtcttgggttccccacggctgtcacagggcagtgtctsagttcattcgtctttttccttcaggaagtctgggtgtaaagggatggagagaggtgaggtgtgtgcagtaagaggatttctcaaggatgggacaggaagg

SEQ ID NO: 24978 - DNA, 201 bp, Homo sapiens
tagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaaca

SEQ ID NO: 24979 - DNA, 201 bp, Homo sapiens
gtctttggggaaaatgggaccaagaggtcctggataaccttggacagacaaggtttgcagagagagaagttggcaagtgcaggctcctgggcgtgttcatrtctgcatccagcctggaggggactcaggcagagagccctaagctggagtgtccaggctctgaggatcactgaggattcagtgctcacgaagaatgcctct

SEQ ID NO: 24980 - DNA, 201 bp, Homo sapiens
cctggagaggctctgcgacccgcttaggaccacagaactcggtactaggaaaactcctattttaaaatccagccctgggtgggaagatttgggaagaatcsttaatattgagagagagagggagaaagaggattagatgagagtggcgcctccgctcatgtccgccccctccccgcagagaattaccttttccagggacgg

SEQ ID NO: 24981 - DNA, 201 bp, Homo sapiens
tgtctttggggaaaatgggaccaagaggtcctggataaccttggacagacaaggtttgcagagagagaagttggcaagtgcaggctcctgggcgtgttcaygtctgcatccagcctggaggggactcaggcagagagccctaagctggagtgtccaggctctgaggatcactgaggattcagtgctcacgaagaatgcctc

SEQ ID NO: 24982 - DNA, 201 bp, Homo sapiens
cctgatccgtaatggagactggaccttccagatcctggtgatgctggaaatgaccccccagcagggagatgtctacacctgccaagtggagcacaccagcmtggatagtcctgtcaccgtggagtggagtgagtctctgatgaccctctagaccccacctctgaagagcaggggactctctggctctggggtccactcatc

SEQ ID NO: 24983 - DNA, 201 bp, Homo sapiens
gggtacagtaaacagagagaggtgcccagtggtcagtgcttgtctttggggaaaatgggaccaagaggtcctggataaccttggacagacaaggtttgcasagagagaagttggcaagtgcaggctcctgggcgtgttcatgtctgcatccagcctggaggggactcaggcagagagccctaagctggagtgtccaggctc

SEQ ID NO: 24984 - DNA, 201 bp, Homo sapiens
caatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatct

SEQ ID NO: 24985 - DNA, 201 bp, Homo sapiens
aaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgt

SEQ ID NO: 24986 - DNA, 201 bp, Homo sapiens
atttgggaagaatcgttaatattgagagagagagggagaaagaggattagatgagagtggcgcctccgctcatgtccgccccctccccgcagagaattacsttttccagggacggcaggaatgctacgcgtttaatgggacacagcgcttcctggagagatacatctacaaccgggaggagttcgcgcgcttcgacagcga

SEQ ID NO: 24987 - DNA, 201 bp, Homo sapiens
aggaaggaaagaaggacaatctcaaattctatttcattatttttcttccacgctcctagtccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 24988 - DNA, 201 bp, Homo sapiens
ttgggaagaatcgttaatattgagagagagagggagaaagaggattagatgagagtggcgcctccgctcatgtccgccccctccccgcagagaattacctkttccagggacggcaggaatgctacgcgtttaatgggacacagcgcttcctggagagatacatctacaaccgggaggagttcgcgcgcttcgacagcgacg

SEQ ID NO: 24989 - DNA, 201 bp, Homo sapiens
gggaagaatcgttaatattgagagagagagggagaaagaggattagatgagagtggcgcctccgctcatgtccgccccctccccgcagagaattacctttwccagggacggcaggaatgctacgcgtttaatgggacacagcgcttcctggagagatacatctacaaccgggaggagttcgcgcgcttcgacagcgacgtg

SEQ ID NO: 24990 - DNA, 201 bp, Homo sapiens
gaatcgttaatattgagagagagagggagaaagaggattagatgagagtggcgcctccgctcatgtccgccccctccccgcagagaattaccttttccagkgacggcaggaatgctacgcgtttaatgggacacagcgcttcctggagagatacatctacaaccgggaggagttcgcgcgcttcgacagcgacgtggggga

SEQ ID NO: 24991 - DNA, 201 bp, Homo sapiens; identical to SEQ ID NO: 5395

SEQ ID NO: 24992 - DNA, 201 bp, Homo sapiens
agtggggcaattgaacaggcaggggcggatggatggcagaggaggaggaatctggactcaaggagctggggggctctgggcctggaattttagggtctggsgcccaaggcaccaggagaagaggcaggtcaggatatctgagtcaagacctgggatcttgccttagcaatgacactggagactaaaggtggactccatggt

SEQ ID NO: 24993 - DNA, 201 bp, Homo sapiens; identical to SEQ ID NO: 5247

SEQ ID NO: 24994 - DNA, 201 bp, Homo sapiens
gcaggtttctgcggccccccggacagtggctctgacggcgttactgatggtgctgctcacatctgtggtccagggcagggccactccaggtaagagccgarctgccattcttggagggtctggctcagggaacaattcctaggggacgttatctttaagggatcaaattctgagacaggctgcgggggctcctgccctaag

SEQ ID NO: 24995 - DNA, 201 bp, Homo sapiens
ggaaatgaccccccagcagggagatgtctacacctgccaagtggagcacaccagcctggatagtcctgtcaccgtggagtggagtgagtctctgatgaccvtctagaccccacctctgaagagcaggggactctctggctctggggtccactcatcttatcttctgcatctataccctggggccatgtccaaaccccatct

SEQ ID NO: 24996 - DNA, 201 bp, Homo sapiens
ataggcagagctgtcatgtgggatgagggacagtgttgggagccaccaaggaaacccagaggtgggggagcagagagcagaagggggcatgtgatgctggrcagtgaaagggaggacaggcaaaggctgggttgaggtttgtagggggaatgagatgaggcagtggagccatgtgacagggactgagggtagattactgga

SEQ ID NO: 24997 - DNA, 201 bp, Homo sapiens
cagcgcccccatcccataggcagagctgtcatgtgggatgagggacagtgttgggagccaccaaggaaacccagaggtgggggagcagagagcagaagggrgcatgtgatgctgggcagtgaaagggaggacaggcaaaggctgggttgaggtttgtagggggaatgagatgaggcagtggagccatgtgacagggactga

SEQ ID NO: 24998 - DNA, 201 bp, Homo sapiens
tgaggtgcttgaggggcagatgggtggtctgatgggcaggtagacagaagggtctgcagccggggaggagactgagatacatgagaccatccagggagagrggacccagggggaagagcaaaggaccggatcctgggaactggacagttgtgatttggccaagacagaaaagcctgtgaaagagaccaaaaaaacccaagt

SEQ ID NO: 24999 - DNA, 201 bp, Homo sapiens
caaccattgtactctcaggacatttctagtccaaatttacaccaacactctgagaggaaggactgcaaagtaggtaccttagttttccactgacttccacytttcctgcttacacccttcctcctagacctctccacacccctcctaggacacacctagaaggtactgacatcatgtcacctcctcatctttcagggtagc

SEQ ID NO: 25000 - DNA, 201 bp, Homo sapiens; identical to SEQ ID NO: 5258

SEQ ID NO: 25001 - DNA, 201 bp, Homo sapiens
gcagatgcagtggctcaggcccgtaatcccagccctttgagaggccgagcgggtggatcacttgaggtcaggcgttggtcaagtgctcctagagaaccagsctgaccaacatggagaaaccttgtctctactaataatacaaaaattagccaggtgaagtggcaggcacctataatcccagctattcgggaggctgaggaa

SEQ ID NO: 25002 - DNA, 201 bp, Homo sapiens
tatgtgtgcatgtgtctttatagcagcatgatttataatcctttgggtatatatccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggag

SEQ ID NO: 25003 - DNA, 201 bp, Homo sapiens
ctactggcctattctctctccaaggacatgggtacagtaaacagagagaggtgcccagtggtcagtgcttgtctttggggaaaatgggaccaagaggtccwggataaccttggacagacaaggtttgcagagagagaagttggcaagtgcaggctcctgggcgtgttcatgtctgcatccagcctggaggggactcaggca

SEQ ID NO: 25004 - DNA, 201 bp, Homo sapiens
cttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatggctgcacagtattccatggtgtatatgtgtgcattttcttaatccag

SEQ ID NO: 25005 - DNA, 201 bp, Homo sapiens
tgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaa

SEQ ID NO: 25006 - DNA, 201 bp, Homo sapiens
aatcgttaatattgagagagagagggagaaagaggattagatgagagtggcgcctccgctcatgtccgccccctccccgcagagaattaccttttccaggkacggcaggaatgctacgcgtttaatgggacacagcgcttcctggagagatacatctacaaccgggaggagttcgcgcgcttcgacagcgacgtgggggag

SEQ ID NO: 25007 - DNA, 201 bp, Homo sapiens
ctccccgcagagaattaccttttccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 25008 - DNA, 201 bp, Homo sapiens
cccgcagagaattaccttttccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 25009 - DNA, 201 bp, Homo sapiens; identical to SEQ ID NO: 5273

SEQ ID NO: 25010 - DNA, 201 bp, Homo sapiens
gacagtggctctgacggcgttactgatggtgctgctcacatctgtggtccagggcagggccactccaggtaagagccgaactgccattcttggagggtctrgctcagggaacaattcctaggggacgttatctttaagggatcaaattctgagacaggctgcgggggctcctgccctaaggcagtgtcctctcttcccagc

SEQ ID NO: 25011 - DNA, 201 bp, Homo sapiens; identical to SEQ ID NO: 5276

SEQ ID NO: 25012 - DNA, 201 bp, Homo sapiens
ccgggaggagttcgcgcgcttcgacagcgacgtgggggagttccgggcggtgacggagctggggcggcctgctgcggagtactggaacagccagaaggacmtcctggaggagaagcgggcagtgccggacaggatgtgcagacacaactacgagctgggcgggcccatgaccctgcagcgccgaggtgagtgagggctttg

SEQ ID NO: 25013 - DNA, 201 bp, Homo sapiens
aggaaggaaggaaggaaggaaggaaggaaggaaggaaggaaagaaggacaatctcaaattctatttcattatttttcttccacgctcctagtccagcctarggtgaatgtttccccctccaagaaggggcccttgcagcaccacaacctgcttgtctgccacgtgacggatttctacccaggcagcattcaagtccgatgg

SEQ ID NO: 25014 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgaggtgagtgagggctttgggccggcggtcccagggcagccccgcgggcccgtgcccagggcgcaggagcagccgggttggcct

SEQ ID NO: 25015 - DNA, 201 bp, Homo sapiens
acgctcctagtccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 25016 - DNA, 201 bp, Homo sapiens
attctatttcattatttttcttccacgctcctagtccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 25017 - DNA, 201 bp, Homo sapiens
aaggaaggaaggaaagaaggacaatctcaaattctatttcattatttttcttccacgctcctagtccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 25018 - DNA, 201 bp, Homo sapiens
cccagctgagtgttgtatcctccatccctttccacctggtcccttcattttctacccctcacagttccctaacgagaaggtggtccacccaacagacaacrctgcctcagatggttatcaaggggtaccctaagaagaaatcatctcaccctctctttgtccccatttgtcaagtagcagtgaggccgagccaggggatgg

SEQ ID NO: 25019 - DNA, 201 bp, Homo sapiens
tggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactca

SEQ ID NO: 25020 - DNA, 201 bp, Homo sapiens
taaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagc

SEQ ID NO: 25021 - DNA, 201 bp, Homo sapiens
cagtgcccctgagctcattcttttcagtaaattctctctctgcgtggtgagaaaacaggcctggagaggctctgcgacccgcttaggaccacagaactcgrtactaggaaaactcctattttaaaatccagccctgggtgggaagatttgggaagaatcgttaatattgagagagagagggagaaagaggattagatgaga

SEQ ID NO: 25022 - DNA, 201 bp, Homo sapiens
atctataccctggggccatgtccaaaccccatctttcttctataccagctcctgagcatagtttgaagccagggaaatggagacttcctgaccttggcttrggggttcctgaagattcatagttctcccccttgtcagagaatctagggacactgactggtctcgaaaccctcacacttaggaactgacctcacacatagg

SEQ ID NO: 25023 - DNA, 201 bp, Homo sapiens
gccaccagcagaagggactgccttcccctcagtgctcgcccctccctagtgatcactcagtgcccctgagctcattcttttcagtaaattctctctctgcrtggtgagaaaacaggcctggagaggctctgcgacccgcttaggaccacagaactcggtactaggaaaactcctattttaaaatccagccctgggtgggaa

SEQ ID NO: 25024 - DNA, 201 bp, Homo sapiens
gggttggttccaagtctttgctattgtgaatagtgccgcaataaacatatgtgtgcatgtgtctttatagcagcatgatttataatcctttgggtatatayccagtaatgggatggctgggtcaaatggtatttctagttctagatctttgaggaattgccacactgtcttgagataccatctcacaccagttaaaatggc

SEQ ID NO: 25025 - DNA, 201 bp, Homo sapiens
cagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatatccagtaatgggatggctgggtcaaatggtatttctagtt

SEQ ID NO: 25026 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgaggtgagtgagggctttgggccggcggtcc

SEQ ID NO: 25027 - DNA, 201 bp, Homo sapiens
agagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttgg

SEQ ID NO: 25028 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgaggtgagtgagggctttgggccggcggtcccagggcagccccgcgggcccg

SEQ ID NO: 25029 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggtgagtgagggctttgggccggcggtcccagggcagccccgcgggcccgtg

SEQ ID NO: 25030 - DNA, 201 bp, Homo sapiens
gtctgatgggcaggtagacagaagggtctgcagccggggaggagactgagatacatgagaccatccagggagaggggacccagggggaagagcaaaggacyggatcctgggaactggacagttgtgatttggccaagacagaaaagcctgtgaaagagaccaaaaaaacccaagtgcagtgtgaggagaggcccgcagaga

SEQ ID NO: 25031 - DNA, 201 bp, Homo sapiens
gtggtctttggttttttgtccttgcaatagtttgctgtgaatgatgatttccagcttcctccatgtccctacaaaggacatgaactcatccttttttatgrctgcacagtattccatggtgtatatgtgtgcattttcttaatccagtctatcactgatggacagttgggttggttccaagtctttgctattgtgaatagt

SEQ ID NO: 25032 - DNA, 201 bp, Homo sapiens
atgttttctgggcattagagaaggcaactagaacaaacaggaatccttgccttggtgaaatgtatttgaactgggtcagaaatgaggccattgggtatcargccttaactccagcgcaccctggaggtcactgatgtggctccaggctgacctgctcctgtcaaagaatattgagcaagatgcctctcgtggaatgttctg

SEQ ID NO: 25033 - DNA, 201 bp, Homo sapiens
tgtgctaaactaacaaatacccagatatccaggtttggctcatgctacacgtccaaagtaagtcatccaggaagctctgcttatcatcgtactcaggaagycaggctgacagtctttctcctgcacatctgctcccagaacctccccagcagaatgaagggaacctaagaatttattcactggcttttaatgatccctcct

SEQ ID NO: 25034 - DNA, 201 bp, Homo sapiens
ttacacgtgtgattctagaacatagaatggaacagaatttttgagatcattttatgaggttggttcatttatatttccagagccagctaagaatagtacargagaacaggattgtggactaattttagccatgtcactgaatccaacagtacattataaaaacaatacgttttgaccaattttagatttattctaggaatg

SEQ ID NO: 25035 - DNA, 201 bp, Homo sapiens
agcattcaagtccgatggttcctgaatggacaggaggaaacagctggggtcgtgtccaccaacctgatccgtaatggagactggaccttccagatcctggwgatgctggaaatgaccccccagcagggagatgtctacacctgccaagtggagcacaccagcctggatagtcctgtcaccgtggagtggagtgagtctctg

SEQ ID NO: 25036 - DNA, 201 bp, Homo sapiens
gctctgcgacccgcttaggaccacagaactcggtactaggaaaactcctattttaaaatccagccctgggtgggaagatttgggaagaatcgttaatattragagagagagggagaaagaggattagatgagagtggcgcctccgctcatgtccgccccctccccgcagagaattaccttttccagggacggcaggaatgc

SEQ ID NO: 25037 - DNA, 201 bp, Homo sapiens
caccttgttgaggtcacacccctgttccagatatgagggtggctctttctgaatttcctcttagcaagctttttccgctgcactgtcctcatcccgatatkctgcatcaggctccagaatctcagacaggacatgagtagggatgcagctggtggaggtgacactaaacctgggtctgtccttcccagaggcacagtctga

SEQ ID NO: 25038 - DNA, 201 bp, Homo sapiens
ccgccccctccccgcagagaattaccttttccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 25039 - DNA, 201 bp, Homo sapiens
gagattcagaacgaaaagggtaaatgacatttatacacattttaaaatgcaaaatcttacgaccaactctatacatataaatttgaaaatttagataaaamggatacgtttctagaaagatataaaggtcaaaactacaggaagaaatagaaaactaaaatagagtagagaatatcaaagaaattgtcatgggaagcaaag

SEQ ID NO: 25040 - DNA, 201 bp, Homo sapiens
atgaaaatgggagaatccacactcagagtggggcaattgaacaggcaggggcggatggatggcagaggaggaggaatctggactcaaggagctggggggcyctgggcctggaattttagggtctggggcccaaggcaccaggagaagaggcaggtcaggatatctgagtcaagacctgggatcttgccttagcaatgacac

SEQ ID NO: 25041 - DNA, 201 bp, Homo sapiens
agaacaaacaggaatccttgccttggtgaaatgtatttgaactgggtcagaaatgaggccattgggtatcaggccttaactccagcgcaccctggaggtcrctgatgtggctccaggctgacctgctcctgtcaaagaatattgagcaagatgcctctcgtggaatgttctgggaccttaaaacagatacccaagtattcc

SEQ ID NO: 25042 - DNA, 201 bp, Homo sapiens
gtaagaggatttctcaaggatgggacaggaaggccttggagctttggcttcctcctgtgaacttgtggggtggggagcctggtgcaccaacctgagggacytgagggagtagtatcaggatgtgggattgagccctggaccttttttctagaaagaggaaaaaaatgaagggaggaggaggaggaagctggggagatcaca

SEQ ID NO: 25043 - DNA, 201 bp, Homo sapiens; identical to SEQ ID NO: 5416

SEQ ID NO: 25044 - DNA, 201 bp, Homo sapiens
attatttttcttccacgctcctagtccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 25045 - DNA, 201 bp, Homo sapiens
aggaggaaacagctggggtcgtgtccaccaacctgatccgtaatggagactggaccttccagatcctggtgatgctggaaatgaccccccagcagggagaygtctacacctgccaagtggagcacaccagcctggatagtcctgtcaccgtggagtggagtgagtctctgatgaccctctagaccccacctctgaagagca

SEQ ID NO: 25046 - DNA, 201 bp, Homo sapiens
tcccacatttccaggagcagatcatgcctcttacacgtgtgattctagaacatagaatggaacagaatttttgagatcattttatgaggttggttcatttrtatttccagagccagctaagaatagtacaggagaacaggattgtggactaattttagccatgtcactgaatccaacagtacattataaaaacaatacgtt

SEQ ID NO: 25047 - DNA, 201 bp, Homo sapiens
acagctggggtcgtgtccaccaacctgatccgtaatggagactggaccttccagatcctggtgatgctggaaatgaccccccagcagggagatgtctacayctgccaagtggagcacaccagcctggatagtcctgtcaccgtggagtggagtgagtctctgatgaccctctagaccccacctctgaagagcaggggactc

SEQ ID NO: 25048 - DNA, 201 bp, Homo sapiens
tccgtaatggagactggaccttccagatcctggtgatgctggaaatgaccccccagcagggagatgtctacacctgccaagtggagcacaccagcctggayagtcctgtcaccgtggagtggagtgagtctctgatgaccctctagaccccacctctgaagagcaggggactctctggctctggggtccactcatcttatc

SEQ ID NO: 25049 - DNA, 201 bp, Homo sapiens; identical to SEQ ID NO: 5429

SEQ ID NO: 25050 - DNA, 201 bp, Homo sapiens
cctccccgcagagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 25051 - DNA, 201 bp, Homo sapiens; identical to SEQ ID NO: 5432

SEQ ID NO: 25052 - DNA, 201 bp, Homo sapiens; identical to SEQ ID NO: 5434

SEQ ID NO: 25053 - DNA, 201 bp, Homo sapiens
tcaggatggaaatgtcagtcagggagttaagtagggggagcagctccgccctccacgtccccagctcctcccgcccctgttttttctcccagtgaccccamgtgaaacgtctccgcctcctccagccaccagcagaagggactgccttcccctcagtgctcgcccctccctagtgatcactcagtgcccctgagctcattc

SEQ ID NO: 25054 - DNA, 201 bp, Homo sapiens
tctttctgcagccatgtttgaaaattaactttcaggctacagagtctttcttataccaaagttgaagaaagttttaagaaatatatttctacatctcctamatgcaaaacaacaggagcaagttgaggaattctcaagaaactggtcgagaagagagagcgcttagctatggaaaagagaaagaaggaagggagggcttcc

SEQ ID NO: 25055 - DNA, 201 bp, Homo sapiens
accaagtctttctgcagccatgtttgaaaattaactttcaggctacagagtctttcttataccaaagttgaagaaagttttaagaaatatatttctacatytcctacatgcaaaacaacaggagcaagttgaggaattctcaagaaactggtcgagaagagagagcgcttagctatggaaaagagaaagaaggaagggagg

SEQ ID NO: 25056 - DNA, 201 bp, Homo sapiens
gactaacacttgtcaggatcagaagctgaggtatctgcacccacattacaggaacaggatatgtgctcctagggaactgagggtgtcaggagatgaggaawgtccctggagtcacagaaagaaggtatcagatgtgtctcactctgacatatgcaggtgtttatgaaactctgggatttctaaggaaggatgcagtgcaga

SEQ ID NO: 25057 - DNA, 201 bp, Homo sapiens
acaaatacccagatatccaggtttggctcatgctacacgtccaaagtaagtcatccaggaagctctgcttatcatcgtactcaggaagccaggctgacagkctttctcctgcacatctgctcccagaacctccccagcagaatgaagggaacctaagaatttattcactggcttttaatgatccctcctagaaagaacaca

SEQ ID NO: 25058 - DNA, 201 bp, Homo sapiens
tgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacattta

SEQ ID NO: 25059 - DNA, 201 bp, Homo sapiens
aaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaataca

SEQ ID NO: 25060 - DNA, 201 bp, Homo sapiens
aggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatg

SEQ ID NO: 25061 - DNA, 201 bp, Homo sapiens
aaggaaggaaggaaggaaggaaggaaggaaggaaagaaggacaatctcaaattctatttcattatttttcttccacgctcctagtccagcctagggtgaaygtttccccctccaagaaggggcccttgcagcaccacaacctgcttgtctgccacgtgacggatttctacccaggcagcattcaagtccgatggttcctga

SEQ ID NO: 25062 - DNA, 201 bp, Homo sapiens
gcggcaggagctggaatgggagggggtgcatgaggctgagtgtggcgcatcctcctcggggctgagatggattttacttgtcttgggttccccacggctgkcacagggcagtgtctcagttcattcgtctttttccttcaggaagtctgggtgtaaagggatggagagaggtgaggtgtgtgcagtaagaggatttctcaa

SEQ ID NO: 25063 - DNA, 201 bp, Homo sapiens
tccagggagaggggacccagggggaagagcaaaggaccggatcctgggaactggacagttgtgatttggccaagacagaaaagcctgtgaaagagaccaawaaaacccaagtgcagtgtgaggagaggcccgcagagaagagtcttggaagctgaggggaggtgacctcagcagcacagtggacagcggtgccagtgactt

SEQ ID NO: 25064 - DNA, 201 bp, Homo sapiens
gaaacctacagggaggtagctgggtttgaggtgcttgaggggcagatgggtggtctgatgggcaggtagacagaagggtctgcagccggggaggagactgrgatacatgagaccatccagggagaggggacccagggggaagagcaaaggaccggatcctgggaactggacagttgtgatttggccaagacagaaaagcct

SEQ ID NO: 25065 - DNA, 201 bp, Homo sapiens
tggggtccactcatcttatcttctgcatctataccctggggccatgtccaaaccccatctttcttctataccagctcctgagcatagtttgaagccagggmaatggagacttcctgaccttggcttaggggttcctgaagattcatagttctcccccttgtcagagaatctagggacactgactggtctcgaaaccctcac

SEQ ID NO: 25066 - DNA, 201 bp, Homo sapiens; identical to SEQ ID NO: 5394

SEQ ID NO: 25067 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgaggtgagtgagggctttgggccggcggtcccagggcagccccgcgggcccgtgcccagggcgcaggagcagccggg

SEQ ID NO: 25068 - DNA, 201 bp, Homo sapiens; identical to SEQ ID NO: 5249

SEQ ID NO: 25069 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgaggtgagtgagggctttgggccggcggtccc

SEQ ID NO: 25070 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgaggtgagtgagggctttgggccggcggtcccagggcagccccgcgggcccgtgcccagggcgcaggagcagccgggttg

SEQ ID NO: 25071 - DNA, 201 bp, Homo sapiens; identical to SEQ ID NO: 5252

SEQ ID NO: 25072 - DNA, 201 bp, Homo sapiens
tcttattcttgaatgaaaaacgttctcttactggtgattgaggaggagaaacaaagactaacaaatgaaaatgggagaatccacactcagagtggggcaaytgaacaggcaggggcggatggatggcagaggaggaggaatctggactcaaggagctggggggctctgggcctggaattttagggtctggggcccaaggca

SEQ ID NO: 25073 - DNA, 201 bp, Homo sapiens; identical to SEQ ID NO: 5255

SEQ ID NO: 25074 - DNA, 201 bp, Homo sapiens; identical to SEQ ID NO: 5403

SEQ ID NO: 25075 - DNA, 201 bp, Homo sapiens; identical to SEQ ID NO: 5257

SEQ ID NO: 25076 - DNA, 201 bp, Homo sapiens; identical to SEQ ID NO: 5405

SEQ ID NO: 25077 - DNA, 201 bp, Homo sapiens; identical to SEQ ID NO: 5260

SEQ ID NO: 25078 - DNA, 201 bp, Homo sapiens; identical to SEQ ID NO: 5261

SEQ ID NO: 25079 - DNA, 201 bp, Homo sapiens; identical to SEQ ID NO: 5262

SEQ ID NO: 25080 - DNA, 201 bp, Homo sapiens
agcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactgg

SEQ ID NO: 25081 - DNA, 201 bp, Homo sapiens; identical to SEQ ID NO: 5264

SEQ ID NO: 25082 - DNA, 201 bp, Homo sapiens; identical to SEQ ID NO: 5410

SEQ ID NO: 25083 - DNA, 201 bp, Homo sapiens
aggactgcaaagtaggtaccttagttttccactgacttccacttttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattacct

SEQ ID NO: 25084 - DNA, 201 bp, Homo sapiens; identical to SEQ ID NO: 5411

SEQ ID NO: 25085 - DNA, 201 bp, Homo sapiens; identical to SEQ ID NO: 5266

SEQ ID NO: 25086 - DNA, 201 bp, Homo sapiens; identical to SEQ ID NO: 5412

SEQ ID NO: 25087 - DNA, 201 bp, Homo sapiens; identical to SEQ ID NO: 5268

SEQ ID NO: 25088 - DNA, 201 bp, Homo sapiens
cattgggtatcaggccttaactccagcgcaccctggaggtcactgatgtggctccaggctgacctgctcctgtcaaagaatattgagcaagatgcctctcrtggaatgttctgggaccttaaaacagatacccaagtattccccctgatttcatggttcccagaagctctatggggaagaaattgtaggtaattcacaact

SEQ ID NO: 25089 - DNA, 201 bp, Homo sapiens; identical to SEQ ID NO: 5414

SEQ ID NO: 25090 - DNA, 201 bp, Homo sapiens; identical to SEQ ID NO: 5417

SEQ ID NO: 25091 - DNA, 201 bp, Homo sapiens
ggacaggatgtgcagacacaactacgagctgggcgggcccatgaccctgcagcgccgaggtgagtgagggctttgggccggcggtcccagggcagccccgygggcccgtgcccagggcgcaggagcagccgggttggcctaagggaccttagtgccgggcggaaaggggactttgggttggggattcatggggggagccca

SEQ ID NO: 25092 - DNA, 201 bp, Homo sapiens
atatatttctacatctcctacatgcaaaacaacaggagcaagttgaggaattctcaagaaactggtcgagaagagagagcgcttagctatggaaaagagaragaaggaagggagggcttcctggaggaggtggcatttgaaccaggactgacatcaggatggaaatgtcagtcagggagttaagtagggggagcagctccg

SEQ ID NO: 25093 - DNA, 201 bp, Homo sapiens
gcggaaacccagaggtcttaacagtagggttcgtagaaggtccaagggccagatcttgatgcccaacattgcttatgggagcaacaacaacaacaaaaaamacatgctgcccagtggcttccagaagtttctggtccacagcctcaaggagctgaaagtgctgctgatgtgcaacaaatcttactgtgctgagatcgctca

SEQ ID NO: 25094 - DNA, 201 bp, Homo sapiens
gatggtgaaagtggaaggaggtgggagttgggcattgggtgtgaagatgctctttaaaggggttttaataaccacttgctaccaggccagtgaacacttaycatagttgatgccttttgagcatgttgcattgtaaactgtccctgaaattcctgtgcacttggcttatgggatgaaacatcctcctagttctcttgtctc

SEQ ID NO: 25095 - DNA, 201 bp, Homo sapiens
cagtaagaataggatcagctgtgctaaactaacaaatacccagatatccaggtttggctcatgctacacgtccaaagtaagtcatccaggaagctctgctyatcatcgtactcaggaagccaggctgacagtctttctcctgcacatctgctcccagaacctccccagcagaatgaagggaacctaagaatttattcactg

SEQ ID NO: 25096 - DNA, 201 bp, Homo sapiens
ttactgtgctgagatcgctcacaaaatttcctccagaactgcaaagtcatcatggaaagagtcacccagccggccatcagagtcaccaaccccagtaccasggtgcacagctaagaaaatgagtagaaagttcatgtccacgttttgtgtgtaaataaaaccataaaaactgccaaaaaaaattacatcaatgcctctaaa

SEQ ID NO: 25097 - DNA, 201 bp, Homo sapiens
agtctcattgagcaccttctcttcaatttcttttacacagtaagaataggatcagctgtgctaaactaacaaatacccagatatccaggtttggctcatgytacacgtccaaagtaagtcatccaggaagctctgcttatcatcgtactcaggaagccaggctgacagtctttctcctgcacatctgctcccagaacctcc

SEQ ID NO: 25098 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgaggtgagtgagggctttgggccggcggtcccagggcagccccgcgggcccgtgcccagggcgcaggagcagccgggttggc

SEQ ID NO: 25099 - DNA, 201 bp, Homo sapiens; identical to SEQ ID NO: 5436

SEQ ID NO: 25100 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggtgagtgagggctttgggccggcggtcccagggcagccccgcgggcccgtgcccagggcgcaggagcagccgggttggccta

SEQ ID NO: 25101 - DNA, 201 bp, Homo sapiens; identical to SEQ ID NO: 5438

SEQ ID NO: 25102 - DNA, 201 bp, Homo sapiens
aaggtatcagatgtgtctcactctgacatatgcaggtgtttatgaaactctgggatttctaaggaaggatgcagtgcagagacaggtcccagaggagacargagctgagagaccatccaaactgggaccaccttgtcactagacttcaaattttcaatattgatagagtgttttctaagagtcaggccctttgctgagtgc

SEQ ID NO: 25103 - DNA, 201 bp, Homo sapiens
aggagaagcgggcagtgccggacaggatgtgcagacacaactacgagctgggcgggcccatgaccctgcagcgccgaggtgagtgagggctttgggccggsggtcccagggcagccccgcgggcccgtgcccagggcgcaggagcagccgggttggcctaagggaccttagtgccgggcggaaaggggactttgggttggg

SEQ ID NO: 25104 - DNA, 201 bp, Homo sapiens
aggttggttcatttatatttccagagccagctaagaatagtacaggagaacaggattgtggactaattttagccatgtcactgaatccaacagtacattayaaaaacaatacgttttgaccaattttagatttattctaggaatgcaatgattcttcagtgtcagaaaatatataatgtggttaacacattagtggactcc

SEQ ID NO: 25105 - DNA, 201 bp, Homo sapiens
ccatgtcatgacctatgacctccatggctcctgggagggctacactggagagaacagccccctctacaaatacccgactgacaccggcagcaacgcctacstcaatgtggtgagtccctgtacagatgcaagagcagaccagagatgatgatgaaaatcacatagagattcaggcacaaaaggcatcataagtttagtggt

SEQ ID NO: 25106 - DNA, 201 bp, Homo sapiens
ctgatggtcactgctgcagtagctgctggcatctccaacatccagtctggctatgagatcccccaactgtcacagtgagtgatgtgccttatcttcaaacycctggaggtatcactcaggcagactagacttgtctttggtctgtcttgctattcagggaccttgtttaggaggctatggaagtggtgccttgtgcccgca

SEQ ID NO: 25107 - DNA, 201 bp, Homo sapiens
ccggcagcaacgcctacctcaatgtggtgagtccctgtacagatgcaagagcagaccagagatgatgatgaaaatcacatagagattcaggcacaaaaggyatcataagtttagtggttttctcaaatgagaaattaggctgccataatcaattaaatattctcatttactaaaaaacttgcctatttattaacaccatac

SEQ ID NO: 25108 - DNA, 201 bp, Homo sapiens
agttgccaagggaagcttataagtccaactactggtggactcagttgagaacaatcttccacttagaagcaatccaaagctggcattgataaagcattcaktctccttggtcaggagattcactcctagggaaataattggaactgtggagacattggggtgcagcaaaccaacatggcacatgtatacctatgtaacaaa

SEQ ID NO: 25109 - DNA, 201 bp, Homo sapiens; identical to SEQ ID NO: 5541

SEQ ID NO: 25110 - DNA, 201 bp, Homo sapiens
gaaaatcacatagagattcaggcacaaaaggcatcataagtttagtggttttctcaaatgagaaattaggctgccataatcaattaaatattctcatttaytaaaaaacttgcctatttattaacaccatactgataattttacctaatatgaaagaagattaataacaagtgcattgttttttaataaaagaaaatgata

SEQ ID NO: 25111 - DNA, 201 bp, Homo sapiens
gggagggctacactggagagaacagccccctctacaaatacccgactgacaccggcagcaacgcctacctcaatgtggtgagtccctgtacagatgcaagrgcagaccagagatgatgatgaaaatcacatagagattcaggcacaaaaggcatcataagtttagtggttttctcaaatgagaaattaggctgccataatc

SEQ ID NO: 25112 - DNA, 201 bp, Homo sapiens
ttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaact

SEQ ID NO: 25113 - DNA, 201 bp, Homo sapiens
tataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaactt

SEQ ID NO: 25114 - DNA, 201 bp, Homo sapiens
gtctcaccctgccttctttgggtctccctcagtttcactgccatggtttccactcctgagaaccaccagactttcatcaactcagtcatcaaattcctgcrccagtatgagtttgacgggctggactttgactgggagtaccccggctctcgtgtgagccctcctcaggacaagcatctcttcactgtcctggtgcaggtg

SEQ ID NO: 25115 - DNA, 201 bp, Homo sapiens
gcatgttctcactcataagatggagttggaacaatgagaacacatggacaccgggaagggaacaagaaacactggagccagctgaggggttgggggcaagsgggggagagcattaggacaaatacctaatgcatgtggggattaaaacctagatgacgggttgataggtgcagcaaaccatcatggcacacgtatacctat

SEQ ID NO: 25116 - DNA, 201 bp, Homo sapiens
ggttgattttactctaaggtgttgggaccaccaaggtctcaccctgccttctttgggtctccctcagtttcactgccatggtttccactcctgagaaccaycagactttcatcaactcagtcatcaaattcctgcgccagtatgagtttgacgggctggactttgactgggagtaccccggctctcgtgtgagccctcctc

SEQ ID NO: 25117 - DNA, 201 bp, Homo sapiens
catgttctcactcataagatggagttggaacaatgagaacacatggacaccgggaagggaacaagaaacactggagccagctgaggggttgggggcaaggsggggagagcattaggacaaatacctaatgcatgtggggattaaaacctagatgacgggttgataggtgcagcaaaccatcatggcacacgtatacctatg

SEQ ID NO: 25118 - DNA, 201 bp, Homo sapiens
agatctgtaccttcctgaagaatggagctactgaagtatgggaggcttctgaggatgttccctatgcctacaaaggaaatgagtggcttggatacgataayaccaagagtttccaaatcaaggtagactgtgttctatgggttgttgttgcctgtgagcatgttcccattatagccctggagccacagctcagccttggtg

SEQ ID NO: 25119 - DNA, 201 bp, Homo sapiens
tagtattttatttaaacatctatattttaaaaataattgtaataatgagaatacatagacacagggaggggagcaacacacactggggcctgtcggggggsggtgggggtagggaaagcatcaggataaagagctaaagcatgtggggcttcatacctaggtgatgggttgataggtgcagcaagccaccatggcacatgt

SEQ ID NO: 25120 - DNA, 201 bp, Homo sapiens
tgaaaaaaatagacagtctcaaaaaacaagctgacctttttatgttccttgaacctagttgtgaagggcccttgttactgggcctcatgccaaacaactcrttacaaaaacagctagagtcccagacggtgccaaagcttcatgaaacctctcctcgtctgtgcacgaacaggtggccaactctggagcccaggctgttgc

SEQ ID NO: 25121 - DNA, 201 bp, Homo sapiens
tgcgccagtatgagtttgacgggctggactttgactgggagtaccccggctctcgtgtgagccctcctcaggacaagcatctcttcactgtcctggtgcargtgagctaagttccagatcattttcactggaaagcatacacccatctcatatgaaagatcactgggaccttaaacctagtttcctagaattttatttggg

SEQ ID NO: 25122 - DNA, 201 bp, Homo sapiens
gtttttaaagaaatctgtgactcactagggagcttgtctctcaccttctttctctgggtaacaggctctgcctaccagctgacatgttacttcaccaactrggcccagaaccagccaggcctggggtgcttcaagcctgatgacatcgacccctgcctctgtacccacttgatctacgcctttgctggaatgcagaacaac

SEQ ID NO: 25123 - DNA, 201 bp, Homo sapiens
gctctcacacatcaggtatcactggctaaaagcaaggaggttcaggatttgttttcttttttcttctcaggttgcaaagctccagcccaacccattgctcycattgccgaggcaaacatcacatgcggtgtcagccacagtggtagctctgggggccgctctggcaggagctctgggggcagccccagaggtagtggattc

SEQ ID NO: 25124 - DNA, 201 bp, Homo sapiens
ctactggtggactcagttgagaacaatcttccacttagaagcaatccaaagctggcattgataaagcattcagtctccttggtcaggagattcactcctasggaaataattggaactgtggagacattggggtgcagcaaaccaacatggcacatgtatacctatgtaacaaacctgcacattgtgcacatgtaccctgga

SEQ ID NO: 25125 - DNA, 201 bp, Homo sapiens
ggtacccggactacatccatgtcatgacctatgacctccatggctcctgggagggctacactggagagaacagccccctctacaaatacccgactgacacyggcagcaacgcctacctcaatgtggtgagtccctgtacagatgcaagagcagaccagagatgatgatgaaaatcacatagagattcaggcacaaaaggca

SEQ ID NO: 25126 - DNA, 201 bp, Homo sapiens
cttagaagcaatccaaagctggcattgataaagcattcagtctccttggtcaggagattcactcctagggaaataattggaactgtggagacattggggtrcagcaaaccaacatggcacatgtatacctatgtaacaaacctgcacattgtgcacatgtaccctggaacttaaagtatatttaaaaaaaaaactgtggag

SEQ ID NO: 25127 - DNA, 201 bp, Homo sapiens
ttttttcttctcaggttgcaaagctccagcccaacccattgctcccattgccgaggcaaacatcacatgcggtgtcagccacagtggtagctctgggggcygctctggcaggagctctgggggcagccccagaggtagtggattctgtgctgacagggccagtggcctgtaccctgaccccactgacaagaatgcctccta

SEQ ID NO: 25128 - DNA, 201 bp, Homo sapiens
cttgtctttggtctgtcttgctattcagggaccttgtttaggaggctatggaagtggtgccttgtgcccgcacaggtatgggaaatgaccatcagaatgaytttaaatcctctaccccacctcaggtacccggactacatccatgtcatgacctatgacctccatggctcctgggagggctacactggagagaacagcccc

SEQ ID NO: 25129 - DNA, 201 bp, Homo sapiens
aacactgcatgttctcactcataagatggagttggaacaatgagaacacatggacaccgggaagggaacaagaaacactggagccagctgaggggttgggrgcaagggggggagagcattaggacaaatacctaatgcatgtggggattaaaacctagatgacgggttgataggtgcagcaaaccatcatggcacacgtat

SEQ ID NO: 25130 - DNA, 201 bp, Homo sapiens
cctcaatgtggtgagtccctgtacagatgcaagagcagaccagagatgatgatgaaaatcacatagagattcaggcacaaaaggcatcataagtttagtgkttttctcaaatgagaaattaggctgccataatcaattaaatattctcatttactaaaaaacttgcctatttattaacaccatactgataattttacctaa

SEQ ID NO: 25131 - DNA, 201 bp, Homo sapiens
acctcaatgtggtgagtccctgtacagatgcaagagcagaccagagatgatgatgaaaatcacatagagattcaggcacaaaaggcatcataagtttagtrgttttctcaaatgagaaattaggctgccataatcaattaaatattctcatttactaaaaaacttgcctatttattaacaccatactgataattttaccta

SEQ ID NO: 25132 - DNA, 201 bp, Homo sapiens
aaggttgagcattactgtacaatcgcttctgcttctttactgtaggatcttagatgtaattgatccctatttcccaatgatatacagttgctccaccagcmcccaagcctgcagcatgcactgctagtcctggatgttgggtagcggaagcagggggattaaaggaaaatacatggtcccttcattctcaaaacatgtatt

SEQ ID NO: 25133 - DNA, 201 bp, Homo sapiens
tgtggagacattggggtgcagcaaaccaacatggcacatgtatacctatgtaacaaacctgcacattgtgcacatgtaccctggaacttaaagtatatttaaaaaaaaaactgtggagacattgaaacataccaatcatagtcacctactccaacattcataagtaggaaataaggataagaacaaagataaaccaggatg

SEQ ID NO: 25134 - DNA, 201 bp, Homo sapiens
catctcttcactgtcctggtgcaggtgagctaagttccagatcattttcactggaaagcatacacccatctcatatgaaagatcactgggaccttaaaccyagtttcctagaattttatttggggtgaaggacctgaaaatcctattccagtaaggatgctgaggaatgaatggaaggatggaagaggttaatttaattca

SEQ ID NO: 25135 - DNA, 201 bp, Homo sapiens
gagccaagaacaaaatccaggtactagctctcacacatcaggtatcactggctaaaagcaaggaggttcaggatttgttttcttttttcttctcaggttgyaaagctccagcccaacccattgctcccattgccgaggcaaacatcacatgcggtgtcagccacagtggtagctctgggggccgctctggcaggagctctg

SEQ ID NO: 25136 - DNA, 201 bp, Homo sapiens
ttttcttttttcttctcaggttgcaaagctccagcccaacccattgctcccattgccgaggcaaacatcacatgcggtgtcagccacagtggtagctctgrgggccgctctggcaggagctctgggggcagccccagaggtagtggattctgtgctgacagggccagtggcctgtaccctgaccccactgacaagaatgcc

SEQ ID NO: 25137 - DNA, 201 bp, Homo sapiens
tcaggatttgttttcttttttcttctcaggttgcaaagctccagcccaacccattgctcccattgccgaggcaaacatcacatgcggtgtcagccacagtsgtagctctgggggccgctctggcaggagctctgggggcagccccagaggtagtggattctgtgctgacagggccagtggcctgtaccctgaccccactga

SEQ ID NO: 25138 - DNA, 201 bp, Homo sapiens
gttccttggaagtcatggagctgttgcacaagtaattgtctgacattgtccattcctatctggtaacaattgattaatggtgggaagaacaaacagggctyttcaccatttcttccttccttcattcatttcacaagaaatttattgaacatctattacatatacagtgctctgtaggtaccacaggtgatctaaatgcat

SEQ ID NO: 25139 - DNA, 201 bp, Homo sapiens
ccattgacctggatgatttcacaggcactttctgcaaccaaggaaaattccctctgatcaccaccctgaaggatgctctgggcctgcagagtacaagtgakttagggagtgagaagggacactaagcctcagacttaagagaaattccaaaggttccttggaagtcatggagctgttgcacaagtaattgtctgacattgt

SEQ ID NO: 25140 - DNA, 201 bp, Homo sapiens
agaatttagttgagaattagacctatcactttaacagatatatgtcagtgatgctctaaaatatgttgcaagtactttgtacagtgggcacaaccaaatcraaaaaagtttagctaataattaatcactaggccatcagctgtgggtgagaactctagctaacccactgccattgcaggattatgtcatgaactactggaa

SEQ ID NO: 25141 - DNA, 201 bp, Homo sapiens
ttttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaa

SEQ ID NO: 25142 - DNA, 201 bp, Homo sapiens
tttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaac

SEQ ID NO: 25143 - DNA, 201 bp, Homo sapiens
gtggagacatagaaggaggagccaagaacaaaatccaggtactagctctcacacatcaggtatcactggctaaaagcaaggaggttcaggatttgttttcytttttcttctcaggttgcaaagctccagcccaacccattgctcccattgccgaggcaaacatcacatgcggtgtcagccacagtggtagctctgggggcc

SEQ ID NO: 25144 - DNA, 201 bp, Homo sapiens
gtgaagcttttgagcaggaggccaagcacattaataagcccaggctgatggtcactgctgcagtagctgctggcatctccaacatccagtctggctatgasatcccccaactgtcacagtgagtgatgtgccttatcttcaaacccctggaggtatcactcaggcagactagacttgtctttggtctgtcttgctattcag

SEQ ID NO: 25145 - DNA, 201 bp, Homo sapiens
tgttcccattatagccctggagccacagctcagccttggtgtctgtacataactgacttcctttctaattaccacaggcagattggctaaagaagaacaastttggaggtgccatggtctgggccattgacctggatgatttcacaggcactttctgcaaccaaggaaaattccctctgatcaccaccctgaaggatgctc

SEQ ID NO: 25146 - DNA, 201 bp, Homo sapiens
ttgatkacrtgagargaatatgaggctgttttcatgatgtgagaaatccttgtgctccaaacagacaaggtcctgaaggagaagagaaagctgtttatccrttccatgggtgaaggtacaataaatggcttactggatgaattattacagacaagggtgctgaaccaggaagagatggagaaagtaaaacgtgaaaatgct

SEQ ID NO: 25147 - DNA, 201 bp, Homo sapiens
tctcacataaactctgtgaaaacatttcctcatatgttcgtgaaagcaatgtttagtgctatgaatccatctagagcacaccatgattttagcattcatcrttctattttatatttattctagtttacgtattcaatattcttgtcctcccatatgtatacattgtaggaggagatgctgaaggacaggaaaagggatcat

SEQ ID NO: 25148 - DNA, 201 bp, Homo sapiens
tttactttctccatctcttcctggttcagcacccttgtctgtaataattcatccagtaagccatttattgtaccttcacccatggaatggataaacagctmtctcttctccttcaggaccttgtctgtttggagcacaaggatttctcacatcatgaaaacagcctcatattcctctcacgtcatcaacagaaagtgacct

SEQ ID NO: 25149 - DNA, 201 bp, Homo sapiens
ggacagcaatacagtaagaagagggattacccaactgtgaggagggggacatttcactgatgaaatctaaatgaggtcactttctgttgatgacgtgagargaatatgaggctgttttcatgatgtgagaaatccttgtgctccaaacagacaaggtcctgaaggagaagagaaagctgtttatccattccatgggtgaag

SEQ ID NO: 25150 - DNA, 201 bp, Homo sapiens; identical to SEQ ID NO: 5544

SEQ ID NO: 25151 - DNA, 201 bp, Homo sapiens
tgcaaatttggcatgcctgtgcccctttcggaataacggagtcaatcaaagctcgggtcttatccataactgtagcattttcacgttttactttctccatstcttcctggttcagcacccttgtctgtaataattcatccagtaagccatttattgtaccttcacccatggaatggataaacagctttctcttctccttca

SEQ ID NO: 25152 - DNA, 201 bp, Homo sapiens
tcagagaagaataaagtatatttaagtgacgatgatacgttcaggaaatacattcaatgattacagaatagtaaagatttcaacagggctctttcctcccrttgcccccatgcattttcttttgagtaagatctgcttgtctgttgccaagctgcagatcatactgggaggcctggacttccatcatctgcagccctccta

SEQ ID NO: 25153 - DNA, 201 bp, Homo sapiens
aggaaatgagcttgcccattcttataatcccttgaacctacagcatggtgaggatgggagttttggtgcacttgaacattatttattgtcatttagtcagrgttgtgggaggaatttgcagtgaggagtggcttatgcattgctgtaaagttttccagagatgataagtggctatttcaatgttcttcatctttttatagg

SEQ ID NO: 25154 - DNA, 201 bp, Homo sapiens
gaagaataaagtatatttaagtgacgatgatacgttcaggaaatacattcaatgattacagaatagtaaagatttcaacagggctctttcctcccgttgcycccatgcattttcttttgagtaagatctgcttgtctgttgccaagctgcagatcatactgggaggcctggacttccatcatctgcagccctcctagggcc

SEQ ID NO: 25155 - DNA, 201 bp, Homo sapiens
agaaatgcatgtttttatcaagttcagatattactctactgaatttattaaggatgattacctcatgaatgttttcttaaatgtttcacagcatgggataytcactatataaccaaatactgtattctcaaaaataactcaaatgcttttctttagtttttctctattgctttcacaaatccttacaaagaaaccaaacat

SEQ ID NO: 25156 - DNA, 201 bp, Homo sapiens
caagtaggacagcaatacagtaagaagagggattacccaactgtgaggagggggacatttcactgatgaaatctaaatgaggtcactttctgttgatgacrtgagaggaatatgaggctgttttcatgatgtgagaaatccttgtgctccaaacagacaaggtcctgaaggagaagagaaagctgtttatccattccatgg

SEQ ID NO: 25157 - DNA, 201 bp, Homo sapiens
tgatgcaaatttggcatgcctgtgcccctttcggaataacggagtcaatcaaagctcgggtcttatccataactgtagcattttcacgttttactttctcratctcttcctggttcagcacccttgtctgtaataattcatccagtaagccatttattgtaccttcacccatggaatggataaacagctttctcttctcct

SEQ ID NO: 25158 - DNA, 201 bp, Homo sapiens
tcacgttttactttctccatctcttcctggttcagcacccttgtctgtaataattcatccagtaagccatttattgtaccttcacccatggaatggataaycagctttctcttctccttcaggaccttgtctgtttggagcacaaggatttctcacatcatgaaaacagcctcatattcctctcacgtcatcaacagaaag

SEQ ID NO: 25159 - DNA, 201 bp, Homo sapiens
atttaagactactgaaatattccctcacatcttccagagacacatttatgtaaacaatttcagagctgaacatgccattcttccccaccctgcttctcttmcagttttgtgtaacttggtttttgatgccaccatcaccagttgttcaatccaggaacttgaaactcatcttggcccccttcctctcatgcacctccaata

SEQ ID NO: 25160 - DNA, 201 bp, Homo sapiens
ctcatgaatgttttcttaaatgtttcacagcatgggatattcactatataaccaaatactgtattctcaaaaataactcaaatgcttttctttagtttttytctattgctttcacaaatccttacaaagaaaccaaacatttcttctactaaattattattttatagttttctccaatataatcattctaattagttcttc

SEQ ID NO: 25161 - DNA, 201 bp, Homo sapiens
ctggttcagcacccttgtctgtaataattcatccagtaagccatttattgtaccttcacccatggaatggataaacagctttctcttctccttcaggaccwtgtctgtttggagcacaaggatttctcacatcatgaaaacagcctcatattcctctcacgtcatcaacagaaagtgacctcatttagatttcatcagtga

SEQ ID NO: 25162 - DNA, 201 bp, Homo sapiens
gataagacccgagctttgattgactccgttattccgaaaggggcacaggcatgccaaatttgcatcacatacatttgtgaagaagacagttacctggcagrgacgctgggactctcagcaggtaagggtcagtgactcacactcaagttcacctagggcctgtcttcgtgcctaacatttgatttctttactagtcatgtt

SEQ ID NO: 25163 - DNA, 201 bp, Homo sapiens
cctcatatgttcgtgaaagcaatgtttagtgctatgaatccatctagagcacaccatgattttagcattcatcgttctattttatatttattctagtttaygtattcaatattcttgtcctcccatatgtatacattgtaggaggagatgctgaaggacaggaaaagggatcattaaaaaaatattcccagtgtttactac

SEQ ID NO: 25164 - DNA, 201 bp, Homo sapiens
gtatgtgatgcaaatttggcatgcctgtgcccctttcggaataacggagtcaatcaaagctcgggtcttatccataactgtagcattttcacgttttactwtctccatctcttcctggttcagcacccttgtctgtaataattcatccagtaagccatttattgtaccttcacccatggaatggataaacagctttctctt

SEQ ID NO: 25165 - DNA, 201 bp, Homo sapiens
gatgcaaatttggcatgcctgtgcccctttcggaataacggagtcaatcaaagctcgggtcttatccataactgtagcattttcacgttttactttctccytctcttcctggttcagcacccttgtctgtaataattcatccagtaagccatttattgtaccttcacccatggaatggataaacagctttctcttctcctt

SEQ ID NO: 25166 - DNA, 201 bp, Homo sapiens
tcctggttcagcacccttgtctgtaataattcatccagtaagccatttattgtaccttcacccatggaatggataaacagctttctcttctccttcaggarcttgtctgtttggagcacaaggatttctcacatcatgaaaacagcctcatattcctctcacgtcatcaacagaaagtgacctcatttagatttcatcagt

SEQ ID NO: 25167 - DNA, 201 bp, Homo sapiens
atgaaagtagatcctccctgtaatgcatacctagaaatctctggcttgaaatgtgctccattagcagcaaacgcactcaactatgttaatgactagattargattgtcctctaggaatgtatttcctcttttgtagcttcctccataggtgaggctataagaacaaagagggataccactgttcatgatattccttgtctc

SEQ ID NO: 25168 - DNA, 201 bp, Homo sapiens
agccatttattgtaccttcacccatggaatggataaacagctttctcttctccttcaggaccttgtctgtttggagcacaaggatttctcacatcatgaamacagcctcatattcctctcacgtcatcaacagaaagtgacctcatttagatttcatcagtgaaatgtccccctcctcacagttgggtaatccctcttctt

SEQ ID NO: 25169 - DNA, 201 bp, Homo sapiens
gattaggattgtcctctaggaatgtatttcctcttttgtagcttcctccataggtgaggctataagaacaaagagggataccactgttcatgatattcctkgtctcttgcagctcttcaggcagtgcaggacaacccagctatgcccacatgctcaagcccagaaggcagaatcaagctttgctttctagaagacgctcaa

SEQ ID NO: 25170 - DNA, 201 bp, Homo sapiens
aaacaagtaggacagcaatacagtaagaagagggattacccaactgtgaggagggggacatttcactgatgaaatctaaatgaggtcactttctgttgatkacgtgagaggaatatgaggctgttttcatgatgtgagaaatccttgtgctccaaacagacaaggtcctgaaggagaagagaaagctgtttatccattcca

SEQ ID NO: 25171 - DNA, 201 bp, Homo sapiens
gaagaagacagttacctggcagagacgctgggactctcagcaggtaagggtcagtgactcacactcaagttcacctagggcctgtcttcgtgcctaacatktgatttctttactagtcatgttaatctgcagaatatcttcttatctctgcctttgggccatatttctgtagcagaggccctattgcatgtcccttgactc

SEQ ID NO: 25172 - DNA, 201 bp, Homo sapiens
actgtagcattttcacgttttactttctccatctcttcctggttcagcacccttgtctgtaataattcatccagtaagccatttattgtaccttcacccawggaatggataaacagctttctcttctccttcaggaccttgtctgtttggagcacaaggatttctcacatcatgaaaacagcctcatattcctctcacgtc

SEQ ID NO: 25173 - DNA, 201 bp, Homo sapiens
ctacagttatggataagacccgagctttgattgactccgttattccgaaaggggcacaggcatgccaaatttgcatcacatacatttgtgaagaagacagktacctggcagagacgctgggactctcagcaggtaagggtcagtgactcacactcaagttcacctagggcctgtcttcgtgcctaacatttgatttcttta

SEQ ID NO: 25174 - DNA, 201 bp, Homo sapiens
cagaatacaataataaagtggagtgaaagatatacttcaggcagttttgaaatgcagtggctttttcttagaaccaattttattgagcggttctggaggawcatacttctgctccccttgcataaaggatctctatatcctagaatcccaggtttaggtaaagagttgcaaactggaactcataaattatcatagtcttca

SEQ ID NO: 25175 - DNA, 201 bp, Homo sapiens
tcggaataacggagtcaatcaaagctcgggtcttatccataactgtagcattttcacgttttactttctccatctcttcctggttcagcacccttgtctgraataattcatccagtaagccatttattgtaccttcacccatggaatggataaacagctttctcttctccttcaggaccttgtctgtttggagcacaagga

SEQ ID NO: 25176 - DNA, 201 bp, Homo sapiens
agcgtctctgccaggtaactgtcttcttcacaaatgtatgtgatgcaaatttggcatgcctgtgcccctttcggaataacggagtcaatcaaagctcgggrcttatccataactgtagcattttcacgttttactttctccatctcttcctggttcagcacccttgtctgtaataattcatccagtaagccatttattgta

SEQ ID NO: 25177 - DNA, 201 bp, Homo sapiens
tccatctcttcctggttcagcacccttgtctgtaataattcatccagtaagccatttattgtaccttcacccatggaatggataaacagctttctcttctrcttcaggaccttgtctgtttggagcacaaggatttctcacatcatgaaaacagcctcatattcctctcacgtcatcaacagaaagtgacctcatttagat

SEQ ID NO: 25178 - DNA, 201 bp, Homo sapiens
gtgctgaaccaggaagagatggagaaagtaaaacgtgaaaatgctacagttatggataagacccgagctttgattgactccgttattccgaaaggggcacrggcatgccaaatttgcatcacatacatttgtgaagaagacagttacctggcagagacgctgggactctcagcaggtaagggtcagtgactcacactcaag

SEQ ID NO: 25179 - DNA, 201 bp, Homo sapiens
gtgcccctttcggaataacggagtcaatcaaagctcgggtcttatccataactgtagcattttcacgttttactttctccatctcttcctggttcagcackcttgtctgtaataattcatccagtaagccatttattgtaccttcacccatggaatggataaacagctttctcttctccttcaggaccttgtctgtttgga

SEQ ID NO: 25180 - DNA, 201 bp, Homo sapiens
ctgttgcttcctttaacttcagtctcatctgctcctgggagggagagctccatctctgacgtaactggctctgttgggctttagcgccagcctgctccacygagtggggttttcaggaccactgcctctgggcagctcttccactctggctacggagcgtatgttgtagaaattttgatttctctccctgccaacctggga

SEQ ID NO: 25181 - DNA, 201 bp, Homo sapiens
tttaagccagctttgccgtcccttaaaggaacaggacacaccaaacgagtctccaccacacaagccagggttgtagtttacagacggttctggttggtggsgtctggcccacacaacttgttgtacctactgttcgtgtccaagtgctcactcaccatgtgtaatgctctccccctgattaatctgcgcgaacagtgctga

SEQ ID NO: 25182 - DNA, 201 bp, Homo sapiens
gatcttggctcactgaaacctccacctttcaggttcaagcgattctcctgcctcagccccccaagtagctgggactacagacatgtgccaccacacccggstaatttttgtatatttagtagagatggggtttcaccatgttgcccaggctggtctcgagctcctgaccttgtgatccacccacctcggcctcccaaactg

SEQ ID NO: 25183 - DNA, 201 bp, Homo sapiens
cttgccctccagttcaagtacagctggctccttctttgtggctcgtttgggggatgggctggtttggggtttaggtgcagagaatggtttggggccactgygtactggaccactctgagccttcagggcagggttcttgtgagtcttcatgtcatcagatacatgtttcagggctgtaagaacaacagctaccttgttcct

SEQ ID NO: 25184 - DNA, 201 bp, Homo sapiens
aatacatgtataaacacattctagaatgtcactctgactgttgcttcctttaacttcagtctcatctgctcctgggagggagagctccatctctgacgtarctggctctgttgggctttagcgccagcctgctccactgagtggggttttcaggaccactgcctctgggcagctcttccactctggctacggagcgtatgt

SEQ ID NO: 25185 - DNA, 201 bp, Homo sapiens
gattatgtaaaatttaaatttcagtgtccttattggaacagttttagttactttttacatactgtctgtggctgcatttgttacagtggcagcaatgagtrgttacaaccatatggcccttaaagcctaaaatattttgtatctggcctttacaaaaacgtttgctgacctctgtactcaagagtgaattgtttccgtgcc

SEQ ID NO: 25186 - DNA, 201 bp, Homo sapiens
agtggcgtcaggatagcagcatctctcacttggtcaggctaggtgagctgcggctggctatatgactggcgcatctacccttttatttattccttcacacrttgaacagagatttgttaggcacctacagttcatttacaaattgagtaacccttatctgaaatgcttgggactgggaagcatttcggatttttttttttt

SEQ ID NO: 25187 - DNA, 201 bp, Homo sapiens
tgacagccatctgtaatcccagctgcttgggaagctgaggcaggagaattacttgaacccaggaggcagagcttgcagtgagccaagatcgtgccactgcrccccagcctgggtgacagagcgagactctgtctcaaaaagaacataaaatgaaattgaaatgaaatgaaaaaatacagctgcctgctggggaaaaaacct

SEQ ID NO: 25188 - DNA, 201 bp, Homo sapiens
aactaattccactcctagccatgtctatttggttccttgttttcaggtatttattagtctttggattctcaaatgtgcaacttccctattcatctccttcmgttgttttattatcttggttttgagttcttattctattgagctcattttcttgtcttttttttagagacaaggtcttgctctgttgcccaggctggagta

SEQ ID NO: 25189 - DNA, 201 bp, Homo sapiens
tattctacatattctctgttctcatggatttgcatggtatttaaacttcattcttcttcctttactctttattctcactcttgcccagttgcctccaaaamgcctatacttttctttctttgtgtgaaccaaaacaacccttggcgatcagaattctgttagtgatgctaagtgagcagtccgtcggggggtgacaagtga

SEQ ID NO: 25190 - DNA, 201 bp, Homo sapiens
caaaaccccatctctactaaaaatacaaaaattaggcaggcgtggtggtgcacacctgtagtctcagccactccggaggctgaggctagagaattgcttgyacccagaaggcggaggttgcagtgagctgagatcgcaccactgcaccccaacctagatgacagagtgagactctgtctcaaaaaataaaaataaaaaata

SEQ ID NO: 25191 - DNA, 201 bp, Homo sapiens
aatacaaaaattaggcaggcgtggtggtgcacacctgtagtctcagccactccggaggctgaggctagagaattgcttgcacccagaaggcggaggttgcrgtgagctgagatcgcaccactgcaccccaacctagatgacagagtgagactctgtctcaaaaaataaaaataaaaaatactgattaaaagctatagattg

SEQ ID NO: 25192 - DNA, 201 bp, Homo sapiens
gctacaatgctatgggattctcccagggaggccaatttctgtacgttcctttttgttatattgtaccacttatatggaattgatttttgtttcttttattyagataaatccactcctccaattcaagattgtcacctatcttggaagggaaatttcctaaaatgttcctgtgtaagaagctttatggaacttaatttcttt

SEQ ID NO: 25193 - DNA, 201 bp, Homo sapiens
aaatatggccctgcctgtcctatgggaatttttcagaggataaagtgaaataataggtaggaaaatactttttaaaagtataaggattatacaaacgcaarttggtaaaaacagctttattattcattcatttaacaaatatttattgaaaacctattatatgccaggaacaagacagacaaggttcttgcattcatgaaa

SEQ ID NO: 25194 - DNA, 201 bp, Homo sapiens
taacaaatatttattgaaaacctattatatgccaggaacaagacagacaaggttcttgcattcatgaaatatatatatatacacacacacatgtgcacatrtatgcacatacatacatagacatatatatatacacatatgcacctatatacacacatacatagacatatatagacatatatatacacacatatgcactta

SEQ ID NO: 25195 - DNA, 201 bp, Homo sapiens
tattatatgccaggaacaagacagacaaggttcttgcattcatgaaatatatatatatacacacacacatgtgcacatatatgcacatacatacatagacatatatatatacacatatgcacctatatacacacatacatagacatatatagacatatatatacacacatatgcacttatatacacatatatacacacaca

SEQ ID NO: 25196 - DNA, 201 bp, Homo sapiens
gttcactgaaatagcacttctaattttcctcaggaactttttttttttttgcattctataaatgttcagagttctaaacctttaaaaggtttcaaatacaygtataaacacattctagaatgtcactctgactgttgcttcctttaacttcagtctcatctgctcctgggagggagagctccatctctgacgtaactggct

SEQ ID NO: 25197 - DNA, 201 bp, Homo sapiens
attatatgccaggaacaagacagacaaggttcttgcattcatgaaatatatatatatacacacacacatgtgcacatatatgcacatacatacatagacatatatatatacacatatgcacctatatacacacatacatagacatatatagacatatatatacacacatatgcacttatatacacatatatacacacacac

SEQ ID NO: 25198 - DNA, 201 bp, Homo sapiens
gttctggttggtggggtctggcccacacaacttgttgtacctactgttcgtgtccaagtgctcactcaccatgtgtaatgctctccccctgattaatctgygcgaacagtgctgagcgggaagcagactcatctgagcctgaactggtagagactgggggaggaggggggcctggtggagggggaggaggacctgatccgg

SEQ ID NO: 25199 - DNA, 201 bp, Homo sapiens
tatatatatacacatatgcacctatatacacacatacatagacatatatagacatatatatacacacatatgcacttatatacacatatatacacacacayatatatatatatacacgataaaatggaggatagctgggcacatggtggtgtacacctgtagtccctgctacttgggaggctgaggctggaggatcatttg

SEQ ID NO: 25200 - DNA, 201 bp, Homo sapiens
tatatatacacatatgcacctatatacacacatacatagacatatatagacatatatatacacacatatgcacttatatacacatatatacacacacacayatatatatatacacgataaaatggaggatagctgggcacatggtggtgtacacctgtagtccctgctacttgggaggctgaggctggaggatcatttgaa

SEQ ID NO: 25201 - DNA, 201 bp, Homo sapiens
tggagaacgttgttttcagagaaataaaaggaatagacaattctctaggcagtagccttttcttgttctaaaattggtgcttaagctttctcacaggttgmaaatggaataagtaagttcaaaatgggaaatgatctcagtccacttctactcagtagccagtttgcttcccgttcctagttctagttccctgaaatagaa

SEQ ID NO: 25202 - DNA, 201 bp, Homo sapiens
agatgagagattgtagaaataaagacacaagacaaagagataaaagacagctgggcccgggggaccactaccaccaagacgtggagactggtagcggcccygaatgccaggctgcgctgatatttattggatacaagacaaggggggcagggtaaggagtgtgagccatctcccatgataggtaaagtcacatgggtcacg

SEQ ID NO: 25203 - DNA, 201 bp, Homo sapiens
gttgtggctggtttggtcttctatctagaccactcagattttctccatagcagcaataagactgttttgcttccttattatttgtgtgttcactgaaatarcacttctaattttcctcaggaactttttttttttttgcattctataaatgttcagagttctaaacctttaaaaggtttcaaatacatgtataaacacatt

SEQ ID NO: 25204 - DNA, 201 bp, Homo sapiens
tggatttagcaatataaagatgattaatcttgacaaaagcagttttgggagagtcgtgatagtgagatctttattgggatgggttacagaaaaatattcaragtaattagagtcagcaaatacaaacacttgcaaggttctccaacaggccctggggctactacagtggggtcaaaagaggacacagggtaggagctttgt

SEQ ID NO: 25205 - DNA, 201 bp, Homo sapiens
atattttgacctcttcccgtgaatcatgaatttttgtttgtttgtttttgagacagagtctcactctgtcacccaagttggagtgcagtggtgccattacrgcttactgcaacatagcctcaacctcccaggctcaagcaatcctcccacctcagcgtcctgagcagctgggactacaggtgtgagccactacaccccact

SEQ ID NO: 25206 - DNA, 201 bp, Homo sapiens
accttacaaaccaacctctgctagcttcacgctttttttctgcagcttcctcacctctctcagccttcattgaattgaagagagttaggacgttgctctgrattaggctttggcttaagggaatgttgtggctggtttggtcttctatctagaccactcagattttctccatagcagcaataagactgttttgcttcctta

SEQ ID NO: 25207 - DNA, 201 bp, Homo sapiens
atagccggtgaagtggaggggtcaggaaagcgcagtgtccttgaagccaagtgaagaaaatgtttcaggaagaagggcatgatcaactgcatcaaatgttrataggtcatgatcaactgtatcaaatgttaatgggtcaaggaagataaaggctgacaactgattattggatttagcaatataaagatgattaatcttgac

SEQ ID NO: 25208 - DNA, 201 bp, Homo sapiens
aacatagcctcaacctcccaggctcaagcaatcctcccacctcagcgtcctgagcagctgggactacaggtgtgagccactacaccccactaattttttamtttttttgtagagataggatctcatttatgttgcccaggctagtctcacactcctgggctccactgattttccctcctcaccctcccaaagtgcatggta

SEQ ID NO: 25209 - DNA, 201 bp, Homo sapiens
gcagcttctacatcagcacttgctgccccatcttgcactcctgtgttatggagatggtttctttccttgaaccttacaaaccaacctctgctagcttcacrctttttttctgcagcttcctcacctctctcagccttcattgaattgaagagagttaggacgttgctctgaattaggctttggcttaagggaatgttgtgg

SEQ ID NO: 25210 - DNA, 201 bp, Homo sapiens
aaattctttgttcttttggaacctactctccagtaggagaagcagattataaagaaattaacaagtaaaacataacatatcaaatggtgatatgtgcaacrgagaaaaatatagtagggtgtaggataaaaactggaggtgggggcttgcacttttaataaagcaaagttgggaaagaattcattgaaaaagtgacatctg

SEQ ID NO: 25211 - DNA, 201 bp, Homo sapiens
caacagtgggcttaaaatagtcagcaaaccacactgtaaacagatctgctgtcatccaggctttgtgttccatttgtagagcacaggcagagtaatttagygtagttcttaagggccctaggatttaaaaaatggtaacccagcattggcttcagcttcaagtcatcagctccatgaggcactcacaagagagtcagcctg

SEQ ID NO: 25212 - DNA, 201 bp, Homo sapiens
gaccaggtgctttttaatgagctgtaatatttgtttgttttttgagtttgtttttaaactttttttaattaaaaaaaatagtttttgagacagggttgtgytctcttgcccagactagagtgcagtggtgtgatcacagctcactgcagccttcacctcctggactcaagccatcctcccacttcagcctcctgagtagct

SEQ ID NO: 25213 - DNA, 201 bp, Homo sapiens
ctagaccactcagattttctccatagcagcaataagactgttttgcttccttattatttgtgtgttcactgaaatagcacttctaattttcctcaggaactttttttttttttgcattctataaatgttcagagttctaaacctttaaaaggtttcaaatacatgtataaacacattctagaatgtcactctgactgttgc

SEQ ID NO: 25214 - DNA, 201 bp, Homo sapiens
catgcaccgccatgctcggctacttttaaaaagaattttcttttctagaggtggggtcttgctatgttgcccaagctagtcttgaactcctggcctcaaayggtcctcctaccttggcctcccaaagtgctggcattgtaggtatgagccaccatgcccagctgcgtggtaatgttttgaaaggaatctttttttctgagc

SEQ ID NO: 25215 - DNA, 201 bp, Homo sapiens
ctgattgtggatgatacatttccatctgacagtcggagctaaaactcccttttattccgtaggagggcagtggctcagagatgcccttcacctcccatgaycaatctgatctcggttgggggacaacatcaaggtaactttgcctctttgctttcttttttctgtattctaacccacatgaccacctgatttaaaaaaaaa

SEQ ID NO: 25216 - DNA, 201 bp, Homo sapiens
gcacccaaaccgggctcccatagatgtgcgttctttttcctgtttaggtcttcataaacaaatcagcagtgactgtttacccaaactgtcctgggcagacmctaggaaagagaagttctgttttttttgggaggcagggcctttgagattcagttccctttagggaggttgaaattcatttgcctttcttcccttaagttc

SEQ ID NO: 25217 - DNA, 201 bp, Homo sapiens
cttaaagcctaaaatattttgtatctggcctttacaaaaacgtttgctgacctctgtactcaagagtgaattgtttccgtgccttgcaagactgggagctytttggaaacagattatgtattcatccttgaatgtctagagctcagcacaggaatttttcacatttattgcttaataattttaggaagcagaaattctggg

SEQ ID NO: 25218 - DNA, 201 bp, Homo sapiens
aaaaaacaacaggatactgtttgaaggacacactagtggttgtagtgcttaaaggagtgggctctggggccaaactgcctgtgtctgaatcctggcttatmccttattgtctaaccttggacaaggtatttaacctcatttttacagttttctatctgtgatatagggcaaataatgaaatctactccacagggtggttgt

SEQ ID NO: 25219 - DNA, 201 bp, Homo sapiens
tcactggaaagagagaaggggaaggaaagagagagccgcgcacggcgttgaagttttacatgctgtccttgattaatccttacagtagtggcgtcaggatvgcagcatctctcacttggtcaggctaggtgagctgcggctggctatatgactggcgcatctacccttttatttattccttcacacattgaacagagattt

SEQ ID NO: 25220 - DNA, 201 bp, Homo sapiens
tctcgcgcccgcggtcatgtgacacagcgaagatggcgtcgcccggctgcctgtggctcttggctgtggctctcctgccatggacctgcgcttctcgggcrctgcagcatctggacccgccggcgccgctgccgttggtgatctggcatgggatgggtgagtgagtgagaaatttaaaagggtttggcgattctctctctt

SEQ ID NO: 25221 - DNA, 201 bp, Homo sapiens; identical to SEQ ID NO: 5581

SEQ ID NO: 25222 - DNA, 201 bp, Homo sapiens
cccaaactggtctcgaactcttggcctcaagcaatcctcctgcctcgtcttaccaaagcgctgggatgataggtatgagcccatgcttggcctatatggatttttttttttttttttttttgagatggagccttgttctgttgcccaggctggagtgcagtggcatgatcttggctcactgaaacctccacctttcaggtt

SEQ ID NO: 25223 - DNA, 201 bp, Homo sapiens; identical to SEQ ID NO: 5582

SEQ ID NO: 25224 - DNA, 201 bp, Homo sapiens
cttattacattcccaccagcaatgtccaaggggtcccatttttctacatcgttgacaatacttgttattttctattaaaaaattattattaaagacatccyagtctgtgtgaaatggtatctcatcgtggttttggtttgcatttcacatgcttttcacatgccagtggttagccatttgtatatcttctttggaaaaata

SEQ ID NO: 25225 - DNA, 201 bp, Homo sapiens
aaaactttcagattttgggtttcccattttcagattaggatgctcaacctatattcatttaacacagttattgagcacctactaggtgctgaggatacagkagggaactaaacagactaaattctttgttcttttggaacctactctccagtaggagaagcagattataaagaaattaacaagtaaaacataacatatcaa

SEQ ID NO: 25226 - DNA, 201 bp, Homo sapiens
agctcttccactctggctacggagcgtatgttgtagaaattttgatttctctccctgccaacctgggatagagtttgttcgaatttccccatgtgaggccktggggtaaccgtgcccattttgaggaggtgggggctggaagggaagaggaagtggagagagattggaaagaaagtataaagagtcccctttgctccagtt

SEQ ID NO: 25227 - DNA, 201 bp, Homo sapiens
ttcagaggtcatttgtctcctcttggcttggcttttcttttgcactgggtgcctcaacttgggtggtgaggtaaaaagggaagctagaatctgatttgagaaaaaaaaaaaaaaaaggcttcagaaattacagctaagaacttccttactgtgaaaactcaaaatgatgttggccacggcagaagcaccattctggcactg

SEQ ID NO: 25228 - DNA, 201 bp, Homo sapiens
ttacttccttcattgaagtcttgaatccctcagccattcatgagggttggaatcaacttcttttaaattcctgataatactgatattttgacctcttcccrtgaatcatgaatttttgtttgtttgtttttgagacagagtctcactctgtcacccaagttggagtgcagtggtgccattacagcttactgcaacatagcc

SEQ ID NO: 25229 - DNA, 201 bp, Homo sapiens
tggcttggcttttcttttgcactgggtgcctcaacttgggtggtgaggtaaaaagggaagctagaatctgatttgagaaaaaaaaaaaaaaaaggcttcaraaattacagctaagaacttccttactgtgaaaactcaaaatgatgttggccacggcagaagcaccattctggcactgtcgtaactgcttatcttcccaac

SEQ ID NO: 25230 - DNA, 201 bp, Homo sapiens
cgtttcatcagtgttcacagcatcttcaccaggagtagattccatctcaagaagccactgttttgctcatccgtaagaagcaattccttatctgttttttkagattgcaacaattcagtcacatcgtcaggttccacttctaattctagttctcctgctatttccacatctgcagttacttccttcattgaagtcttgaat

SEQ ID NO: 25231 - DNA, 201 bp, Homo sapiens
ttcctttaacttcagtctcatctgctcctgggagggagagctccatctctgacgtaactggctctgttgggctttagcgccagcctgctccactgagtggsgttttcaggaccactgcctctgggcagctcttccactctggctacggagcgtatgttgtagaaattttgatttctctccctgccaacctgggatagagtt

SEQ ID NO: 25232 - DNA, 201 bp, Homo sapiens; identical to SEQ ID NO: 5587

SEQ ID NO: 25233 - DNA, 201 bp, Homo sapiens; identical to SEQ ID NO: 5588

SEQ ID NO: 25234 - DNA, 201 bp, Homo sapiens
ggccctttcaatgggctgtttattagagaggagccttccgcacctgatccccggcgcgtgggagagcgctctgcgccgcgcccccagccctcgccctgcasctagcgcttttgtacaaggtggaaatttagcggtgggccagagatggaaggcaagaaaagaaaggcgagggaggggtggaagaccctgtccacttttgtt

SEQ ID NO: 25235 - DNA, 201 bp, Homo sapiens
gccctttcaatgggctgtttattagagaggagccttccgcacctgatccccggcgcgtgggagagcgctctgcgccgcgcccccagccctcgccctgcagstagcgcttttgtacaaggtggaaatttagcggtgggccagagatggaaggcaagaaaagaaaggcgagggaggggtggaagaccctgtccacttttgttg

SEQ ID NO: 25236 - DNA, 201 bp, Homo sapiens; identical to SEQ ID NO: 5589

SEQ ID NO: 25237 - DNA, 201 bp, Homo sapiens
ttctcagatgttcaaagtaccaaaggagctttctcttctcagttatgtctttactagacttttccagtatatgctggataagttatgactactcattatgyaatattttagatctggcatgatttagctaattgtgtggctcactgaatctgagtgaataatgccatttaacttctgttggcttattttttcatgaattta

SEQ ID NO: 25238 - DNA, 201 bp, Homo sapiens
tgcctgtcgagcctgggcagctccagcctcaggccaggacccgggagcccaactgcctcccccggggcggaggcgccgcgtcggcggtctggtcagaaccsgcatcaaccccccttcatcccccgaagctctcaagagcctccgagctacccagcctgtgcaggacctgcagctctcagccctccgttcctgcggcccctg

SEQ ID NO: 25239 - DNA, 201 bp, Homo sapiens; identical to SEQ ID NO: 5590

SEQ ID NO: 25240 - DNA, 201 bp, Homo sapiens; identical to SEQ ID NO: 5591

SEQ ID NO: 25241 - DNA, 201 bp, Homo sapiens
atgttccttctgcaggggaggatttaatttatgaaaatgatattgtttatgcatgaatgaactgcatgcactctgcataacacatagcacttccatctgaycagagaaataccacagaaccagtgccaatgtcagaaacatattctacaaatttactcacttaaatgtttaatgaatatttggaaggcattttcaaaccat

SEQ ID NO: 25242 - DNA, 201 bp, Homo sapiens; identical to SEQ ID NO: 5593

SEQ ID NO: 25243 - DNA, 201 bp, Homo sapiens
ctcagctagcggccccgcccgcgcttagcatcactaactgggctatataacctgagcgcccgcgcggccacgacacgaggaattcgcccacgcaggaggcrcggcgtccggaggccccagggttatgagactatcactgctcaggacctactaacaacaaaggtaattacagttctttcatttttttgccccagaatagaa

SEQ ID NO: 25244 - DNA, 201 bp, Homo sapiens
tttgggtttcttttgtggatagcataggagcttcttggattttttaaaagaatgcacggtaactatgattatctgctagtgctgattttaaagtcccaaargcaataatgacttcactttctcacttcttacagtaagaaaaaaaaatctatgttatcaatatatattttgtgtgcatgtattttacgcacattgggagtg

SEQ ID NO: 25245 - DNA, 201 bp, Homo sapiens
ccacaaattattttcagtccagcaagtgttataaacattaattctataaaaagaaaacaattgaaactaatttcttattatattgcatggcaccaaactcyccccacttcctttttgaggatcatgagttgtctgtcattgtttctttttattgatatcaattggttaaatataatctggaattggaataaaagaaaaact

SEQ ID NO: 25246 - DNA, 201 bp, Homo sapiens
taaagggaggtttgaggcgaactttgaaaagccccaataaagagcgggcggccctttcaatgggctgtttattagagaggagccttccgcacctgatcccyggcgcgtgggagagcgctctgcgccgcgcccccagccctcgccctgcagctagcgcttttgtacaaggtggaaatttagcggtgggccagagatggaagg

SEQ ID NO: 25247 - DNA, 201 bp, Homo sapiens
tgggtttcttttgtggatagcataggagcttcttggattttttaaaagaatgcacggtaactatgattatctgctagtgctgattttaaagtcccaaaagsaataatgacttcactttctcacttcttacagtaagaaaaaaaaatctatgttatcaatatatattttgtgtgcatgtattttacgcacattgggagtgtc

SEQ ID NO: 25248 - DNA, 201 bp, Homo sapiens
tacctgttaccgctccagaggcggccaagtccccagcagccactactggagccagaaattcagttgttttactaaaggctttttattttccttactagaarcggcaacttcgcggttgccaatcgctgaccattataattactcaatcttttaaagggaggtttgaggcgaactttgaaaagccccaataaagagcgggcg

SEQ ID NO: 25249 - DNA, 201 bp, Homo sapiens
ggaagtagaatgtgtgattttacagcttttttttttttttatggagttgtgagtaactttgaacacatttggataaacatgaagtcgctgaaatgtacagycatttccacacacattatcctgtcgggcaaccaccataaacacatttaagttaatcactaggatacaaacacatatgcgtgagtggtgtacacatataca

SEQ ID NO: 25250 - DNA, 201 bp, Homo sapiens; identical to SEQ ID NO: 5592

SEQ ID NO: 25251 - DNA, 201 bp, Homo sapiens
ctcaagtaccccctgcaggctttctaatttaaattttaaaaatttgggtttcttttgtggatagcataggagcttcttggattttttaaaagaatgcacgrtaactatgattatctgctagtgctgattttaaagtcccaaaagcaataatgacttcactttctcacttcttacagtaagaaaaaaaaatctatgttatca

SEQ ID NO: 25252 - DNA, 201 bp, Homo sapiens; identical to SEQ ID NO: 5595

SEQ ID NO: 25253 - DNA, 201 bp, Homo sapiens
gatggtgacttaatggaagttgcatcagaggtccatattaggtaagtctatttatttcaccgcttattgtcaaccagtaaacataaatctaatattacaaygaaagctctcttctctgaactatcaaagcaggcagttggttagtttttaaaaaatcagtaaatcagggaagcataaagagacatgcacaaatttcaataa

SEQ ID NO: 25254 - DNA, 201 bp, Homo sapiens
aatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaag

SEQ ID NO: 25255 - DNA, 201 bp, Homo sapiens
aagaactttggctctggcagaaaaatatcgatggatgtcccctaaccaacggagagattttgctgttgttaaggcactggcaaaacttaagtaagtctttytcttaaaccaaaaattgtatcccaggttcaatgactgttaataacaaatttcattacattttagggcagaagactgtgaaatatcatttttaccatttaa

SEQ ID NO: 25256 - DNA, 201 bp, Homo sapiens
tgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaat

SEQ ID NO: 25257 - DNA, 201 bp, Homo sapiens
gtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatc

SEQ ID NO: 25258 - DNA, 201 bp, Homo sapiens
gatttatctatcttgtccaatactttcagtaaacagtatacttgttataaggaacagtatgtcataatttttggtataatctcttagtaaatttcttgatrtctaatagaaatatttaatttcagattaaataatggaagtatggctcttataattgcccgaaacacttctcggccagaatttataaaacacctgaaaaga

SEQ ID NO: 25259 - DNA, 201 bp, Homo sapiens
taaggaacagtatgtcataatttttggtataatctcttagtaaatttcttgatgtctaatagaaatatttaatttcagattaaataatggaagtatggctsttataattgcccgaaacacttctcggccagaatttataaaacacctgaaaagatatgccagtgtaaaaaatcaggtatagtaaattctttttgttactta

SEQ ID NO: 25260 - DNA, 201 bp, Homo sapiens
tatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatct

SEQ ID NO: 25261 - DNA, 201 bp, Homo sapiens
gcatatcttgcttttgacacaagaaacagttgcctgtgtgtgattcactggccttaactctgatttatttatcaactttcaaaaattaaaatccatgctatttttttttttttgcaaagaattctaaaatattttgcatagtgtatatagtaagaaagattgattcccagggtgactgctttcaagcaatgttaatttgat

SEQ ID NO: 25262 - DNA, 201 bp, Homo sapiens
aaagcaatccagttgttgtaaaacaaggctcaagccacatactgatggctgtgaaccatatattcctatagagtttgcataaataaattcatgctttccarttaatttgaggagaataaaatattgccgagggactgttaatttctatgatatttcaggcaaagaaccaaagtgtaggtgccgttttcatgagaattttag

SEQ ID NO: 25263 - DNA, 201 bp, Homo sapiens
tgtggccaaacggatatcctaatagaaattgatgttactaacaattagcctctagggctttaaaagtcaagatgaaatatcaattcaaattctgtttttaratatcaattcaaattcttttttttacaatgtgtttattggacacacaaaaaaactttgcaaccatcataatacatcaatatttaacctagataattctga

SEQ ID NO: 25264 - DNA, 201 bp, Homo sapiens
gttaataacaaatttcattacattttagggcagaagactgtgaaatatcatttttaccatttaacagctctgatgatgtgcaagaaaggtaggtaaaaacycaatgtaatacagataacctgtatctttaaagcataaaacattctgacaaacaattgatcagacttaggatctttggttatttttctaacatagtagtaa

SEQ ID NO: 25265 - DNA, 201 bp, Homo sapiens
aatttataaaacacctgaaaagatatgccagtgtaaaaaatcaggtatagtaaattctttttgttacttatttgcaaagctattaatcatgtagaaaaagmtgctgcaagaattgacatcgaatcctgcctcataagaaggttttattttcttctgaatatattaatcttctttttcccaatctatttcatccaaattttg

SEQ ID NO: 25266 - DNA, 201 bp, Homo sapiens
ctgatttatttatcaactttcaaaaattaaaatccatgctatttttttttttttgcaaagaattctaaaatattttgcatagtgtatatagtaagaaagaytgattcccagggtgactgctttcaagcaatgttaatttgatttgttaattatccacacaggtgtgtttatttaggctctttccttcatggtgacattaaa

SEQ ID NO: 25267 - DNA, 201 bp, Homo sapiens
gaaaaatatcgatggatgtcccctaaccaacggagagattttgctgttgttaaggcactggcaaaacttaagtaagtctttttcttaaaccaaaaattgtwtcccaggttcaatgactgttaataacaaatttcattacattttagggcagaagactgtgaaatatcatttttaccatttaacagctctgatgatgtgcaa

SEQ ID NO: 25268 - DNA, 201 bp, Homo sapiens
atgttttaaaattgctttggcaggatctaccaatgtattggcacattctcttcatggagttcctcatgtgataactgcaacattgcacattataatgggtragaattcttccaaagcagttcatattttataaggaaatgttgatttatataaggaaggccatcttatttccatcagactttaagaaaaggcaggttcttt

SEQ ID NO: 25269 - DNA, 201 bp, Homo sapiens
ttcttgacattccttggcttacagctgcatccctccagtctctgactctgccatccttggcattcttctctcataaggacatcagtcatattggattaggkcccgccctaatgacttcatcttaagttgattctacctgcaaagaccctatttctaaacaggggacattcacaggtaccaggggttaggacttgaacatag

SEQ ID NO: 25270 - DNA, 201 bp, Homo sapiens
tagttcaattttccatttgttgagacttacactgttgaggaagtaaaagttcatccaaggaataatactggtggatataatccagaggaggaggaggatgraactgcttcagaaaattgtttcccttggaatgtagatggtgacttaatggaagttgcatcagaggtccatattaggtaagtctatttatttcaccgctta

SEQ ID NO: 25271 - DNA, 201 bp, Homo sapiens
attttagggcagaagactgtgaaatatcatttttaccatttaacagctctgatgatgtgcaagaaaggtaggtaaaaactcaatgtaatacagataacctrtatctttaaagcataaaacattctgacaaacaattgatcagacttaggatctttggttatttttctaacatagtagtaaagaatatagaatcacagactc

SEQ ID NO: 25272 - DNA, 201 bp, Homo sapiens; identical to SEQ ID NO: 5599

SEQ ID NO: 25273 - DNA, 201 bp, Homo sapiens; identical to SEQ ID NO: 5601

SEQ ID NO: 25274 - DNA, 201 bp, Homo sapiens; identical to SEQ ID NO: 5600

SEQ ID NO: 25275 - DNA, 201 bp, Homo sapiens; identical to SEQ ID NO: 5602

SEQ ID NO: 25276 - DNA, 201 bp, Homo sapiens; identical to SEQ ID NO: 5603

SEQ ID NO: 25277 - DNA, 201 bp, Homo sapiens; identical to SEQ ID NO: 5604

SEQ ID NO: 25278 - DNA, 201 bp, Homo sapiens; identical to SEQ ID NO: 5605

SEQ ID NO: 25279 - DNA, 201 bp, Homo sapiens
tctatctttagtagcaaagattctttttaatatattggctatatatgttgtgtgtgttatgtattgtgtgtatattttatgtgtgtattgaatatatataktgtgtgtgtatatatatatgtatattcctgtatattcaattttgaagccctctttttttgtgagagtgttttattcaagaaataaatgaacacattcttt

SEQ ID NO: 25280 - DNA, 201 bp, Homo sapiens
ctatttctcatctctctggagatgtacaaaaaaaggaatttctggccaggcgtggtggctcatgcctgtaatcccagcactttgagaggccgaggcgggcrgatcatgaggtcaggagttggagatcagcctggccaacatagagaaaccctgcctttactaaaaatacaaaaatcagctgggtgtggtggcgcgtgcctg

SEQ ID NO: 25281 - DNA, 201 bp, Homo sapiens
tgaataacatctatttctcatctctctggagatgtacaaaaaaaggaatttctggccaggcgtggtggctcatgcctgtaatcccagcactttgagaggcygaggcgggcagatcatgaggtcaggagttggagatcagcctggccaacatagagaaaccctgcctttactaaaaatacaaaaatcagctgggtgtggtgg

SEQ ID NO: 25282 - DNA, 201 bp, Homo sapiens
aaaacccagaatgttacaaaacagatgacccactttcatcaacaaatacatggcaaggagaaaaaggaggaggaactgttaaagattaaaagaaacattartcaaatataatgtatggattatggatgctgatttttgaaagctcactgtaaaagaacattgactatttgatgttagaaggagtgattgttaaattttaaa

SEQ ID NO: 25283 - DNA, 201 bp, Homo sapiens
gtgtggtggcgcgtgcctgtaatcccagctactcaggaggctgaggcaggagaatcacttgaatcccagaggcagaggttgcagtgagccaagattgcacyactgcactccagcctggtgacagagcaagactccatctcaaaaaaaaaatttctacaaatattttttgggttccttctacctacttcccttttctaaaat

SEQ ID NO: 25284 - DNA, 201 bp, Homo sapiens
gttcaagcaattctcctgcttcagcctcccgagtagctgggattacaggcgcgtgccaccacacccggctggctaatttttgtagttttagtagagacggrgtttcaccatgctggtcaggctggtcttgaactcttggcctcccaaagtactgggattacaggtgtgagccactgcgcacagccgagagggagtttatta

SEQ ID NO: 25285 - DNA, 201 bp, Homo sapiens
gtcaggatatgaaagatgggcagtttgtctctgtcatgtgggctttgtaagtaataagtactattattgtttcaattattctgtaatgaaaacactttccycttttggggttcttcctttctagactcccatagtgaccctctctggccacatggaggcagtttcctcagttctgtggtcagatgctgaagaaatctgcag

SEQ ID NO: 25286 - DNA, 201 bp, Homo sapiens
ctttgggaggccaaggtgggtggatcatgaagtcaagaatttgagaccagcctgggcaaaatagtaaaccccatctctactacaaatacaaaaattagccrggcatggtggcaggtgcctgtaaacccagctactcaggaggctgaagcaggagaattgcttgaacccgggaggcggaagttgtagtgagccgagctcgtg

SEQ ID NO: 25287 - DNA, 201 bp, Homo sapiens
cagaaggcagagtccaggcttagactgcagttcctcgcttacctgtgcagtctaattttgagctgcctctttgtagtcttaaaaggcaggagcttcgtgtwgtgggtctgctaacccgtacgtttccgtgggcaagtcgtgtgtactcctcgccatggctcagctccaaacacgcttctacactgataacaagaagtaagt

SEQ ID NO: 25288 - DNA, 201 bp, Homo sapiens
tgtattttcctcagagttccacaaacatgtggagtttgatttccttattaagggccagtttctgcgaatgcccttggacaaacacatggaaatggagaacrtctcatcagtaagttcaaattcttatcttctgtatttcacttgaggcattatcggctattgtaggtaaactccttttagaatcacactgaatctatcttt

SEQ ID NO: 25289 - DNA, 201 bp, Homo sapiens
ttcttattcttgtgttctcctttctccagatagtttgtcctgcttattattgagtgcttctatggatcagactattctcttatgggagtggaatgtagagmgaaacaaagtgaaagccctacactgctgtagaggtcatgctggaagtgtagattctatagctgttgatggctcaggaactaaagtaagtagctagaatat

SEQ ID NO: 25290 - DNA, 201 bp, Homo sapiens
gcagtggcatgatctcggctcactgcaacatccacttcccaggttcaagcgattctcctgcctcagcctctcgagtagctgggactacaggcacctaccaycacgcctggctaatttttgtatttttagtagagacggggtttcaccatcttggccaggctgatctcgaactcctgacatcatgatccacccgccttggcc

SEQ ID NO: 25291 - DNA, 201 bp, Homo sapiens
tataaagtgttgtaaaaaacaaccccttattaaaacaactgtgggccgagtgcagtggcccactgcaggagtgggcctggctggagtgcagtggcgtgatsgtagctcactgtagcctcaaactgctgggctcaagtgatccttctacttcagcctcccaaatagatatgactatagtcatgtgtcattaagcccagctaa

SEQ ID NO: 25292 - DNA, 201 bp, Homo sapiens
ctcaacctccagggctcacaaaatcctcacgcctcagcctcttgagtagctggaactacaggtgcatgccaccatgccctggctaattttttttttttttwaagagatggggtcttgttatattgcccaggctggtcttgaactcctgacctcaagcagtcctcccacctcggccttccaaagtgctgggattacgggcgt

SEQ ID NO: 25293 - DNA, 201 bp, Homo sapiens
catcacgcctggctaatttttgtatttttagtagagacggggtttcaccatcttggccaggctgatctcgaactcctgacatcatgatccacccgccttgscctcccaaagtgctgggattacaggcgtgagccactgcacccagcctgtttgtttgttttttgaggcagagtctcactctgtcgcccaggctagagtgta

SEQ ID NO: 25294 - DNA, 201 bp, Homo sapiens
tgttatgtattgtgtgtatattttatgtgtgtattgaatatatatagtgtgtgtgtatatatatatgtatattcctgtatattcaattttgaagccctctktttttgtgagagtgttttattcaagaaataaatgaacacattctttatatttgtggaagaactggcaagaaagggaatagcaaatatgtgtgtacaaata

SEQ ID NO: 25295 - DNA, 201 bp, Homo sapiens
agttttcagaaaaaaatttctgtttaatctgtttttaaggccatgtggaaatatggtggttgtagttaaggaataaagattttggtataaagttgtaatayagaggtaatcaagacattgattgttctacagagggctgagttatgcaggcataaaacaagcgttttagtgcttaggccccatttactagtgaagcacaaa

SEQ ID NO: 25296 - DNA, 201 bp, Homo sapiens
ctatctttagtagcaaagattctttttaatatattggctatatatgttgtgtgtgttatgtattgtgtgtatattttatgtgtgtattgaatatatatagwgtgtgtgtatatatatatgtatattcctgtatattcaattttgaagccctctttttttgtgagagtgttttattcaagaaataaatgaacacattcttta

SEQ ID NO: 25297 - DNA, 201 bp, Homo sapiens; identical to SEQ ID NO: 5614

SEQ ID NO: 25298 - DNA, 201 bp, Homo sapiens
tagtagcaaagattctttttaatatattggctatatatgttgtgtgtgttatgtattgtgtgtatattttatgtgtgtattgaatatatatagtgtgtgtrtatatatatatgtatattcctgtatattcaattttgaagccctctttttttgtgagagtgttttattcaagaaataaatgaacacattctttatatttgt

SEQ ID NO: 25299 - DNA, 201 bp, Homo sapiens; identical to SEQ ID NO: 20830

SEQ ID NO: 25300 - DNA, 201 bp, Homo sapiens; identical to SEQ ID NO: 5618

SEQ ID NO: 25301 - DNA, 201 bp, Homo sapiens; identical to SEQ ID NO: 5619

SEQ ID NO: 25302 - DNA, 201 bp, Homo sapiens; identical to SEQ ID NO: 5620

SEQ ID NO: 25303 - DNA, 201 bp, Homo sapiens; identical to SEQ ID NO: 5621

SEQ ID NO: 25304 - DNA, 201 bp, Homo sapiens
tcacatttcttagaaaacaaactaaaactaaatgaaacaagtctcttaatgctaaaatttcattattctgtccatttatttggaaatccttaagaatcaaytggtgaaaagtatttgtaacatcagtcaaaaactccatatccttaatatattaaaataccttaaaaattagaagagatcaataaactgacaggaacacta

SEQ ID NO: 25305 - DNA, 201 bp, Homo sapiens
tccctcacgcatcttacttactagtggggacagacagaaactaagtaagcaaataaagaaggtaatttcagatagtgataaatgccataaaagataaaatwgggtaatgcattagagtgttgatttgaggacagggggaagttacactagatacacccgttagggaagacttctccagaagagcagtcagcttggattgaa

SEQ ID NO: 25306 - DNA, 201 bp, Homo sapiens
agtgataaatgccataaaagataaaatagggtaatgcattagagtgttgatttgaggacagggggaagttacactagatacacccgttagggaagacttcyccagaagagcagtcagcttggattgaaggatgaaaagtaaaagctccattcagagctcttggggaagagcctcttaggcaaaaaacagctggtgcaacag

SEQ ID NO: 25307 - DNA, 201 bp, Homo sapiens
ctagtgctgtcagtggagcattgaagttccccactattattgtgttgctatctatctgttttcttaggtctagtggtaactgttttatgaatgtgggagckccagagttaggtgcacatatatttaggattataatgtcttcttgtgaccttttttgccccccctttttttcttactattattgctttagtctgttttatc

SEQ ID NO: 25308 - DNA, 201 bp, Homo sapiens
tcttgctgataagcaccatgatcagaggtctcttcactttggcttaaatcataaacatgtttggagcacctaccatgtatggccactctcctaagagtgargtaggatattgaggtactcccagtgtagtgtctggcttctggggactcagtgttaaatgagtgtggagaagatgtgtatatgaagactgtgtcttaaggg

SEQ ID NO: 25309 - DNA, 201 bp, Homo sapiens
taatcaaccttttgattttttttatctggtatttcaaagattacttcttggtttggattcattgctggagagctactgtgaccttttgggggttgttatakaaccctgtttcgtatttccagaatcattttctggtttcttctcttttggatagataattttttctaattattcttgaatttatttttgattctactgtgt

SEQ ID NO: 25310 - DNA, 201 bp, Homo sapiens
tgaatgaaaaaagtaacactcaaaatttacaagataatctagtctagtactttacattttaagaaatacatgaatggacctggaactaatgtgtgtgtgtktttttctttttaagtaagccatataacctatgaggcaagcaagttgttctaattgccttctggttgattacatactatttgttgagtactagctactggg

SEQ ID NO: 25311 - DNA, 201 bp, Homo sapiens
tgcatctgtgtttgcttttatcagataatcttctacctactttgagtttaccttctatttctaattccttgcttaacttctgggttccttgcacagcagcrtctgatatcctgcatgttagttctttgttttccctacccaactgaaaattactaatgcaaaattatattagcaaaatgggcataaccagaatcaccactg

SEQ ID NO: 25312 - DNA, 201 bp, Homo sapiens
agtttaactctttgaaatataacggaggaagggtcagaaataaagcaatctttctttcttctggacttatttattcactcttctttaaacagttgttaaawctctcttatgcatttgacattgggctttgcactagtgatagaaaaatgaataagactgtgacatcttttggtactacatcatataaattgtctagattgt

SEQ ID NO: 25313 - DNA, 201 bp, Homo sapiens
catgacctgcatagggctggagaagagtgcagttagcccttgagggttgggggtgaatgtgttaagggtattaagggtggggagatactgctaagttggaraaaaactttcagcgaatttcactgatttcaaatcaagctgaatttgaagttcttgtctacatgagtgaacaatttttaaaacatttgaaggcatgcattt

SEQ ID NO: 25314 - DNA, 201 bp, Homo sapiens
accttttgggggttgttatagaaccctgtttcgtatttccagaatcattttctggtttcttctcttttggatagataattttttctaattattcttgaatktatttttgattctactgtgttttcttttttttccctcttgatgatgcgactttagtatttacagtttattctagcctaatgaagctcttggtgctttcag

SEQ ID NO: 25315 - DNA, 201 bp, Homo sapiens
agaaagggctttgctttttaccagtaatttagaattttatgactaagacaaagcagaaaattgggaagaacagtgaaaagggcaagaagttaatggagtgyggtcagagctgagaggacaaaatctaaatgaaagggggaaaagcaataaggattgaggaaggttgtttaggtcattaagcttacaagatcttctatttcc

SEQ ID NO: 25316 - DNA, 201 bp, Homo sapiens
tggatatttttgtgtgggccattattctgcctaccacagcttctaaatttggagccatttaatgaaaagacaaggtaagccatatgtgtgtgtgtgtgtgratatatatatatatatatatacattgtttgttgggcctatacctatatttcatccaacacagtatagggtctcaaaataatttaagaacaatagaaactt

SEQ ID NO: 25317 - DNA, 201 bp, Homo sapiens
aaaatattatcaaaagtaaataggacaaggatttttttcttaaaaaattgggtctactggtttttaaaaattggattttatttaaaaaaattcactgacayaattttctaagaatatatcaattaagcaaattaaataaaatacagtaatggttgaaatggcctgaaggatctccctgacacaaggggatccttttataaa

SEQ ID NO: 25318 - DNA, 201 bp, Homo sapiens
gaaaagggcaagaagttaatggagtgtggtcagagctgagaggacaaaatctaaatgaaagggggaaaagcaataaggattgaggaaggttgtttaggtcrttaagcttacaagatcttctatttcccaattagtacattctgaccctgaagacgtttaagtacatgacgaggatgtcactggagtgtgacaaattcttca

SEQ ID NO: 25319 - DNA, 201 bp, Homo sapiens
tttctcacagaattagataaaaacaattctaaaattcatatggaaccagaaaggagcctgaataaacaaagcaatcttaagtaaaaagaatgaagctagargcatcacattatccaacttgtttatactataaggtagtggtacaaaaacagacacatacaccaatgaaacagaatagagatcccagaaataaagctgcac

SEQ ID NO: 25320 - DNA, 201 bp, Homo sapiens
ttggacaatgtgttagataaaataaaaaaaataatttgtgatcaaattttgggtgatcttaaggagctagtttaggaatatggagttactttgataggcaytggaaagccattgaagacttttgaccagggaatgatgtgattagggcttagaattgcagtgctgattctagatatattgtagagctacgacataaaggat

SEQ ID NO: 25321 - DNA, 201 bp, Homo sapiens
attcatatggaaccagaaaggagcctgaataaacaaagcaatcttaagtaaaaagaatgaagctagaggcatcacattatccaacttgtttatactataargtagtggtacaaaaacagacacatacaccaatgaaacagaatagagatcccagaaataaagctgcacaactacaaccatctgatctttgagaaagtcaac

SEQ ID NO: 25322 - DNA, 201 bp, Homo sapiens
ggactatttgaaaaataactggtccagagtttaaagggttttaaccatctacatctagaactctggctctttcaattaacttattaactgtatgactttgkacaactataaactctctgaacctcagttctcttatatcttaattagagatgatacctatctcacaggttgtaatgaagactaaagttggatatatgctag

SEQ ID NO: 25323 - DNA, 201 bp, Homo sapiens
gaagaaacatgaacatattcttccctatttttttgttccaatatggttaaacaaaactcccagataatatagaaaccttgcttattccccttatgaatatyttaccagtattgctaagaagtgaaattgattgatattaatttaacttcctcctcttcccacccagacattagtaaatagtgaaatggttgtaagtgttca

SEQ ID NO: 25324 - DNA, 201 bp, Homo sapiens
cggtgggtcacgcctgtaatcccagcactttgggaggcccaggcggacggatcacaaggtcaggagatcgagaccatcctggctaaaacggtgaaactccrtctctactaaaaatacaaaaaattagctgggcgtggtggcaggcgcatggagtcccagctactcgggaggctgaggcaggggaatggcatgaagctggga

SEQ ID NO: 25325 - DNA, 201 bp, Homo sapiens
gatcttcatctctacactttacttctttctgatttccattatctggttttcacttcattcatttcatttccaaacatgctttttctgtattttctatttargttagtggcatctcaatccaagggatagtagttaatttgatgtgtctgaaatacagggtacaaaacaggctcatagtcggggagattgcccttaactctc

SEQ ID NO: 25326 - DNA, 201 bp, Homo sapiens
aacatactataaatgttcatacctttgctcatatttgttttttaactgaaaattctcttcctaccatacctatgaaatttaatatctatgaaaattaattyagccttctaggctgatctgaaatatcatcttttctgttatctttttcttattctctccagagataatcctgcaatactttgttgtgattttattttactt

SEQ ID NO: 25327 - DNA, 201 bp, Homo sapiens
cgcttgagcccgggagttcaacactaacctgggcaacatggcaaaacctcaactgtacaaaaaatatgagaattagttgggtgtggtgtggcactcctgtrgtcccagctacttgagaggctgaggcggcaggattacctgagccctgtaagggtgaggctgcagtgagccaagatcgcaccagcactccagcctgagcta

SEQ ID NO: 25328 - DNA, 201 bp, Homo sapiens
actgaattctgtcattatttatagttttccagttgattctcttgtgctgtccaggtaaataatcatatagtttccaaataatgatattttagttttatctyttataattttacctgcattttactgtctagttatgttattcaggacctccaaaaaattaatggtggtcatagtagacactcttgtcttcaacttattgtt

SEQ ID NO: 25329 - DNA, 201 bp, Homo sapiens
tccataagggtctaagataagcatagatgcatattggcatcatctgcttggaaggggcctttaaaatgtcaccattcctcactatgctacaccaaggaagkggggataattatcattgcttgtggtaggtgaggcaggatggtcagagcacgtactttgaacctcatcattctgctaagtactactatacgttattttttt

SEQ ID NO: 25330 - DNA, 201 bp, Homo sapiens
tattaaactctccagctattattgtggtgcagtctaagtctccttgaagttctctaggaacttgctttatgaatctgggtactcctgtgttgggtgcatayatatttaggacagttagattttcttgttgtactgaacaatttactattatataatgcccttctgtgtctttttgtttatctttgttggtttaaagtctcc

SEQ ID NO: 25331 - DNA, 201 bp, Homo sapiens
gatgtgagcaaataaagtctgactctaattagacatacttaatctgctcgttgaaacttggagtcaaataagtcttagagtgacatttcagtcttagagtracatttcactgatttcttataagagctttgctaaaaaatatgcttatcaatttaatcaattataggattctagaaatcacaggaaaaacatcacaattaa

SEQ ID NO: 25332 - DNA, 201 bp, Homo sapiens
taaaaataagttatatctaatgttatacaataaactgcctagtttggataatttcattagcttaaactcttccctttgctcagtattaaagttcagaagtkgccacctaacctaacattcttacatatccccctcatggggacttttaacacagtgaattaagtgtcccctttattccatttttttataagaatgtatgag

SEQ ID NO: 25333 - DNA, 201 bp, Homo sapiens
tttatacttgagtccaaaatcctatggtgacctacaaggtctttgtgatctggctctatttatctactactccttccttctttattttgctatgctactckctcttcctgtgtgaggattttcacatactctcttacttttatctgcagtgcttgtttgcatgctctctctctttctctctctttctgtttctctctctct

SEQ ID NO: 25334 - DNA, 201 bp, Homo sapiens
tgtttctttgtgggggtattccttctagtgggtcataacatatgccataaaaatccacattgtggccacttccatagacccatctgcagacaggcctttaytcagatcttcttgtcccagatctttcaatctttcttctttcaggtgcctgcccaattagccagggtattcttcactgtttattaatccttatatcttcta

SEQ ID NO: 25335 - DNA, 201 bp, Homo sapiens
tatttcacctaaggaatttagtaaatttctcttattacctttttaatatctgctacatctgtagttgtgtccctttttgattcataatattatttgtgccstctttctgtatttctcattcacttttgccagaggtatgccaattttattagtttttgcaaagaaccaatatttggctctgttgtttccttctagtctatc

SEQ ID NO: 25336 - DNA, 201 bp, Homo sapiens
actgaattggaatctctggagtggcacttgtttatctgccttttgacaagctgaccaaatatgcacactaaagtttgagtacctctggatgatgtagattytaaggttccttccagctctatgatactttgaatgagaaagacaaagacagacagcaattacggatttcatttcaggtttctttactattctttaatgtca

SEQ ID NO: 25337 - DNA, 201 bp, Homo sapiens
cagagaggtgaactggtaaataccaaatgaaggaagaatactttttataattaaaattcataaaaaagtaatgaactatcatttgaaatggtaagcatccsatcactgggcatttctaaacagaggtaatgtggtcatgtgtcaggactgttatagtgagagttttactttgagtgggaagttgtactttagaacagacgc

SEQ ID NO: 25338 - DNA, 201 bp, Homo sapiens
aagcaagctaaagaaatatatctggaggatatggttcaaaagtaggcaatattaaactgtatatctgtacacgtataattgttatatatagtcatatacayatatgtggtaaagtatgaagtggtaaaactgtagaaaagcaaggagtaattaagaggcaagacaggctagtgggtacctctggagggaggaaaagatctg

SEQ ID NO: 25339 - DNA, 201 bp, Homo sapiens
aaatactggagccaagcaatgcaaaagctgagagactccatttaatagcatgttaatatattaaaacccttaataataaattcatagcacttaaaatacawatatttctacaatgtaatattattttacagatggtatttagtaaatagccagtatttactgggaagtggggaattcattgtcctttgtgccttgctttgt

SEQ ID NO: 25340 - DNA, 201 bp, Homo sapiens
gcagtggctcacgcctgtaatcccagcactttgggaggctgaggcgggtggatcacctgaggttgggagttcgagaccagcctggccaacatgttgaaacsctgtctctactaaaaatacaaaaattagccaggcatggtggtgcacacctgtaattccagctactctggaggccaaggcaggagaatcgcttgaacccag

SEQ ID NO: 25341 - DNA, 201 bp, Homo sapiens
atattttctatcttttttaactgtttgctacctctttctgttagaaaagtgaagaaaaataccaaagaaatatttttgtaagaataacttaaaattaagastattccacatatcaatttaaaaacaaaatttcaacagattgctacagattgcttttatatggtttaaataataaattactttgattccatttatggagca

SEQ ID NO: 25342 - DNA, 201 bp, Homo sapiens
ctatgttgaacaggagtggtgagagagggcatccttgtcttgtaccagttttcaaggggaatgctttcagcttttgcccactcagtgtgatattgcctgtrggtttgtcatatatggctctgattatatcatgatatgaggttacatcccttccttggtatgagtttgtgccccttcctgtgtctgagtgttgacgatata

SEQ ID NO: 25343 - DNA, 201 bp, Homo sapiens
gctttagtaagtatcactctatttctaggtctgtttcaaagctgtcaccctgatatttctctttattccacttctagattagtttcactatttcttagatyctgtgtactcccttttaagaacatttctttttcctccccttcaggacatttattcaagtgattttttttccataaagggtgcatgggaggtaaacttcct

SEQ ID NO: 25344 - DNA, 201 bp, Homo sapiens
cttttttatctagtcatgatattagagtatgtgtggactttgacagtgacacctaaatggtttttacttgcctcattgtttccttactaactgtatgaaaraagaacacgtgttgagcccctccaatctaaaaatacaaactctggaatgctccaaaatttgaaactttttgagtaccaacatgactccacaagtggaaaa

SEQ ID NO: 25345 - DNA, 201 bp, Homo sapiens
ttcctaggggaaatacagagctagattcctgcaagcctctggtcacatttttctcaactggtcaatgaataattttattttatgtgttctgtttaaagacrccttactgagtatatattatcgattcattaactttgaactcattgccaagagctctagaactcatatctgaacaaagcttatcgcacacacatgttttct

SEQ ID NO: 25346 - DNA, 201 bp, Homo sapiens
gtgctttcaaaaaagtcttttggtctatttccactttcaaggtaacctggtggcttcttctctcaagtcctcacacaggtattcaggaataccaggatggygtgcccaagattccaacagcctgtattacggtggaagatgcagaaatgatgtcaagaatggcttctcatgggatcaaaattgtcattcagctaaagatgg

SEQ ID NO: 25347 - DNA, 201 bp, Homo sapiens
aaacaacttatgctcttaaagaaatttttattcatgtgtacgccagacatctaaagtgtcaaatgttattatcagccactggggaaaatgaacaagcaaayaaaactgaagcaaatgtaaccacaccagctaaagaatatgcaaggaaaatatgatgaaatgcaaagaaaaatcagcagcacctcctacttcctttccctt

SEQ ID NO: 25348 - DNA, 201 bp, Homo sapiens
ttttcattaagcatgacatgctggcttttgagatgcaacagagatattttgtcatattaagagaggaaacccttttttcttagtatagtacatgataaggrtttttgtcaaaaataacgttgaattttatcaaaagccttttcataatttattgagatggtattttagttttctctttttattattaacatggtaaattat

SEQ ID NO: 25349 - DNA, 201 bp, Homo sapiens
aacccaaatccaagaggtaaccagattttctttaggaatataagtttttccaaggcaatatccatgtgtgagacatctttggaagaataaatgtacagaarttggttgtattagtttcctagggctgctttaacaatttaccataaaaccagtggcttaaaagaacagatatttattctttcacagttctgaaaagctgaa

SEQ ID NO: 25350 - DNA, 201 bp, Homo sapiens
tcaagtagacaaagtcaaatggtaatacacaagatttgaataatataactaatgaggttgaataatataatttatgagtgaatagggatatggaacatttmatagtatattttattattaatcaaaaaattatgttatgtatgaatatatatgtacatgatatatattgggatatatatggggtatatgtatgtatatatg

SEQ ID NO: 25351 - DNA, 201 bp, Homo sapiens
tatggaaattatagctgttaagacctgttccacaaacacaggttatacatattatcacatctctttaatcttctttacagttaatcacccaagtctccacrgggcttattagcaggaaggctattatctcctcttgagatccctcccactgcccctgaattgtccatgaatcctgactttactcaggccaaatgggtcagt

SEQ ID NO: 25352 - DNA, 201 bp, Homo sapiens
ctttttcctgcagatgtgacatttgactatgaatattgaagttaaacttcaattcattgtattgtaaatggaaaagaagagtttttcattttaggtatatrtacataatacatatattcttttccttggctctcatcatgtttatattagatacaaaactagttaacatgtctagtctggcatttttcctccaagatatat

SEQ ID NO: 25353 - DNA, 201 bp, Homo sapiens
aacccttcttcgaagtgtgatttcctggctaatggatgcttctgggatgattattatatatatttttgtactcaattaagccctattcagaccaacttatkttttggtgaacttaaggaccttatgattagcatccattagcatttccattacatctatattgtaataataccatctaaaatttctatgctgtatctctca

SEQ ID NO: 25354 - DNA, 201 bp, Homo sapiens
tgtcctcagctagtatggcaagggcatgctccctatcactgctagtaatagcaaatgatcactaccactgagtatttgcatcatgccagctactatattargctctctgtatatattttctcatttaatactcctcataaccctgcaaagtaggaattgttattattccccccgttacatagaggggaactgcaatttaga

SEQ ID NO: 25355 - DNA, 201 bp, Homo sapiens
ggaactcataagagaacccaaagagaagaaaaactgtggcaagttttaggctacattgcctagcttatatcacaatgccagcagccttcaactgcaatacrtaggaactgggacttaaaaaccagcagaaacacattggtaaacatcataatgacacgcatatttaggaaaatgatgtttttaatttcaaaatctatgcag

SEQ ID NO: 25356 - DNA, 201 bp, Homo sapiens
atgctattataccatcacgtgctgctgtggctttataggaagtatatcctggatggttattacatatttagctggaatttagtttcctagggaaataaaagtttcatattttaagaatagacaattattttgaacaagtggtttatgtccacagaaagttcatgttcttatcttttatgtttgaatgaaggcactgtgtat

SEQ ID NO: 25357 - DNA, 201 bp, Homo sapiens
atgtttgaatgaaggcactgtgtatgaggtgtccctgaacattggaagtctaaagagcatggatttggatgtcaaaactgggtccagattgaagttatgayatggaccacctgtgagagccttaatttcttcctgtgtgaatgtaaataatacctacctcatgggattaaaagagaaaataatataagaaagcatatatca

SEQ ID NO: 25358 - DNA, 201 bp, Homo sapiens
aggcttcccaaaaggtaagagttacctcctcaaagaagcgggggaaattgtctcttactactctatgacaatgagcaaatcactcaaattctctgactctstcttttggaagaaataacatttactggttgcttttgaggattgaatcagatgagatatagaaaagcccttagcccagtgcttgctaggggaaagatcaat

SEQ ID NO: 25359 - DNA, 201 bp, Homo sapiens
accaagagctgtcttacatcctctttggatttccgcatagattttgcaagccgtaaatacaaaatttgtctagagttcatagttggttctgtttactggatttttttttttttttttttttttgagacagggtctggctctgttgcccatggtggaatgcagtggtgcaatattgactctgtgcagccttcgcctcctggg

SEQ ID NO: 25360 - DNA, 201 bp, Homo sapiens
aaagatcttggtaaatatttagaaaattgttaactaatgtgtgaggatctcagtgacatgtttaactcaaaacacaaaatacttaacagattagttactayggtatgttcaaagatcctcttgaggtcagttgattcccagaaaagaaacaacttatgctcttaaagaaatttttattcatgtgtacgccagacatctaaa

SEQ ID NO: 25361 - DNA, 201 bp, Homo sapiens
aggctttgttgttttatacactcaggcaacttgaaaaggataaaagaaaggtggagaaaagaatagtaaagtgagctcaattaattttctaagaaggcaawctaaaaacttctcacatgtaaacagtaagatgtcagggacacaaaatgagttagcccgtgttgctgggatgaggagggatagcagagaaatggccatatg

SEQ ID NO: 25362 - DNA, 201 bp, Homo sapiens
gaggcctcctctggctggaaggttggctggaagagcgggaagaaaattgttgaattcacttaaatacatactttcccatcctattagacacaattcctctyttttaaaaacaaataatttgtaatgccttctttattatcctgaaataaacatcatagacaatctgcttgtgtacatttttaaataaatatattatcctaa

SEQ ID NO: 25363 - DNA, 201 bp, Homo sapiens
cattttcgaatgataatttttaggagaaatatttagaaacagaatcaaagggctttgttttgtttcctcgaaatataaacctattattagaatataattcmcagtatgagaaatgtaggttttgcttgagtttgcttccagatttaagtagaaaagaaagaaaatgacattataaagaattttatctctttttttgtgaaa

SEQ ID NO: 25364 - DNA, 201 bp, Homo sapiens
cagggtgccatggatgatggcggtggagcctttatatcatgggaagcactctcacttattaaagatcttggtaaatatttagaaaattgttaactaatgtrtgaggatctcagtgacatgtttaactcaaaacacaaaatacttaacagattagttactatggtatgttcaaagatcctcttgaggtcagttgattcccag

SEQ ID NO: 25365 - DNA, 201 bp, Homo sapiens
tcaatatcactcaggtcctgagccatggagaagggacagacatcaacttttggatccaagctggagtgcctggtaagaccaaaagatgaagttgtgttccytatatattgccaacaatttaaaataaaatttctgttttaatagagcacaatgaatactagtaggccaggttgtccacggaaaccttaagcttttgttcaa

SEQ ID NO: 25366 - DNA, 201 bp, Homo sapiens
tctttgtgcagagacattgtcccaactccttcaccatgtgctaacaattagataatgactccataaatgtagagaaaaagcagtgtcatggacggtgggtrgtttgttttcttagttctttattgaaaacatatggagatgtttatatataaatagaaaacaataaaacgctgccatcatgtaagcagcaacttaaaaagt

SEQ ID NO: 25367 - DNA, 201 bp, Homo sapiens
tggctcctgggaaacagatgagctggccagtttgaaggatcttaaagttgcaagttttcgggctgggtagcaatttaactgtgcaacctgtcaagagcctrttatattctaaatttgtgccgtgacaatattggctacatgaaataactgtgtgctttcttaccagactttatttggaaagagtttatgaactagtggcct

SEQ ID NO: 25368 - DNA, 201 bp, Homo sapiens
gagttatcctgtaaaataacccaaagacaaagacatggcttttttaatgtatatgtgtttttagaaataaatcattgaaaagctcagtaatccctttggaraacagctttagcattgatgctgtcaagacccttgtcaaaagaataaaccaaacctgattggcctggtggataaactcattccatacataactgaatagtt

SEQ ID NO: 25369 - DNA, 201 bp, Homo sapiens
ttatagtttcaggtttatctgctgcctgggaatcaaaacacaggtcttgattaactttctataaagcaaggatatggactagggatcactaagctctcttwtatctctacaatggtgtcattatatgattctaatccatcactagaaatgtattgtgaaatagttaattaatgtttgcagaatgcttagagaacttttaat

SEQ ID NO: 25370 - DNA, 201 bp, Homo sapiens
ccacatcttttgtttgcactcctaagcacacatttttattctttacatggccaggctgtgaattttcataatttttatgttctatttccccttaaattatraatactgtctttaaattatttctttcccctcacattctattatatacatttaaaagaagccacacagctccttcagtattttgcttagaaatttcttcca

SEQ ID NO: 25371 - DNA, 201 bp, Homo sapiens
ttccatcagatattctagtttatcactcttaaattctgccttctgttaaagccctcaggcatggacacactttagccaagttttttgccacttaataacamggatagcctttactacagtttccaatacgttgttcttcatttccatctgagacctcatcagaattgcctgtactgtccatatttctgtcagcattctggt

SEQ ID NO: 25372 - DNA, 201 bp, Homo sapiens
gtgatagtggcacctcccagtgtcacccagaatgatatccctagtggatgataagaagggaggaggtagttctcagccttgttggcttgcagcttccagtrtgggaccacctcctatgagtgagctgagaaaggggtgatcagagtcttagtattcttgatggctacttagggtagagtttccaccctatgagtaggactt

SEQ ID NO: 25373 - DNA, 201 bp, Homo sapiens
tcattatgtcccttaatcaacaatatgatatggacttttttgcataaataaacaagaacagattgccattggttatatagtacaagtaacactaccaatarcattgtggtcctctgtggttataggattagaatgaatttaataggacaaaaaggaatatagagcataatcatgaaaggaggtatctccaagggcattctg

SEQ ID NO: 25374 - DNA, 201 bp, Homo sapiens
cttagaaaaacattaagatttttcttctttagtagtagatggcttaaaggttttaggtctgctattggtaaatgcattggatgttcaaagcttgattgacwaagtgggtaataaataaaccactgggaccagatgacatcaacccagtatttttgaagaaagtagaaggtaatattgtcaaaacttggttcaattattttt

SEQ ID NO: 25375 - DNA, 201 bp, Homo sapiens
atgtcagtcttactatgattcaaaggacattaaagcaaatggggtgtttagtgacaaaagtatttacaaaaagcttttttttttttaagttcacactgccrtattgtactctcctcaaccttacttttaagtacattttctatacttaatttgggagaaattaccataaaacatttagtgctttgttttctgatatggttt

SEQ ID NO: 25376 - DNA, 201 bp, Homo sapiens
aggcaggggctccagaagttctaggtaggagtcctttgttcttatgtttttcaagggtctcatggtgaccaacattgttaacttcttttagcctctgtttcctcaccctcaaatgaggtcaatagtatctactttcagaagtgatattcaaaatatctgatatgggagtgggacttggctgttatcagacagatggcatat

SEQ ID NO: 25377 - DNA, 201 bp, Homo sapiens
cccagtaaaccaattgtaatgtcaaaaaattatgagttgaaccatcataagtgcagatgctccttgacttacaatggggttatatcctgataagtccgttrtaaagttgtatagttgtaagttgaaccatcataaattggggaccgtctatatttgtaatccttgtgttctagcattggtgtctgcacatttgaagagaca

SEQ ID NO: 25378 - DNA, 201 bp, Homo sapiens
tggtctattctgctattgatacttgtgattgcattgtgaagctcttgtgttgtgtttttcagctccatcaggtcagttatattcctttctcacctattctkgttatctggctatcagctccagtattgttttattatgtttcttagcttctttgcattgggttacaacatgcttctttagctcaggaaagttcgttgttac

SEQ ID NO: 25379 - DNA, 201 bp, Homo sapiens
ttcaatgtcacctctaggagctgcagccagacattcctatgatgtacttatagctaatctagttgagctccatttgagaggattctagatatattacttastagagatctggctttctagaaggctcccactggatccaggtaatgtccagtggcttgaacgatagaaagctggagtcagcagctggccttccagacccat

SEQ ID NO: 25380 - DNA, 201 bp, Homo sapiens
agttcacttcagttcttaagataaagtaggttctactgagtatttgctaaatgaatgaacaaatcaatactctaaaatgttttcagctttttactcattgyagtgtaggaagagctacatggagttgaatttctatcaactagcccatcttttattactggagttagtcttctttggtaatttaatactcagagtacctca

SEQ ID NO: 25381 - DNA, 201 bp, Homo sapiens
caaatgggcctttcaattctttccaactctaaaataaatgtaattctagtagaaatccatatacaaatcatggttcataaaactgaaggttaacattgctrccatatggagaagttagctcacatacaaaaagagaaaaccatcagttctccaaatatttctttttaccaaatttgactttaacagcaaactggattgtgt

SEQ ID NO: 25382 - DNA, 201 bp, Homo sapiens
ggtagagtggataaagaaaatacattcattacctgggtgacaaaataatttataaaccaaaccccaatgacacacaatttacccatgtaacaaacctgcayatataccccctaaaccaaaaataaaagttggatagaaaaaagaaagaggtgtgagaaaagaccccactgtgacacataagtggcatagataacagtggag

SEQ ID NO: 25383 - DNA, 201 bp, Homo sapiens
taagaaaagacagataagatccatgctctcacagacaacacagactagtaatgagacctggttatttcatctgcaaaataagtctggtaacctatgagtcrttatttctaccaggcctccacttgtgttctcctcctcctctgtcccctatctcattagcaggcactataattcagaaacctcaaaagcacccaggacata

SEQ ID NO: 25384 - DNA, 201 bp, Homo sapiens
caacagcaacaaaaccaaattaggataattgaggtttagtttaataaagggactatttatatgatgtagagagggtatagggaaagcacaggggatcatgwttatcaaccctaaatctgaaggggcacagagaggaagtggtcatggaaacctggacacagaaagggtgctgcagaaaggaccctctaatgggcactgaga

SEQ ID NO: 25385 - DNA, 201 bp, Homo sapiens
cacctagtctctccactctccatgatctatgcacaataatcaccccttaaggtgaatttaagatcacagaagtgtgccttatcccctctggtccagtttayttgagacgctcaaactcacaggcaaatgaggagttgaatcacttcataccaagctcccagcaatctgcattattgaatacctgaagtgttctgtcctccc

SEQ ID NO: 25386 - DNA, 201 bp, Homo sapiens
atattcacaggattacagtgtctgcattccttagacgctcctatcatgctgtgctagtcgggcactgtgctaggcacagggaatgttgagataaaaggaasttggtttgttgtttaaactacccagattgtgcattgttaaaaattattatttttttggaactcttaaaattttgttttgcccaaaaaattacatgacact

SEQ ID NO: 25387 - DNA, 201 bp, Homo sapiens
taattcaaaacctcttaaaatgctgttcccaagtgtgctgggactttctggtcatgtctctgcgaaatggatattttggatcttgctttagcatacacagraaaccaatctccaggcagttcttccttataatttctttacaagtttccccttaaagaattcctaatgtactttcctcaatagtaacatagatttttctag

SEQ ID NO: 25388 - DNA, 201 bp, Homo sapiens
gaaaacagtatggagattcctcaaagaactaaaagtatatctaccattctatccagcaatcccactactaggtatctgcccaaaggaaaagaagtcattayatcaaaaagacacctgcacatgtacatttatcacagcatggttcacaattgcaaagatatggaataaacctaactgtccatcaatagataagtggataaa

SEQ ID NO: 25389 - DNA, 201 bp, Homo sapiens
agaggagtcaagcataaactgacagtttggggcccaaacaactgaaatgaggggagttaggcagggggaaaagggggagataaggagtatgggtttgaacmtgttaagtttgagatatcagactttcatgtggagaggtcaagtaggcagtttggtaaaaagtatagagttcaatgaattgacatttctcaaaagaagata

SEQ ID NO: 25390 - DNA, 201 bp, Homo sapiens
tcacaataaaagatcaataaatctcaggctttaaatcttagtctctctatcttttagcacattctctttccactgtgttcttttccacttctgtttgtctrttcgctctggcatttttatcatagcctgagacattttcgaatgataatttttaggagaaatatttagaaacagaatcaaagggctttgttttgtttcctc

SEQ ID NO: 25391 - DNA, 201 bp, Homo sapiens
cactcttctcaacttcagtattacagtaggtatgttagtttattcacatggcaggattgagagctctgcaagttatctgtggagagtttgaagaaggcagrtatacaagcaggccaagtccgaagagatgaaggacaaacttacaagacaggagaaagcacaatctccaatcagtcctgagataacatagcatacatcaga

SEQ ID NO: 25392 - DNA, 201 bp, Homo sapiens
tcaaactgttttgtcatttgaattaggaaaggtcaaagggaaaggaacataatagtagacagacagaaaagtgctttgtgaaaattacccattttttccamgtaaggaaaagtaatttgttttttttcagtgctagagatttttgttttgatagatttacagagagaaaagaaaccaccaagaattttgaaaggtcccatt

SEQ ID NO: 25393 - DNA, 201 bp, Homo sapiens
taagggttcttatgtttaaatctttaatctgtctcagatttattttggtgtaaggtgtgttatatatatctagcttaatttttcttcaattagttatcaakatttttttgtttttatatcactttttgaagttcattttttccgatgggattcaaatatacttatcacattaaaattttctaactatatttgtgtctattt

SEQ ID NO: 25394 - DNA, 201 bp, Homo sapiens; identical to SEQ ID NO: 5636

SEQ ID NO: 25395 - DNA, 201 bp, Homo sapiens
atgaggtcatgtgtcatacaggcatggaatgttacaaagctgatatttatggggcactgaccatacaccaggcactgttatatttaacctttttacttatrttgccccatttaatcatcactatatatctaagagctagatactatggtaagtcctatttgatcttcttaactagaaacagtacatggaaaatgggagagt

SEQ ID NO: 25396 - DNA, 201 bp, Homo sapiens
acttaacataatggtcttcaattccatctatgttgctgcaaatgacaggatttcattcatttttatggctgaatgatatttcattgtgtatatatatggcrttttctttcttcattcatctgttgatgggtacttagcttgattccgtattttcactattgttagcagtgctgaaataaacacgggagtgcagatatctct

SEQ ID NO: 25397 - DNA, 201 bp, Homo sapiens
gagacgggactttgccatgtgggccaggttgatctcgaccttctggcttcaagctatctgcctgccttggcctcccaaagtgttgggattacaggcatgarccactgtgcctggctcttttcagcatttttaagctgaattttaaacagaggaatgatatgattggattttccttagaaaatagctacagtaataatgttt

SEQ ID NO: 25398 - DNA, 201 bp, Homo sapiens
ataactaatatattatgtattttcattggaggaagaactgcgttcatgtctgcatttcatcaaagattcctaatgacttcagagggagccagcctgttttmcatgttgctagagaagtggagtaaaaagagagtgggtgacatgatgggggccatctatggtatagtgaagagttagggaattagaggaacttggatacag

SEQ ID NO: 25399 - DNA, 201 bp, Homo sapiens
ttatttctctaatttatcatattgtttagtacatatttcttgagagcttcctagttgctcagaaatttccgagtactaggattactaaggtgaattccatrtgttttttgtcctcaagaaatatttttatgtagccaaaagagaagggggtaagaacatgtaagtgattagtgttatttattttatatttagtgctaagtg

SEQ ID NO: 25400 - DNA, 201 bp, Homo sapiens
cagatatgaaatacagagaagaaatttgagctggcgcttccaaataactgtacttctttaatggtaagatatcccaagctttgatttctcatcttattcastttgtcaggaagagacaaacaggtgtgggtgctgggcagagggcttgatctcattttgcagagaaagtgtttggagactttgaactaagcaaagagtaac

SEQ ID NO: 25401 - DNA, 201 bp, Homo sapiens
atgtctccttttttgcattaataagttcttttttattttactgtaaattggcaaattatggttgtatatatttatgaaatacaaagtaatgttgatatatrtcataatacaaccttccatacaatgtggaatgattaaatcaagctaataaacatacccatcaccttaaatacttatcatttttgtggtgaaaatatttga

SEQ ID NO: 25402 - DNA, 201 bp, Homo sapiens
tgcttatcaatttaatcaattataggattctagaaatcacaggaaaaacatcacaattaaagagattttggtaaaactgagttaaaattgggtaggacttkttactataaaaataagttatatctaatgttatacaataaactgcctagtttggataatttcattagcttaaactcttccctttgctcagtattaaagttc

SEQ ID NO: 25403 - DNA, 201 bp, Homo sapiens
attataggtgataagagtcggtggaggattatatgagtgaatgtataaaagcacctggccaaaggcacagaatagcacttggactgactctcacaggcgayatcaagttctagtttgtctgctatggactgactgggtattcttcactgtaaaggagcctcatccctaatggtgatgtgaagatagtatgtatcccaaaat

SEQ ID NO: 25404 - DNA, 201 bp, Homo sapiens
agaatgtgtttatgtgccttgtaaaggagctagtcattcccttttgctttcctttattatgatgtgtgtatactctgtgtgtgtgtgtgtgtgtgtgtgtstctctgtgtgtatgtacaccaaagaagaaccacaccaggaattgagcataaaggctttctcttacccatctacacacctttcttgtaagttgctgctttt

SEQ ID NO: 25405 - DNA, 201 bp, Homo sapiens
agttgagtgattgttttgcaacagagactgtatggcccactaaacctaaaatatttagtctctgaccctgaaatgtaagattgatagcccaggaccaggcrtggtggctcacacttgtaatcctagcactttggcaggccaaggagggtggatcacctgaggtcaggagttaaagaccagcctggccaacatggtgaaacc

SEQ ID NO: 25406 - DNA, 201 bp, Homo sapiens
agaatcagataattgtctctctgtgcaatgtccaacaccagctttctatgtaataaaaataaactgaaaacaaacaggaggcaaaaataaagcttcatggrcttcttaaactgtttgtgaaagttgttgttctagagatcataaggtagggagttaataaatactttgttccttgacagggctaccccattgtaccactcc

SEQ ID NO: 25407 - DNA, 201 bp, Homo sapiens
ctctataaaatgattcttcattttacaagcttattcactgccgcattcctttactgatctattcctttactgatctattcctttactgatccctctatacmcaactccagatttatggcacagataaattagtgggcaatcatttgctctataaaatgattcttcattttacaagtttattcactgccacattcctttact

SEQ ID NO: 25408 - DNA, 201 bp, Homo sapiens
cagaacattctacccaagaactgcagaatatacatattctattcatcagcacatggaactttctccaagatagaccatatgataggccacaaaacgagtcytgataaattcaagaaaattgaaattatatcaagtactctctcagaccacagtggaataaaactggaaatcaactccagaaggaaccttcaaaaccaggca

SEQ ID NO: 25409 - DNA, 201 bp, Homo sapiens
cacctaacacttaagtgctcacataaacttaaggtaaacggatagaaaaagagattccatgcaaatggacatgaaagtgagcaggagtagctattcttttwtcagacaaaacaaactttaaggctctagcagttaaaaaagacagagggtcattatataatgataaaaggccttgtccaacaggaaaatatcacaattcta

SEQ ID NO: 25410 - DNA, 201 bp, Homo sapiens
cagcctgttttccatgttgctagagaagtggagtaaaaagagagtgggtgacatgatgggggccatctatggtatagtgaagagttagggaattagaggamcttggatacagacttggctctgctcccaaacaactaggtggtcttaggaatgtttcttaaacttctctaggcctcataattttcttctgttaaccagggg

SEQ ID NO: 25411 - DNA, 201 bp, Homo sapiens
agcaattttgaaatatacaacacagtataattaactatagtcatcatgctgacaatataatctcaaaaaatttattcctcttgtttaattgaaactttgamccctttggcattccccattttccccaacccctcagactttggtaagcaccattctactctacgcttcttagttctgttgtttagattccacgtagaagtg

SEQ ID NO: 25412 - DNA, 201 bp, Homo sapiens
tatattgtgaatcttaactgggggcttctcccaacctgttgtgtccggaattggtgggttcttggtctcactgacttcaagaatgaagccgcggaccctcrcagtgagtgttacagctcttaaggtggtgtgtctggagttttttccttctgatgttcggagtttcttccttctggtgggttcgtggtctcactggctcag

SEQ ID NO: 25413 - DNA, 201 bp, Homo sapiens
gcttattgcatttagcataatgtcctgcagcttcatccatgttgtcacaaatgacagaatttcctcatttttaaaggcagaatagtatttcattgtgcatrtgtgccacctattctttagccatttatctgttgatggacacttcggttgattctataatttggctattgtgaatagtgctgcagtgaacatgggattgca

SEQ ID NO: 25414 - DNA, 201 bp, Homo sapiens
tggccagggcaacgggctttttaaaagactttccaagtaattctaatgagtatctaagtttgaggaccactgatctagatcaattaaccatacatacatayatatatatatatatatatatatgcatttttttttaaaaagatacatttaacacctccccccacccaataaaccttatggaaacccaatgcataaaaaaga

SEQ ID NO: 25415 - DNA, 201 bp, Homo sapiens
gtggaagagtgaagcagaagaagtcagagagttaggaagatgtgattatggaagaatgttcaaagagagacagtgccactggctttgaagatggaggaagrgggccatgagccaaggaatgtgggtggccacgagccaaggaatgtgggtggccactagaaactgaggaaagcaaggaaatagattctctcctaaagcttc

SEQ ID NO: 25416 - DNA, 201 bp, Homo sapiens
ctaaatctggagccttgcaggttccctgacttcagacttactcactgcttgtgattctaatgcgtttctagtccacagagatgtttatctggttcttggaracaaactataaacatttttatgtttactttttatgtttcatctttaattatcacgtttggaataggaggagttttataatggtgtgaatttgctgaatca

SEQ ID NO: 25417 - DNA, 201 bp, Homo sapiens
tcagatcatgaacccaggggtccagcacaaagacgtagatccagccctgataggagaatgcctggtttttagaaatagggggattagcttccaaactataraaagaattcattcatccattcattcattcattttaaaattcaggtcttaattcaaatatcacttccccagggaggcctttctgatacattgtctacagaa

SEQ ID NO: 25418 - DNA, 201 bp, Homo sapiens
gtttccagaggatctgctggtttctttgtcccagcagcttccctctgcctgaacctaccctagattccattctctagaatgagccagcttagggtggcaartgtccctgaagttggctgcatgtcctcagatcacctctgaaatctttcctttctataattttactgttgttagaacttttggcttcattaactttctaat

SEQ ID NO: 25419 - DNA, 201 bp, Homo sapiens
aataaataatttgtaaaaaaaaaaaaaagtttaaaatgttaaatcccagtagcaatcaaatacatataattcaattcaaaacactgaaatgacacttgtastcttttaaattagtgattttaaaaaaacaaaacaacaaaaaaacagaatattggtaagagagcaatgaaaaatgagttttcatacactgtgggaaaataa

SEQ ID NO: 25420 - DNA, 201 bp, Homo sapiens
gaacagaattctgccataccatcccttgactaaatttcactagccttctacatgagaaaagaatgaactaccttgttgaagcctctgagattttgagattstgttacatgcagttgatcttacaatctgattctaaccaattcagatatggaggaaataaatgaataagaacttagtttctaggatttcaagccagtagcc

SEQ ID NO: 25421 - DNA, 201 bp, Homo sapiens
tatgcatatatgtgtataaatatgattgagattgtgtaggagcctgtcttagtccatttgtgctgctataacaaaattataataaaataccaccaactacrtagcttatatacaacagaaacttatttctcacagttttggtggctgggaggcccaagaccaaggagctagctgactcagtgtctgatgaaggctcacttt

SEQ ID NO: 25422 - DNA, 201 bp, Homo sapiens
agctcaggagcagtggttacagaattttctggggtttaaataccatctagaggtttcccattggttacttggttacatcctacataaatgaggtagtgggmcatgaccagtctgattagtcgcctttcatgatcagtcagagactgaagtggttacaaagttacacccctatgcaaatgaagactaggcctgtgaccagcc

SEQ ID NO: 25423 - DNA, 201 bp, Homo sapiens
aacaaaacaagaatatccacaaacatgacaccctctttggcagaatagacactaagtgcatatttgttgagaattgagaagatgcataagtcagagaaaakaaattatatttaaaaaggctttacaaatttttagtttttgaggtaatatatacaagtggaacacaactcaaaaagagtatgtagtgaaatgtaagtttcc

SEQ ID NO: 25424 - DNA, 201 bp, Homo sapiens
gcactacctaactgttgtgttttgtaatcaaaagctatattggcaggggtgagtgtgagcctgctgaaaactcagggaaactgttgaaggtttatcaaccygaagcaattttactctagttagtgggcctgtgttgctcagttagcagaatgtttggggatcagaagaataccccagagcacttcagccattgcatagaca

SEQ ID NO: 25425 - DNA, 201 bp, Homo sapiens
tgaagcctgagacaggagaactgattgtgtaattccaatcctaaagctagcagactggagaccaaggaagagttgacgttttacttcaaatgcaaaggcargaaacattcttcctcaattgccacacagtctgactgattttgctggctctcactttccagaaagggaaccatggccataaatgtcatgggaaggtattta

SEQ ID NO: 25426 - DNA, 201 bp, Homo sapiens
ccttgaggtaataatagccatctacaacaaacagataacattatactgaatagggaaagttgaaagcattccccctgagaactggaacaagacaaggattyccattttcaccacttctattcaacatagaattggaagtcctagccagagtcatcagacaagaaaaagatatcaagtgcatcccaatcagtaaagaggaag

SEQ ID NO: 25427 - DNA, 201 bp, Homo sapiens
tattctgtttatctcctctcttcctctcttgcctctatgggtcctggcacaaagtttatgttccataattgatgttaaatgaatgtcttgttttgactaaratatttgttccttaagaaccttatccgtcttacctttattctgtaggaccaagaacacaagatcttatgtgtacccatttagcgatgacagactgaccaa

SEQ ID NO: 25428 - DNA, 201 bp, Homo sapiens
ccttccaaagtcctgggatttcaggtgtgagccaccgtgcccggccccatgcttctttatactagttctttcctcccttctcacctccagcctgggatgtrgtctccactatggtctttattccatactccaaatttgtctctttccaagtatcttcctaattcctttttttaaagttacctttttaatttcctgccgtga

SEQ ID NO: 25429 - DNA, 201 bp, Homo sapiens
acaggctcctggtcctgggtctgacttttttccagtgcaacccagtctgacaatgccatatattcccagtatatctggggaactgcatcactatttcttcrcatgcatttgagattagttatcatagatcacattttggagctggaaggaccttggagattttttaaaggcacttcaaaagtcattatacatacatattta

SEQ ID NO: 25430 - DNA, 201 bp, Homo sapiens
tgctgtgtcaagttttgttaattacacattgttacatgtcaaggcttctaacctattcattctatcctgtaaccataatgtatttgttttggtcttcgttmtagagaattcagtacaactattagtcattttgccagagatttatcatgcatttcttgattgactgaagttaatgcactagcaatttcttccagaaatgga

SEQ ID NO: 25431 - DNA, 201 bp, Homo sapiens
ttttgcccacatccttgctgtcattacgctagtcctaactcttgactcggccatgcagaatattttaaaccactttatcctctacactgcctcagagttaratcataagttggatcatgttacttcctctctcagaagacctacattttgaaaaattgcttgtggaataaatcccaaactcctaatttggcatttaaggtt

SEQ ID NO: 25432 - DNA, 201 bp, Homo sapiens
ctatgtatccaacaaaagtctaatatccagactctataaggaacttaagcaattcaacaaaccaaaaactaataacctcattaaaacgtgggcaaaggacrtgaacagacacttatcaaaagaagacagacaagtagccaataaacatatgaaagaaatgctcaacatcattaatcatcagagaaatgcaaatcaaaagca

SEQ ID NO: 25433 - DNA, 201 bp, Homo sapiens
tcagtgtgctaaatcttataaaattcctttgcatcatccaccttgacagatggtcttcaggaatgtgctgaacctccaaaacagagggttgggaggaaacycaagagtgttcttcccctgtcttctgtcaatgactacgacacactgaaggccacattgaccttccatcaaacatacatgcaggcttcaagccacccttcc

SEQ ID NO: 25434 - DNA, 201 bp, Homo sapiens
acagtagggactctgtgtgggggctctgatcctacttttcccttctgcactgccctaggggaggttctccatgagagcaatgcccctacagcaaacttctrcctggacatccagatgtttccatacatcctctgaaatctaggtggaggttcccaaaccccaattcttgactcctgtgcactggcaggctcaacatcatgt

SEQ ID NO: 25435 - DNA, 201 bp, Homo sapiens
ttataaaattcctttgcatcatccaccttgacagatggtcttcaggaatgtgctgaacctccaaaacagagggttgggaggaaactcaagagtgttcttcmcctgtcttctgtcaatgactacgacacactgaaggccacattgaccttccatcaaacatacatgcaggcttcaagccacccttccttcttccccgtaagg

SEQ ID NO: 25436 - DNA, 201 bp, Homo sapiens
ttatagtccggttggtagagtaaaaaagcaatcaaacttaacagctttttaaaaaattaagaatgttatataggttgatgttatttttattattataaatrtaatatttactccttttgccaacttggaaaatgtagaaaagtcaagaaaaacataacattcatccatgatcccaccacccagacaaaaccacttttacct

SEQ ID NO: 25437 - DNA, 201 bp, Homo sapiens
cagagggttgggaggaaactcaagagtgttcttcccctgtcttctgtcaatgactacgacacactgaaggccacattgaccttccatcaaacatacatgcrggcttcaagccacccttccttcttccccgtaagggacaggttgaagcaaagatcatgctattaggtattaggtaacaagcctccacttacagagtatcct

SEQ ID NO: 25438 - DNA, 201 bp, Homo sapiens
ttacttccctttaacttttctattatgccacaaaggacaagtatgtgttttccttataaaaagaagttttggcaaaaaatgaagttttggtcctatagttyatagtggccccagaaaaaattgccttactatttccacaacaccattgcttgttttttgtttttgtttttttatatagtcccacactttcttttgctcctg

SEQ ID NO: 25439 - DNA, 201 bp, Homo sapiens
agattgaacggttgttaacactttgctatgttttcatcagataacttgggaagaaaggaaggaaggaaggaaggaaggaaatagtgcaaatatagttgaagttttactcagtatttcctgctctcttccctttcttccctatataatttacttaaaagtttgtatatattattcctatgtgcattttgattatttttatta

SEQ ID NO: 25440 - DNA, 201 bp, Homo sapiens
ggtgtgcaatagatatttgttggacaaatgtctgcatgagtgagtagacggctgtggaattgggtttaatgctgtgattccaatgcatataataaggaatkaagttctttcctaaaatactcacatcacactctagcaaccattggcttcttgctagttgatttattctctaagaattgccacaatagattaaagagatga

SEQ ID NO: 25441 - DNA, 201 bp, Homo sapiens
gtccggtttcaaatcctagctcttcttgtccttagctctgtggccttgagcaaatcacttggcttctctgtgcctcatctataaaatgcgaatagtgctaygtaccgctaccacaactgtaatgattgcagaaaatgttcacaaggaacctaacagtgcctagcacctggaaggcattcagtaagaggtgaaaatgcaaca

SEQ ID NO: 25442 - DNA, 201 bp, Homo sapiens
ccatcagtgcagagaggcccatccatgaatcaggtaatttttaagtgagagaaacacacaacaagcctaggattaaggatggtagagagattactgtgtgwtgctatggcatgggaagactttgtggaggagaaagccctcgggctggatgctgaaggccaagtaggtgttagactgggggagctaagtgaagagggcatt

SEQ ID NO: 25443 - DNA, 201 bp, Homo sapiens
ttacgggcagaaaaggaacagagacagatcatcacggtctcccagttgtgttctttcttccactatgcagcctacatttctctctaccatacattttgatwacttaacctaggacatcaatacctatgtattaatcaggactcttgggattttaaacgtcaaacacctagagaaacttgtttgataagcagggaagttatt

SEQ ID NO: 25444 - DNA, 201 bp, Homo sapiens
ctcttgggattttaaacgtcaaacacctagagaaacttgtttgataagcagggaagttattggcttgtgtaactgaagagttttggtagggctgaatccargtttccagaagatgtcaggtgtttgcctctccttcacaaggcttaacttttctcagtgtggcttcattctcaggcaagctgcctacaaatagtgtccaaa

SEQ ID NO: 25445 - DNA, 201 bp, Homo sapiens
agggataccaagcaaaaacttaatgagagtctgactctgttatcataataaatatttttctacttttctctgtaaaaatgattttctctttcttgccctattttttttgcctcattgttccctaagtttatgtcatctactaataaattatatttaaaaataattaatacattaaaacaaatctgccaaatgggcctttca

SEQ ID NO: 25446 - DNA, 201 bp, Homo sapiens
cttatagattcacttttttgctcaagccttcagcttaaattatattcaattaatctaacagaagagttatttgtgctttgtaaatataatcagtctttccygagtaactgtctacagaaggctgtttgctgtgaagcgtcgttgaatacttttctgtgtctgtggtttactggacttgaaactgtttatttgaaatgttat

SEQ ID NO: 25447 - DNA, 201 bp, Homo sapiens
tttgctcttttcttaacttttctaagttgaaggttgtattagtcagggttctcttagagggacagaactaataagatacacacacacacacacacacacamaaaaaaaaactaataggatatatatatgtatatatacacatacaaaactaataggatatatatatatatatatacacacactcacacagaactaatagga

SEQ ID NO: 25448 - DNA, 201 bp, Homo sapiens
ggtcttttggcatcccacatctgttgacaattacagaggcacatacagtgccattcatagaatggcatgtgtctccctatgccttggttcacaggccctcrgggacatttacaaagtgtgtactttttaactgtcctagaactaaggagtttaattttgcctgagaatgtgtttatgtgccttgtaaaggagctagtcatt

SEQ ID NO: 25449 - DNA, 201 bp, Homo sapiens
aggtagataataggaggcctaagagaaagctcagttgtcctttggcctatggcctttgggcttgctgtagatcctctgttggcaactggatgctctgttgrgtccaggaattgatgataaccagtagtttgtgggtagatttccatgttgagcactgccttcagctaagtgctttcagttgcctcttgttatggttggagc

SEQ ID NO: 25450 - DNA, 201 bp, Homo sapiens
tcaggctaactgatgaattacaagattttcaccaatgagtgggaaatgtagcgataattattcagactgatttatatttgtctttgggctggtttttcatrtatatttttagacattttaatatatttggatctgattttttataaaatcatgaggttctctttatgctcaagtgctgccaagaagttggacagccctcct

SEQ ID NO: 25451 - DNA, 201 bp, Homo sapiens
gtcctcacagcttgaggtagcatttagcatgtgtcatgatttagtacaagggttggcaaactgttgctcttggattaagtctggctcattgcctgtttttsaaagaaaaaaattgtatatgtgtgtatatatgttatatataggtacacacacatatgtgctatatatagcatatatacacacataatatataaacatgta

SEQ ID NO: 25452 - DNA, 201 bp, Homo sapiens
ctggagccagtgagaataccccactgggagaggggagaagaatcagctgtgatgctggagccaagaattcataagatagccatcctgggtcttggcagcarcattgggactcctccagaaggtattgtttgtcttttcagtttgatttgtattttataaaactaatgtcccttggtgtaattgagtacaatatgcatgatt

SEQ ID NO: 25453 - DNA, 201 bp, Homo sapiens
actaaaaatacagaaattagctgggcgtggtaatgggtgcctgcaatccaagctactctggaggctgaggcaggagaatcacttgaacccaggaggcagargttacagtgagctgagatggtgccactgcactccagcctggacgacagagtgagactccatctcaaaaaaaaaaaaaaaaaaaaaaagatagtccaagat

SEQ ID NO: 25454 - DNA, 201 bp, Homo sapiens
ttcttacactgtaaaaaaaaaaaaaaatggtgggggggaatacaaatccagccccttctttcctcacagaaatgttgttaagatagataagaaaacaaaakcattgatctcttctggaggaaagatgatttaaattcaaagtattactcataaggtggatgctgttagatgactcagaaatgatgactgatgtgttattat

SEQ ID NO: 25455 - DNA, 201 bp, Homo sapiens
cacacacacacacacacacaaaaaaaaactaataggatatatatatgtatatatacacatacaaaactaataggatatatatatatatatatacacacacwcacacagaactaataggagatatatatatatatgagtttattaagtattaacttacatgattacaaggtcccacaataggctgtctgcaaggggaggaga

SEQ ID NO: 25456 - DNA, 201 bp, Homo sapiens
caaattctctgactctctcttttggaagaaataacatttactggttgcttttgaggattgaatcagatgagatatagaaaagcccttagcccagtgcttgmtaggggaaagatcaatattggttttcatctttcctttcttttttcctcccctcctacctccatcaggtggggagtgtgacttccggagcacactacacag

SEQ ID NO: 25457 - DNA, 201 bp, Homo sapiens
aggccaaggtaataggtttttcacatttggaaagctatttggaatgtaggagagttcttagtacacagattgtcccccacatagctgtctgtctagtgtcyccggcctctgccaactagttaccagtagaatctccataccatggtgacaagtaaaagtgctccccccacatattcaaaatggcccctaggggcagcatca

SEQ ID NO: 25458 - DNA, 201 bp, Homo sapiens
cctgttttcaaccagttgcttgtgcttatatatgcaatttgtctatttttttcatatctgttttcagcttctcccaaagaattatcattaggtcataacaytgggggaggtttactgaatgatcattcttttcaaagactttaccatttcccccagagccttggttggtttattgactagagcaaagcagttagtttgcta

SEQ ID NO: 25459 - DNA, 201 bp, Homo sapiens
aaattacaagactgttactgatcaatgttcaggcctattaaaatttcccctatcccaatggcacttgggcaactacttttcttgtatactttaggaagtawctaattcagacaggggactaagaagagactcttcacagtgcttgctgatagccccaaaatgcagcatgaaaccacccaaatgccaagacaaattgagaaa

SEQ ID NO: 25460 - DNA, 201 bp, Homo sapiens
cttggcagttctagggacccacccaccacctgttcctccccatattaccacagatgatgctctcttgaatgtgccacctcccagcaggaggataaccagcycaaaaatagtgcactaatcaatcaaagctaaggtatcctcacagagtccatttcacctccttgccgcctccaccagagcagatgctaatatccatggctg

SEQ ID NO: 25461 - DNA, 201 bp, Homo sapiens
ggatagcttgggaataagtcaaccaaggtggcagttggtaggtcttgaagatgtggttggctcctgggaaacagatgagctggccagtttgaaggatcttaaagttgcaagttttcgggctgggtagcaatttaactgtgcaacctgtcaagagcctattatattctaaatttgtgccgtgacaatattggctacatgaaa

SEQ ID NO: 25462 - DNA, 201 bp, Homo sapiens
gtaatcccagcactttgggaggctgcaaggtgggagaattgcttgaggccaggagtttaagaccagcctgggcaacacagcaagacccccatctgtctctmaaaaaaaaaaaaaaagaaaaggatgaagaaccatatttgggttcttcatcttttttctaaaagatgaaaatgaatttgtctgaaaaagaaaaaagtaaaa

SEQ ID NO: 25463 - DNA, 201 bp, Homo sapiens
taacataataaaggaaagagtatgatcatttcaggaggtgcataaaaagcattgcacaaaattcaacacccattcataataatgacttttggaaaattagkaatagtgacagcttcctcgacctgttaaaaggcagtgatgtcaaatcttcagtttaattatgaaagagtgaatgctttcctactacgatggggaataaga

SEQ ID NO: 25464 - DNA, 201 bp, Homo sapiens
tgggaatttagctacctttaaatgctaaatttacctctcagcttgtagatttcctacaaatgaatttctttgggtcaagattttttcatgagcattggcawttagtggatattccttgaaccaaccttttactttaagtgaaatgtatttgcattaagagcatattcatttcccaggctgcttcttaacacatttgtttcc

SEQ ID NO: 25465 - DNA, 201 bp, Homo sapiens
gtggagggctgctgccactttgacatcacccctaaaattgttgggcacaccctctctaaaataattttatttctcattatagcttaatcactatgaatttmtactagagtcatttaaaagaacaattttagcctgccctacttgttgggaagaataggggaaattaacagcatcttgtaactggaaggacccttataggtt

SEQ ID NO: 25466 - DNA, 201 bp, Homo sapiens
agtccgtaagtggatctgcttatagagaaacacctgttgcttctgttttttgtctcatatccagttagtttcccattcacagcaaaacattcccttcaatsccaaggaaactcaacctttttgattattagtatagtttcatcaaagtttctttgaaaggtaaaatatcccctttttcttgcctataatttttaaaccttt

SEQ ID NO: 25467 - DNA, 201 bp, Homo sapiens
tgagggtcttcttgccacatcataacatggcagaaggcatcgcacagaagaagggcaaagaggggatgagagagatcaaaggagacacaaaccccttcctrcaataaacattagtttattcataaaggtggagccctcatgtcctgaatacattttgaaagtccaaccttataataccgtcacaagcgcaattacatttca

SEQ ID NO: 25468 - DNA, 201 bp, Homo sapiens
tcagtcctttcactctgttatttctcattgaagcaattgctaaccagtgtatataatttttgaaaacatggatcttgttttatttagctttgggtcctctrtagcacttactagagttcattgcatctagaaatgttaaaatggcaagccaagtagaggttaacatagacatctagagaaatgttatccagttttccagag

SEQ ID NO: 25469 - DNA, 201 bp, Homo sapiens
tgtagttcagtggtaataaatgcatttatattctatttgtttctttgactcttctcccctctccccttcctggcctctgataactaccaatctctatcttyatgagatctacttttttagctcccacatgtgagtgagactatatgatatttgtctttctgtgcttggactttttcacttaacataatggtcttcaattcc

SEQ ID NO: 25470 - DNA, 201 bp, Homo sapiens
ctgcgttttccaatcaccagatggaatagcgcagcccagcggctctatatcccctgttgtccctaatttaatggtgcctcccttatggtgaaaacactgtrcagtgatgtttgaagggattgatgctccatggtaagcagacttcgccctactgggaacatgaaaaggaacctctctgatttgtggctgtaatcctcaagc

SEQ ID NO: 25471 - DNA, 201 bp, Homo sapiens
caatagggcctcagtctaaaaagacacatcaatttaataactcacttaaaaaatacatcatacttatctaatgaccattacattatatttcaggcaagttmttagagaactctgattcttatgtaagtgccagtgaaggaaaaaagattggagactcaaacaatgaggagttattataagctgccaggagaaactgaaaaa

SEQ ID NO: 25472 - DNA, 201 bp, Homo sapiens
actccttgatatattatctgaataaatccagattttcaaatatggggttgacttaaagcaagatacatctctagtagcctacatctatatttatcatataygaagatttttctgacttgggtattgaatatgaagatggggatctggagctggatcctctaattgttagagaccatttaaaatacaatggacatcatgact

SEQ ID NO: 25473 - DNA, 201 bp, Homo sapiens
ttagaaactaaaagtagaatacttttaatggatttgtgattgaggattttttttgtttttactttctggtcctgtcctgtcctttgttttcctttcatttyttccccctcttatgagttgagttgctttctcttctagggagctatgtgttaggaagctgctaatgaactgcttttgagtctaattttcaataagatttaa

SEQ ID NO: 25474 - DNA, 201 bp, Homo sapiens
ttaaagcaagatacatctctagtagcctacatctatatttatcatatacgaagatttttctgacttgggtattgaatatgaagatggggatctggagctgkatcctctaattgttagagaccatttaaaatacaatggacatcatgacttgcagctaaatccattcagctacctttactgtttaccaagcacctaacaggt

SEQ ID NO: 25475 - DNA, 201 bp, Homo sapiens
ataagccacttttattattttagctattaaagcaagatttctatattagtctagattcctacagtactaagttacagaggtctatctcagatgatctgaarcaaaaatggggaaattaagcaagccacggaaggatagagtttgatttggcctcagattttggcatttgaatgctgttaggacacatattctctctctctt

SEQ ID NO: 25476 - DNA, 201 bp, Homo sapiens
aaaagataatctttgtaaggaagaagaggtagttgtgactctttatgcatcaaacatttaaaaatgcatatctttaaaacatgtaaaactaatgattagawctatgagaaataagcgaagctatttgtaggacactttagatctgttgttttacatgacaaatcaagtagacaaagtcaaatggtaatacacaagatttga

SEQ ID NO: 25477 - DNA, 201 bp, Homo sapiens
agagcaaagccctgtctcaaacaaaacaaaacaaaatctcaacgttaaactttctagagaatgggtaatcacctttcaagtcatttttccaaacccatttytgaaccaggacaggcaataacagagattggcaggggaaggactgatgtctcctcacaagggaaaaaggactctgcattgaaaacacagatgagcctttgg

SEQ ID NO: 25478 - DNA, 201 bp, Homo sapiens
agctcaagacatatcttttcagcctctttagcacagaacaggcaaaaaattcatcctatctgacccggttggaaaagttacagtgacccagcctggctccatccctgtggtcaagagctgtagtcattaaaacggggagaaggagtgctgtgcaggtaaatacaataaccagctttgtttcattgttgagacctgattcaa

SEQ ID NO: 25479 - DNA, 201 bp, Homo sapiens
atttaaatctaggcagcctgacgccatgcccaacactcttttttttttttttttgagacggagtctcgctctgtcgcccaggctggagtgcagtggtgcgmtctcggctcactgcaagctccgcctcccgggttcacgccattctcctgcctcagcctcacgagtagctgggactacaggcgcccgctaccacgcccggct

SEQ ID NO: 25480 - DNA, 201 bp, Homo sapiens
taatctgaaatggtgatttgtgtggatagaagtacaaatagactggaggtggggaggcccttcactggacaggcaacattaatctagctgccattgtaccrcacacatgctgaatgatgatgatacaggaatgaaggaaacataattcacttgggcagctcaagagcatttttttaagctcttagtatatactggctagat

SEQ ID NO: 25481 - DNA, 201 bp, Homo sapiens
ggccttgcactgtgaaaaaccgaaggggaatcaatacagcctgtggctcccagctcaggcaggcagcctcgcccagtatacttctcccaggtgccgacttggggggtcaagggctttcccctctgcctaatgagcagttcttccatagcaagtcatcaccaccccagagtggtgggctcttatctgtattttaattttttg

SEQ ID NO: 25482 - DNA, 201 bp, Homo sapiens
caggaaagattctgatttgccttacttgagtcattccagctctgtagtttaggtgcagagtacagggtgaggaatggtattgtgattgacagtcaacctaraccagagtgtagggatcagggaggactaccctaaagaaaataaagccagaacatgggaaagtatgctggtaaatcaaaaactgtatcgactggtctatca

SEQ ID NO: 25483 - DNA, 201 bp, Homo sapiens
gaacagttgtttacagcatgagagctaaaacaagaaggcaaagtatttacttgtttgacctaggctaggaacatgtgtatggagtgactcaattttttttwtttatttatttttttttttgctgtactgcacttgtgcacaaatgactgcaaaagcaatgcaagtatgattttggggttacaaataaattttagtgagtag

SEQ ID NO: 25484 - DNA, 201 bp, Homo sapiens
agttgtttacagcatgagagctaaaacaagaaggcaaagtatttacttgtttgacctaggctaggaacatgtgtatggagtgactcaattttttttatttwtttatttttttttttgctgtactgcacttgtgcacaaatgactgcaaaagcaatgcaagtatgattttggggttacaaataaattttagtgagtaggcaa

SEQ ID NO: 25485 - DNA, 201 bp, Homo sapiens
gtttacagcatgagagctaaaacaagaaggcaaagtatttacttgtttgacctaggctaggaacatgtgtatggagtgactcaattttttttatttatttwtttttttttttgctgtactgcacttgtgcacaaatgactgcaaaagcaatgcaagtatgattttggggttacaaataaattttagtgagtaggcaaatta

SEQ ID NO: 25486 - DNA, 201 bp, Homo sapiens
tttatttaaaaaaaaaatccatttaatatcagttatcacttgaagaatttaaagacagaattatttgctcagaaaaatttgatgctttgtgctattaaacmctcagtacacagaaatagatttaagcaacatggtggtgaatcaagccaaggagagctgggaagctggaattgatggctcagtattctctgtaataatgtg

SEQ ID NO: 25487 - DNA, 201 bp, Homo sapiens
gatgacaatattacttgctttgcagaattaaatgaggtaatattttgaaaattatatgagctattatctaaaaacatttagcacagtgactggcacagcayagagtgcccagtcaatcttggtcccttctccccagttttgccctgaatgttggccagctttgctgcagatgctttctccactatgccattactctcatcc

SEQ ID NO: 25488 - DNA, 201 bp, Homo sapiens
tgtttgagataaatagcccttcccctgagaggccaaatactttccttgaagaaatgccagtcctatgtccctgtgggtagggttcagtatttgtagagtcrccaattataatggcccagatctaataggaactcaaggattccagcctatttccacctaccccacctgcccaagaccagccttatttccaggctttactct

SEQ ID NO: 25489 - DNA, 201 bp, Homo sapiens
aggcaaaccccctttcagattctctatagtgctgtgttctgaacccttaacatgctcttgagaccacagttctacctttcactgaaggtcttttctccacwatgttgagacattggaggatgtctgtcaggggttctcattcttttcttcccctcacccttcacagctttacccagccctccatcttccttcctgacccag

SEQ ID NO: 25490 - DNA, 201 bp, Homo sapiens
gttaaatgcatatttaactttttttcagtttttggcatttatgagtagagctactatgtacgtacttatacaagtgtgcaagttttattttctttcttggraaaatatctaggagtgggattgccgggtcacaggttaaatatatgtttaactttctaagaagctgtcaaactattttccaaagtggtttttacccctttt

SEQ ID NO: 25491 - DNA, 201 bp, Homo sapiens
gtgtattacagtattgcagcttgaatgtggggctcctgcggccatttgtcacagtcttcaggaaaggctttttatcagattcatagtggcaagtgatacarattattggatttcttttccaacataaaaaatagctatttgcagccttttgaagctgggtaaatgagccattgatcttacctgtggaacaccgcagggtat

SEQ ID NO: 25492 - DNA, 201 bp, Homo sapiens
aagaaaattatagtattaccatttctaaaatgtctaggcagccattgctattaagaaagttgcattgcttctatttaccttacaatgtgtttgcatctttcctaaaagcacaggcctagaagtaattccaatgatccagggggtagtccatagtctccccttcgagaccagagctacagctgcagattttgctaacatcag

SEQ ID NO: 25493 - DNA, 201 bp, Homo sapiens
attgagtgcctgtatttgagtataacaattgaaggtgcagtggtgaataatttaccctacttgactttgatagtaagggagacaggtttataaacaaacakattagctgatagcatagttaattatggtagaaacacagaagatggtgcaaataactctggggtgttgtttagtgagcctttacagaaaaggtagttttta

SEQ ID NO: 25494 - DNA, 201 bp, Homo sapiens
catagcttcctggacttctaaatagaaagaggaatctgagaacagaagagagctccctaaatgacaagtgtaccccagatgtctgtggccatgtcccagarggccagctgcaatgcagggcctctcttttgatgtcccttgttcacaacgagccatttcacttctagtcaggactatctgcctcctaccatcatcttgaag

SEQ ID NO: 25495 - DNA, 201 bp, Homo sapiens
ctaaaaaccctccaggtttcttttctcttattctgtctcactctctgtcaaagcaaaccagcacctggtctgtttcttcatatgctctgggatatcttccygaagaacagcctgaaaagcagagtcttctcttgccattgtccacactgatctccaggaaatccttcatctttaaccctggaaaatggcagctggagaacc

SEQ ID NO: 25496 - DNA, 201 bp, Homo sapiens
aggatgctgcactggggaaactggggaaagtttacataggatctctctgtattctttcttataactcaatgtgaatctacagtgatcccaacataaaaackgtaatttaaaaaacttagcgtactttactgtatgtagctcctttccttgtacttgataaccttaagtctttttgtcaaccagtgatacactggtctacaa

SEQ ID NO: 25497 - DNA, 201 bp, Homo sapiens
tttgttacatgcatatagtgtttaatggtgaggtttgggcttcaagcatagccatcacccaaatagcaaacattttcaaccaagatgaaggtgtactgttmactctgggtaagagtgtgccaggcagaaggaacagttactaccaaggtactgaggtgggaatattgcccttcagcaaagaggctagagtgactggagcag

SEQ ID NO: 25498 - DNA, 201 bp, Homo sapiens
acttgccagttttctcagcaccatttgttgaatagggtgccctttcctcaatttatgtttttgtatgctttgttgcggatcagcacttacttaatatattkggctttctttctgggttctctattctgttccgtcggtctacatgcctatttttatacccctaccctgctgttttagtaactatagccttgtaggataatt

SEQ ID NO: 25499 - DNA, 201 bp, Homo sapiens
ccatctgctcctggtcttttcttaacttgagacattttattaatgattattactaatttttattctgctcaggctttctgtttcttcctggctcattcttkgtaggttttatgtgaccaggagttatccattttctctaagtttttccatttgttaaaatatagctgtttataatagtctccagtgattctttgtatttct

SEQ ID NO: 25500 - DNA, 201 bp, Homo sapiens
atcttccacatagtgttgagtctgtaggtacacagaagtcaagaactgaggtttgggaacctcttcctagatttcagaggatgtatagaaatgcctggctrcacaggcagaagtttgctacaggggtgaggctgtcacagagaacttctgccacggcagtgtggaaaaaaatgtggggttggaacccaatacagaaaccct

SEQ ID NO: 25501 - DNA, 201 bp, Homo sapiens
gtgcagacaaactgctgccctttccatgatggaaaaggtccaatataatcgacctgccaccaagtagctggctgatctccctgaggaatggtgccatatcragggctcagtgttggtcccggctgctggcaaattaggcactcagcagtggctgtagccgggtcagcttggtgagtggaagcccatgttgctgagcccatg

SEQ ID NO: 25502 - DNA, 201 bp, Homo sapiens
agaatggcagtaaggggatgatgtttttaaattcgcttaaaaagaactttgcagcaggtgttacagagtgcataatttggccatttgaccacttcagggaygttggttctttacatctttccatgttgccattctcagcatgtagacttttgtcaggcctgtctctttgtggtcccaggatggctgcagttgctctaagca

SEQ ID NO: 25503 - DNA, 201 bp, Homo sapiens
gtcaagaactgaggtttgggaacctcttcctagatttcagaggatgtatagaaatgcctggctacacaggcagaagtttgctacaggggtgaggctgtcayagagaacttctgccacggcagtgtggaaaaaaatgtggggttggaacccaatacagaaaccctacttcagcattgtctagtttagctgtgagaagaggac

SEQ ID NO: 25504 - DNA, 201 bp, Homo sapiens
tgggaacctcttcctagatttcagaggatgtatagaaatgcctggctacacaggcagaagtttgctacaggggtgaggctgtcacagagaacttctgccayggcagtgtggaaaaaaatgtggggttggaacccaatacagaaaccctacttcagcattgtctagtttagctgtgagaagaggaccaccatcctccagact

SEQ ID NO: 25505 - DNA, 201 bp, Homo sapiens
aatgcctggctacacaggcagaagtttgctacaggggtgaggctgtcacagagaacttctgccacggcagtgtggaaaaaaatgtggggttggaacccaayacagaaaccctacttcagcattgtctagtttagctgtgagaagaggaccaccatcctccagactgatagatccactgatagcttgcaccatgcacctgga

SEQ ID NO: 25506 - DNA, 201 bp, Homo sapiens
tgaaatgagttaagattttgggggactgttgggaaggcatgatttattttgaaatatgaggacatgagatttgggaggggccagcgcagaatgatatggtytggctgtgttccccacccaaatctcatgttgaattctcatgtgttgtggaggggacccagtgggaggtaattgaatcatgagagtggatttttcttgtgc

SEQ ID NO: 25507 - DNA, 201 bp, Homo sapiens
gaaatatgaggacatgagatttgggaggggccagcgcagaatgatatggtctggctgtgttccccacccaaatctcatgttgaattctcatgtgttgtggrggggacccagtgggaggtaattgaatcatgagagtggatttttcttgtgctattcttgtgatagtaagtctcacttactcactcgtgatagtgagtaaga

SEQ ID NO: 25508 - DNA, 201 bp, Homo sapiens
atggttctgtggaaagctctaggtgctgcctaagcccctataaattactaggacttaacttacaaattacttcctctgaagatcttgtcaagacttagttytaggcttttcttggactagtttagtctgtattcatagggcagtgtttctctatcttttttttcattactataaaagagatttttaagacatttttttccc

SEQ ID NO: 25509 - DNA, 201 bp, Homo sapiens
caaaagtacattcatagctcactgcaacctcaaactcctgtgctcaagcaatcttcccacctcagcctcccgagtagctaggactacaggctggcgccatkgtgcccagctaatttttttaaaatttttatttttagagatgaggtctcactatgttgcttaggctggtcttgaattcctgggctcaagcagtcctcccac

SEQ ID NO: 25510 - DNA, 201 bp, Homo sapiens
aagttacacagatctctggggcaggggcaaaatgccaccagtctctttgtgtaccaagagccaccattactccagttcccaacaagttcttcatctccatstgagaccacctcagcctgcacttcattgtttatatcagcattttggtcaaagccattcaacaagtcctaaaatattccaaacttctccacatcttcctgt

SEQ ID NO: 25511 - DNA, 201 bp, Homo sapiens
tatcacctcttaaaaacattgtttccactttaaaagtaaacacttaataaatttttggaagatctctgatttttatgtgttcatttatgaacattaaataygaaaatattatggtttatattatttattgaaggagtagaggaattactcaactttagtatgctcttaattgaatatatggaggcatttgactttctaatt

SEQ ID NO: 25512 - DNA, 201 bp, Homo sapiens
cttctgccttaaaggcatttatttcctatcatcacctgttttctccaagacatgtgagaagaataaagcctgtattgtggcattttgtgtgaatgctaagwtcttggcaatgtttcttataccttccctagctcttctattttccctaaaaagtattctctttttgaaagaaaaatttaatttctcaatttcttaaaccag

SEQ ID NO: 25513 - DNA, 201 bp, Homo sapiens
gaacctcaagaggcttggctctgaagggaggagacagagagagcagcagcaggagaagggtgtggggtaaaagaatgggttggtttaagacaggaggaacrtaaacaggactttaatgtgttttagaatgaagaggatgagtgaatgaatgtttggtgagaagcaattacaggatataaagcaaataattagaatataggc

SEQ ID NO: 25514 - DNA, 201 bp, Homo sapiens
ttccactttatggaggaggaaacacaggttcagagaggtaaagaaacgtatgcaagattgtaagtggaagagtcaggatttttagtcaggtctgtcagacyttatagcccatgttttctcctctatgcctaagtaggagtgggctcagtggtgatgttttaagggctaatgttgatgttttaagggctaatgagaaggagc

SEQ ID NO: 25515 - DNA, 201 bp, Homo sapiens
gattgtgttgtttataatcttttgaagtacatttttaaaattcagtattatactgctcagaatcatccatattgttgcatattatagtcattcataccttytgactgctctgtaatattcaatgtgtgaatataacagcttgctatggcttgaatatttgttctttccaaaactcatattgaaatttaatccccaatgtgg

SEQ ID NO: 25516 - DNA, 201 bp, Homo sapiens
gccagcgcagaatgatatggtctggctgtgttccccacccaaatctcatgttgaattctcatgtgttgtggaggggacccagtgggaggtaattgaatcaygagagtggatttttcttgtgctattcttgtgatagtaagtctcacttactcactcgtgatagtgagtaagatctgatggtttttaaaagagaagtttccc

SEQ ID NO: 25517 - DNA, 201 bp, Homo sapiens
ggaggtaattgaatcatgagagtggatttttcttgtgctattcttgtgatagtaagtctcacttactcactcgtgatagtgagtaagatctgatggttttwaaaagagaagtttccctatacaagctctctctcttggcctgctgccatccacgtaaaacgtgacttgcttctccttgccttctgccatgatggtgaggcc

SEQ ID NO: 25518 - DNA, 201 bp, Homo sapiens
aatgggctaatacaccaactattgttgtactggagtctgtctctccctttatatctgataatatttgttttatatatctaggtgctctgctgttgggtgcwtgtatgtttggaattgttatattctctttctgaattgatcccttcatcattatataatgactttctttgtctctttttacaggttttaacttaaagtctg

SEQ ID NO: 25519 - DNA, 201 bp, Homo sapiens
agacagttgctgttagcatcttgctgcacttctttcactctattttcttctatgagtatctttataaagttataatattttatagatactgtcaaatctarttgttgtttaacatcaggcaaaatatcccttgaaacagaatttttaatgtatttaagttattctaacaaatggatatcctgcaatttacttaacctggta

SEQ ID NO: 25520 - DNA, 201 bp, Homo sapiens
atttttggttgttttatatatcatttgtctctttcttccttttttattttttatcattgtggtttagtggttttctttagcggtaatgtttcacttctttktctttctcatttgtgtatcttacttttatactttcatgtgtttttattatggtagagattatccatttgctttcagatgtaggattccgttaagtatttc

SEQ ID NO: 25521 - DNA, 201 bp, Homo sapiens
gctcgtgccactgcattccagcctggggtgatagagtgaaactccatctcaaaaacaaacaaacaacaaaaaaacaaaaaacaacaaaaaaacaaaaaacaaaaaaacagagttagctcagtgttttatgatttataaatattttcttaattttctaggcatttgtgttttgattttttgttatgaaatactttttatttc

SEQ ID NO: 25522 - DNA, 201 bp, Homo sapiens
actatatttgtgtctatttctgggttctctgttctgtttcattgatctatttttctgtttacaaaccagcaactcaccattttaaataatagctttacaayaggtttttatatcttgcattgctaatcccgatcatttgtgttctttttcagaatgtttcttgttattcttatttttcctgtgaacttcagaatcaaatca

SEQ ID NO: 25523 - DNA, 201 bp, Homo sapiens
cttcctacttgatactttctttgatagatgtctttaggggagccaacttttctttaacatctttcctttgactctaaagctctcctctcccaacatttccycctcagtttaacccgagttatgtgttcatgacataaatagggccacgtttgccgctgaatgatgtcacagtgcaggtgatccacagatagagaatacaaa

SEQ ID NO: 25524 - DNA, 201 bp, Homo sapiens
tatgtgtgaacatattaaatttatagaataagtcaggtagaactgacatctttaacatttagagttttcttatccatcaatatccctcacttttccatttrtttaattcttgtgggtccatcagtaacattaaaagttttattcacatatttcttgttatacatttttctagttactctataattttggttgctactttta

SEQ ID NO: 25525 - DNA, 201 bp, Homo sapiens
ttttattcacatatttcttgttatacatttttctagttactctataattttggttgctacttttaatgcaatctattcttactttggatctcctatttgcrttgttcgtatgtatgaaaagtagtggtgtcacaatattatttttgtattcattcacttaactgaattctgtcattatttatagttttccagttgattctc

SEQ ID NO: 25526 - DNA, 201 bp, Homo sapiens
gccatgggtatgcaaagacaaacagggtggtataatggacactggagacttagaaagggggagaatggcaggtgaatgaaggatgaaaaactacctattgkgtataatgtatactattcgggttacgggtgcactaaaatcccaggcttcactgctatacagtgcatccatgtgaccaaaaaaccactgtacccctaaagt

SEQ ID NO: 25527 - DNA, 201 bp, Homo sapiens
gggaatatagtgcccttagaggctctgtctcttcatcttgaagatcccctggtcctagggtctggattctccacaagcctcctttatcacatcatcatgaycctcactggaatcagtctctctgaactgttttcttcctcctcctgatgtctcactcccctctctcctttctccagggctattgttgccaccagttcctaa

SEQ ID NO: 25528 - DNA, 201 bp, Homo sapiens
aggaatcattctcccctccctcccaccacatagaatcaacatatggtagggattacagtgggggcatttctttatatcacctcttaaaaacattgtttccmctttaaaagtaaacacttaataaatttttggaagatctctgatttttatgtgttcatttatgaacattaaatacgaaaatattatggtttatattattta

SEQ ID NO: 25529 - DNA, 201 bp, Homo sapiens; identical to SEQ ID NO: 5624

SEQ ID NO: 25530 - DNA, 201 bp, Homo sapiens
actaatgtcccttggtgtaattgagtacaatatgcatgattcatattataatttggataatttcctattccattggcttaatgagttctctaccctttttygtcctcccattttttacttctgtttcttttgtgaaagggaactgatcatgttggatcgctttttaaatgtagaatctgtagctactggtccatgatactt

SEQ ID NO: 25531 - DNA, 201 bp, Homo sapiens
cttgtgtgacctagaaaagattggaagaaattgaggatacttcaattagggaggttccccaaataacttgatttttctaattagatagagatatctttcayatttaaaattttatttctgtgcagatttgctgtgactttggtgtggcctaatctttagcagtaatcactttagcagtgaaatttaacttagaagtccagt

SEQ ID NO: 25532 - DNA, 201 bp, Homo sapiens
tttctaattagatagagatatctttcacatttaaaattttatttctgtgcagatttgctgtgactttggtgtggcctaatctttagcagtaatcactttakcagtgaaatttaacttagaagtccagttagggttaagataaaaaggccacatgaggtaacaaatgagaatatgtactctggagttatacagatctgagtt

SEQ ID NO: 25533 - DNA, 201 bp, Homo sapiens
atttatgtgaataaaagtctatgtcttgggcttctgtaaactcacctctcaaccccagcatacagcacaagaatatggaaatagaaggaagtatgtatgcmtatatgtgtataaatatgattgagattgtgtaggagcctgtcttagtccatttgtgctgctataacaaaattataataaaataccaccaactacatagct

SEQ ID NO: 25534 - DNA, 201 bp, Homo sapiens
gggataatagcaatacaaacattattggtctgtatgaagattaaacaatataaaatatgtaaaacagcataatgcctggtatgtggtaagctttcaataartgttaccttcatttgttatatatatcatgacagttaatacaatgctgagcgaatatttgatgattgtctgaaataacttgaaaaagtttagtgaaaaaat

SEQ ID NO: 25535 - DNA, 201 bp, Homo sapiens
aagaatactaataatagagttttcattaagcatgacatgctggcttttgagatgcaacagagatattttgtcatattaagagaggaaacccttttttcttrgtatagtacatgataagggtttttgtcaaaaataacgttgaattttatcaaaagccttttcataatttattgagatggtattttagttttctctttttat

SEQ ID NO: 25536 - DNA, 201 bp, Homo sapiens
gcataatgcctggtatgtggtaagctttcaataagtgttaccttcatttgttatatatatcatgacagttaatacaatgctgagcgaatatttgatgattstctgaaataacttgaaaaagtttagtgaaaaaattgggggatggaggggttgggaactgggcacagacaattcagccatctaaggaagcagtggcacttt

SEQ ID NO: 25537 - DNA, 201 bp, Homo sapiens
tactcaaactagtccaaaaaatagaggaggaaagaatacttccaaactggccttctatgagaccaatattaccctgatacaaaaaccaaacaatgacacattgaaagacaaaaacaaaaaattacaggccaatctccctaatgaacactgatgccaaaattcttaacaaaacattagcaaactaaattcaatgatacacta

SEQ ID NO: 25538 - DNA, 201 bp, Homo sapiens
aaaagatgtttccaaagtatgaccagcattggaatttgttcagacccatatttataaacagtaactatgacaactcattcctcccaaccatgctcaacccytcatactttcccaactgtctgttttacaagatgacataagtagagggtttggaaaaaagaaaaaaaaatctttggatgataaacgctttttgcaaacaga

SEQ ID NO: 25539 - DNA, 201 bp, Homo sapiens
tctaatgcgtgggtggacttacagcctggaagctggaggagggaggaggtacagaggacacagagaacatctctttccttcctgaaggatggagggagaaraactttccccctgtctgctccaggcctgacctgaagcttggctggccccagggagagcaaagaagagctttatactagctatgaaactggaatttaaaat

SEQ ID NO: 25540 - DNA, 201 bp, Homo sapiens
ctttcaagagtcaaagtttaaatgccatctactttggatccgttcaaaatattttcactaaccctttataatttaattgactttttaacttttttgttctrttttgttttaacacagcgatctacccttttatgtaaccccttctgctccacatatcactgggctggggccaaaagtaactgagtgactaatatctgggaa

SEQ ID NO: 25541 - DNA, 201 bp, Homo sapiens
ttcaaggaaaaaatgaggaagattacataattgttttaaaataattatccttgactacaaagatcaataagaagggtgcgatgggtacgctaaaagcccasacctcacaactgcacaatatatacacgtcttctgcacttgtacccactaaccctataatttaaaaaaataataataaaaaatagcaagagtgacaccttc

SEQ ID NO: 25542 - DNA, 201 bp, Homo sapiens
tgggtgggatctgatgagtatttgatgttttctaaatcccaaactatctttttcaatgaagtcaatgcattttcaaagcatttttctgcttaatttggaakattaaatgtatctaactggaagcgcatactagaaaagcatgagaaagggcttcttgtcctgatcagaaagatgaggaggctccgaagagatctgaggtag

SEQ ID NO: 25543 - DNA, 201 bp, Homo sapiens
ctggtctcgacctcctgacctcaagtgatctgcccgccttggcctcccaaagtgctgggattacaggcatgagccaccgtgcctggcaaggcctctgcacttttttttttttttgagacggagtcttgctctgtcgccaggctggagtgcagtggcgcgatctcagctcactgcaacctctgcttcttgggttcaagtgat

SEQ ID NO: 25544 - DNA, 201 bp, Homo sapiens
tccagcttctgaatgctgtctatgtttttggcttgtggctctttcctccatatttaaaggcagcaatgaccagtcaagtattgtcatattgtgtcactctkacactcaagttagaaatctagcactgttctcactgggctaaaatcaaggtgccctcagggctgctttattttctggaggatttaggagagagtccatttt

SEQ ID NO: 25545 - DNA, 201 bp, Homo sapiens
tgcagaaaatcagagaaagggcagcatgtatatattcactacccagattgaacggttgttaacactttgctatgttttcatcagataacttgggaagaaargaaggaaggaaggaaggaaggaaatagtgcaaatatagttgaagttttactcagtatttcctgctctcttccctttcttccctatataatttacttaaaa

SEQ ID NO: 25546 - DNA, 201 bp, Homo sapiens
ggatatttttgtgtgggccattattctgcctaccacagcttctaaatttggagccatttaatgaaaagacaaggtaagccatatgtgtgtgtgtgtgtgtrtatatatatatatatatatacattgtttgttgggcctatacctatatttcatccaacacagtatagggtctcaaaataatttaagaacaatagaaactta

SEQ ID NO: 25547 - DNA, 201 bp, Homo sapiens
cgtgtctcctggcacatacatacaagagttgctctagggtatatacctaggagtggaatttctgggtcacgaggtttacacatacttggctttgctaggtwatgccaaattgttttcaatgggattatgccaatttacattcccattagaagtatgtaagaattctggttgttccttttcctccttagtgcatggtatttg

SEQ ID NO: 25548 - DNA, 201 bp, Homo sapiens
tccatgtgttaatgagaagaatgtatattctgcaattcttgggtagaatattctgtaaatattattaggtcaattttttttatagtgtagattaagtccgrtgtttctttgttgactttctgcctctatgatctgtctagtgctgtcagtggagcattgaagttccccactattattgtgttgctatctatctgttttctt

SEQ ID NO: 25549 - DNA, 201 bp, Homo sapiens
ggtcgataggactgggtgccgtggagcaaggggtggcactcattggggaggctcaggccacacaggagcccatggagggggtgggaggctcaggcatggcrggctgcaggtcccgagccctgccccgcaggaaggcagctaaggcttggtgagaaatcgagcgcagcgctggtgggctggcacttttgggggaccaagtac

SEQ ID NO: 25550 - DNA, 201 bp, Homo sapiens
cttcagattctccctgaccaagatcatttctcccattttctaaataggctgaaggaaggcaagggctgaaacggagacaggatgctactgcagtactccasgtgaaggctggtggtcgcttggactgagtcagaacagggaaactgatgggaagttgtcggagagtaagtctatgttgaaaatagagccaacaagatttgt

SEQ ID NO: 25551 - DNA, 201 bp, Homo sapiens
gttatctcacctttacatatttttcttaaaaatgacaattttctgcataactgtaatactattatcactcccattaaaattaactatataatttcttaatrtcctgtagtactgcaaattcaaattgctcaattgtccccaaattgtcttttgcagccagtttgttcagtcaggatctaatcaaggatagtgaatttctta

SEQ ID NO: 25552 - DNA, 201 bp, Homo sapiens
ccgggcacagtggctcatgcctataatcctagcactttaggaggccaaagtgggtggatcacctgagcccaaaagttcaagaccagcctgggcaacctggygagacttttcctctataaaaacacaaaaaaattagctgggcgtggtggtgcacctgtagtcccagctactcaggagactgaggtgggaggattgcttgag

SEQ ID NO: 25553 - DNA, 201 bp, Homo sapiens
tgtctcaggtgtggccagggcaacgggctttttaaaagactttccaagtaattctaatgagtatctaagtttgaggaccactgatctagatcaattaacchtacatacatatatatatatatatatatatatatgcatttttttttaaaaagatacatttaacacctccccccacccaataaaccttatggaaacccaatg

SEQ ID NO: 25554 - DNA, 201 bp, Homo sapiens
tgatctgaccataagaggttaccttggagcattcctctacattgcattatgtatattacatggtaatgaatgacagttttcatggctcctaataatgagcwgcttctctttatttagagaacaaaatagggggtttacagataatatctgagtttatcattgagctgctcagcctcctcttctatgtgcctcagcttgtct

SEQ ID NO: 25555 - DNA, 201 bp, Homo sapiens; identical to SEQ ID NO: 5632

SEQ ID NO: 25556 - DNA, 201 bp, Homo sapiens
tcagggaatatctataatatattccatggcaattaaattgcataccccagactgttcaagatgtgtttataaaaggagaaatggatttcccacagctgctygcctgtgaatgcatccttcacacagaaccacagtagccagtatatgcactaaaataacagacttgaatttaaactttcagtgctttcaaacgtctttcaa

SEQ ID NO: 25557 - DNA, 201 bp, Homo sapiens
tagggatgttcatgaagagttgtgcatagagtgttatctacgtaaatcaaatgacactttcagtgcagtaggggagtccacaatatccaaagtgttatgaytaaattttttatgaggcaaataatccctttataaaatgaacaatcagtcactccttgatatattatctgaataaatccagattttcaaatatggggttga

SEQ ID NO: 25558 - DNA, 201 bp, Homo sapiens
tgaaaaacactgctttaagcatctataggacataatttcgagctgtagaaccacagattttagaactcaaagggaatttagagaccatgtactctaatttwactatgatttagtagatgttggttagcaactgtggagctgcaggacaacaaccaacttgtgtgcctgattttctaaaaaactaggggcatctcaaacaaa

SEQ ID NO: 25559 - DNA, 201 bp, Homo sapiens
ttcagcaccaagtaaaacggcctacacatcctctcaccagactcttttgcttataatcatcattattaccttaaagccaaagtttactcatctgtaaaatsaggataataataattatagaatcattgtgaggctttgataagataatgcctgtaagtgtttagtacaggctcatagaaagtacttagtaaatcctggcta

SEQ ID NO: 25560 - DNA, 201 bp, Homo sapiens
ggtgccgtctgtcacccctttctttgactaggaaagggaactccctgaccccttgtgcttcccgagtgaggcaatgcctcgccctccttcagctcgcgcaygacgcactgcacccactgtcctgcgcccactgtctggcactccctagtgagatgaacctggtacctcagatggaaatgcagaaatcacctgtcttctgcg

SEQ ID NO: 25561 - DNA, 201 bp, Homo sapiens
ataaaattgagataatttttacctttaacataaaagttcggctctaaaaaatgtttggcaaagcagaaactctaagtactaatgaggatatgagttgctcytacagccactttagagagctactaaatgcaaataagcatgacctgattctaggctcacaccctaaaaaatctctcccacagtactaagacagacttgtac

SEQ ID NO: 25562 - DNA, 201 bp, Homo sapiens
caaaccttactttcttggaaagaccgttttctggccgctgaggtctctgccactatctgtcatagaatttgattttattttttcacatcatgtgtcagtcyctggaattatttttgttaacttgtacatctactgtcctccaattagaatgtaagttgagaagaacagagccattgtctgtcaagttcattgctgtatccc

SEQ ID NO: 25563 - DNA, 201 bp, Homo sapiens
cctaccttggagaaaaatttgggggcacttaagaaaaatgtgtattctgccactgctgggtgaaatgctccgtatgtatctgttaggtctgtttgatctayaatattattcatgtcctctgtttccttacttatcttccgtattgatgtcctcttcattattgaaagtgtggtatcgaagtttcctactattactgtattg

SEQ ID NO: 25564 - DNA, 201 bp, Homo sapiens
tttttgacttagagtatgttttgtctaaggatagccacccatgcattcttttggttaccatttgcttagaatacctttttctagcccttcactttcacccygtatgtctcactaagtctaaagtgagtttcctgtggagtgcatgtagttgggtattttgtttgttttccattcagctactctatgtctttggattgggaa

SEQ ID NO: 25565 - DNA, 201 bp, Homo sapiens
gactttccaagtaattctaatgagtatctaagtttgaggaccactgatctagatcaattaaccatacatacatatatatatatatatatatatatatgcatttttttttaaaaagatacatttaacacctccccccacccaataaaccttatggaaacccaatgcataaaaaagattaaagtggaggtgctttacataagg

SEQ ID NO: 25566 - DNA, 201 bp, Homo sapiens
gaggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagt

SEQ ID NO: 25567 - DNA, 201 bp, Homo sapiens
tgaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtcc

SEQ ID NO: 25568 - DNA, 201 bp, Homo sapiens
aggatttaatattgcggtttcattagttgttttcttttagtcctatagtccttttgtcagtcttttcctttcttactgtcctcgtttatgttttcttgattttttttttttgtattcatatgctttaattcttgttgacatttttagtattataccttttcatgggttttggaattttcgtttgctgactcattttgagtg

SEQ ID NO: 25569 - DNA, 201 bp, Homo sapiens
gaggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtcca

SEQ ID NO: 25570 - DNA, 201 bp, Homo sapiens
taactttcatttaaactgcacagactatcatggctgggtatttttcaaagctacatagggttctggaattttagaaaccattaggggccaagaagaatctktcagcttatagatctaaatgttcaaaatttaagttaaagcctgtttcttttggtaggaagcaccttgactcccattttttataatgaaagattgatgata

SEQ ID NO: 25571 - DNA, 201 bp, Homo sapiens
aggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaa

SEQ ID NO: 25572 - DNA, 201 bp, Homo sapiens
agaggaattcttgaaaactggcatggaatatcgtattagatggaaccttggaaggttttatttatcccttctcttttagctttctgtctaaggcctcagawtgtagtctattttagaaaatctccaaggcaggaaatttttcataacctttcccctgttagtcattttttttaacttcaacaaaagcctgcatcagaagct

SEQ ID NO: 25573 - DNA, 201 bp, Homo sapiens
ggcaggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaa

SEQ ID NO: 25574 - DNA, 201 bp, Homo sapiens
ctaaaaaaattatattgaagtataatattctcagagaaagtgcacgaatcctaagtgtatatggtgaacttttacaaactgagtacacctgtgtaactgcyacccagatcagaaaacagaacatgaccagcaccccaaaaggtttcctctaccccctttttgtcacaaaccctcctcaccaagagtaatcactctcctgtt

SEQ ID NO: 25575 - DNA, 201 bp, Homo sapiens
caggggaatggcatgaagctgggaggcggaggttgcagtgagccgagatcgccccactgcactccagcctggatgacagagcgagactccatctcaaaaataaaataaaataaaataaaataaataaaataaaataaaataaaataaaaaaataaaatatcctctgacaacttcccaggcttttatacttgagtccaaaat

SEQ ID NO: 25576 - DNA, 201 bp, Homo sapiens
ctgagtatcgtttttatgattattagtaatttgcatatctttctttgtgaattgtctgttcatatacatatatatatatgctgaatattttctgtttttcygtgggttaccttttcactctcttagtggggtcttttgatgactagctttcctagtttaaaaaaaaacactctcacatattaaagatcttagtaaatattt

SEQ ID NO: 25577 - DNA, 201 bp, Homo sapiens
cctttgcccactttttgatggggttgtttgtttttttcttgtaaatttgtttgagttcattgtagattctggatattagccctttgtcagatgagtaggtygtgaaaattttctcccattttgtaggttgcctgttcactctgatggtagtttcttttgctgtgcagaagctctttagtttaattagatcccatttgtcaa

SEQ ID NO: 25578 - DNA, 201 bp, Homo sapiens
acgacttcactcccctgctaattccatcagagcaggtgctggcatccatggctgcaagacctgaagacagatcacatcacaggactctttgcagacactcyccagtaccagcctgaagcccagtagctcctctgggtggctagacccagaagagcaaaaacaatcactacagttcagctctcaggaagccccattcctagg

SEQ ID NO: 25579 - DNA, 201 bp, Homo sapiens
aaagactttccaagtaattctaatgagtatctaagtttgaggaccactgatctagatcaattaaccatacatacatatatatatatatatatatatatatrcatttttttttaaaaagatacatttaacacctccccccacccaataaaccttatggaaacccaatgcataaaaaagattaaagtggaggtgctttacata

SEQ ID NO: 25580 - DNA, 201 bp, Homo sapiens
cagacctagaaatgatagtgatgatgaaatttgtagacaggcactataagcaactattatacatatattcaaggatttaagagaaatcagaaacataatgmaaagagaaatggaaactatagaaaaggaatcaaatgtaattctataactgaaaaatacaatatatgaaataaaaaaattcaccttatgggctcaacagta

SEQ ID NO: 25581 - DNA, 201 bp, Homo sapiens
tctttatgctcaagtgctgccaagaagttggacagccctcctgttcttctcccagttccccagtccctattccagatgaggggatgcagagttagttgtcmattcattcaacaaacatttattcagcagttagagtgactatctcatctcagtttccctgagacttttctggtttgagcactgaaaagttctatattctag

SEQ ID NO: 25582 - DNA, 201 bp, Homo sapiens
aagactttccaagtaattctaatgagtatctaagtttgaggaccactgatctagatcaattaaccatacatacatatatatatatatatatatatatatgyatttttttttaaaaagatacatttaacacctccccccacccaataaaccttatggaaacccaatgcataaaaaagattaaagtggaggtgctttacataa

SEQ ID NO: 25583 - DNA, 201 bp, Homo sapiens
tgaccctaactttccatattctccagcttggagatgcctgtgggaggtttgctttgagaaggccccagctttggcattgtcagtttttcatctggctcctmatctatttcactttgtctcaagcttcccttctttggtgacccactaaaaactgaagttgtgctggcaagatggtgctttgttgtcatggaaagaggctgt

SEQ ID NO: 25584 - DNA, 201 bp, Homo sapiens
ttattgttcatggagtttcccccccaaacacacacacccattccacatttggtcatttgtttgtaatatcttctttggcttttctggattccaagcatcayttgtgcattcctttaaaaagctttaaggcttttcacatccacagtgatcccattacattccttatataactaatatattatgtattttcattggaggaag

SEQ ID NO: 25585 - DNA, 201 bp, Homo sapiens
gagcaagtgcaagctattattatgatccttattatgtttgatgttgttgttatgtctccctagagtttggtggattttggtttggatttccattccactcyccatcattgagaaggaactgagtcaaaagacccatagtggatcagcagagaccaaccactcaccatggtcataagtaatttcagagcccatagtatctct

SEQ ID NO: 25586 - DNA, 201 bp, Homo sapiens
aataaatgcaattaattagagatttaagtcccacagaggaaagcttctctatggaacaatttgtcttgcattatttctctaatttatcatattgtttagtrcatatttcttgagagcttcctagttgctcagaaatttccgagtactaggattactaaggtgaattccatgtgttttttgtcctcaagaaatatttttatg

SEQ ID NO: 25587 - DNA, 201 bp, Homo sapiens
aggaaagttcatagcattaaatgcctaaaccaaaaatctgaaagagaaccaatagacaacctaaggtcatgcctcatggagctggagaaacaagaacaatygaaacccaaacccagcagaagaaaatgacgaagatcagagcagaactaaatgaaatttaaaaagaaaaaagataaatgaaacaaaagctggttctttgaa

SEQ ID NO: 25588 - DNA, 201 bp, Homo sapiens
aagatacagaatctctgaacagaccagtaacaggcagtgagattgaaatggtaattaaaaaaaattccaaacaaaaaaattccaggaccagatagattcayggctgaattctatcagatgttcaaaaaagaactggtaccaattctactatttcaaaggataaggaaatagagaatcatccctaactcattctatgaagcc

SEQ ID NO: 25589 - DNA, 201 bp, Homo sapiens
gctttagtggctttagaaaccaggaccctatgcatataaatagttgtaataaaaagggaagcagcaacagtgtatagttttcataatttttcaaaatagtwtaaatatgatagcaactttttactcttacagcttagttgtgaaggaggcaaggccagtactcttatactctgggaagctaagacctagagagattaaatg

SEQ ID NO: 25590 - DNA, 201 bp, Homo sapiens
caggacacagttccttgcgtcaaggagctcatagtcaggcaacaatggcttcacatggatagaggcatttaaaccaggccttgaaaagttaggaagtggtaaaaaaaaaaaaagaacaaattagaactcatgaaagtacatagtttgaggagtagaagatgtcttcataaatctagagtaatgggtgagtgaggagggggt

SEQ ID NO: 25591 - DNA, 201 bp, Homo sapiens
agttctcctggataatatcctgcagagtgttttccaacttggttccattctcccggtcactttcaggcacaccaatcagacgtagatttggtcttttcacrtagtcccatatttcttggaggctttgctcgtttctttttattcttttttctctaaacttcccttctcgcttcatttcattcatttcatcttccatcgttg

SEQ ID NO: 25592 - DNA, 201 bp, Homo sapiens
aggacacagttccttgcgtcaaggagctcatagtcaggcaacaatggcttcacatggatagaggcatttaaaccaggccttgaaaagttaggaagtggtaaaaaaaaaaaaagaacaaattagaactcatgaaagtacatagtttgaggagtagaagatgtcttcataaatctagagtaatgggtgagtgaggagggggtg

SEQ ID NO: 25593 - DNA, 201 bp, Homo sapiens
gtttttgttcatttcattaagggttttgagagtcaggttccattaaccagtgtcattccaccattttattctgtgacttcttttggtgctattacatttaraaaattcttcctctctaaaatgtggtaaatatttacctacttagcttttaaaatatattttcatttaattctaaaatgtatttgaaattaatttttatat

SEQ ID NO: 25594 - DNA, 201 bp, Homo sapiens
tgcagatgtaaccagtgttctgagattgttttaaactcactctagaatatgtatataaaaaatggtatcatatagtttttgtgattttgaatttacataastggtattttcttccatattcaggtttatccttttgtttatttcttctatctttttgaggtaaatatttagtctattaattttcagtctttcttattttct

SEQ ID NO: 25595 - DNA, 201 bp, Homo sapiens
atacaatgaaatgaaatgatctgtgccaaatacttgaaacagtgcatggcacatggtaaatggtaaatgttttatttcctccccctttttcttattctgtwtctttctttttcaaaaaatttagatttgtcagaactttgttgatttaaaaactttgtttcccagataataacctcttctgcttatcttttaatctactta

SEQ ID NO: 25596 - DNA, 201 bp, Homo sapiens
aaaagtactgtgtcatttgaaagaagtatattaaaaggccccattaggattgtgattttataaatttctcctttaatttctatcagcttagctctatgtartttggggttttattgctttatacagtttagccaaaagaccttctttatccttaatgatgaattttctctgcaagtctattttatcaaatattaatatcat

SEQ ID NO: 25597 - DNA, 201 bp, Homo sapiens
caagaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaata

SEQ ID NO: 25598 - DNA, 201 bp, Homo sapiens
tctgcattttcaccatgatttgtttagggacactttaaaaaaatatttccttgctcttacttttttttcttcttcaatctgagaactgggagctcttatgttttttttttaattcagtaatgtcataagctattattgcctcaaatattgccttcctgcattctattctgtccttctgtaatccatacagaataaatctat

SEQ ID NO: 25599 - DNA, 201 bp, Homo sapiens
aagaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaataa

SEQ ID NO: 25600 - DNA, 201 bp, Homo sapiens
ataaccctgctggcagagattctaagaaatgtagttctcatgcttccaatccctataatactaaggagagcgtagaaggagaaaatggtgtcaaattgccaaaaaaaagaacctggcatatagaagtagcccaattattaggtgatgacatgccccagtttgtctgggacagtcccaatttattcctgttgacctagagta

SEQ ID NO: 25601 - DNA, 201 bp, Homo sapiens
agaatcacttgaacctgggaggcagaggttgcagtgagccgagatcacgccactgtactccagcatgggcaacagagcaagactccatctcaatgataataataataataataataataataataataataataataatttcttattagtaatttgaaggcattgcttctttgtctttcagcattgactgttcctaataaa

SEQ ID NO: 25602 - DNA, 201 bp, Homo sapiens
aaatccaaatggcaaggtctgatagcagctgaatagttagaattggggctcagataaagatctgagctgaaatttagacttgtgaggtttttttttttttwaaaaaaaaacacttctattttaagtttaggtgtgcaagtacaggtttgttacacaggtaaacttgtgtcatgggggtttgttatacagattatttcatca

SEQ ID NO: 25603 - DNA, 201 bp, Homo sapiens
gataatgtgatattaagtccttaggacttttaaagttgacatagtattataactgttacctccgctaatagcgtcaaaccttgggtctaatcagggctcaktctctttactatttgtgtgaccttcctaaccattttgccattctgtctcccttctgaacatagcaaatataactagcttgctttggccttcaaattaata

SEQ ID NO: 25604 - DNA, 201 bp, Homo sapiens
ttaacactgatgaccttacatggaggatttagtgaaagttatattagaaagcaattcagttacttccagattgttattgaagtccagcctctgtggtctayctatgccattagtatttgtcctaggttatttttgctttcgtatgtcagagaatggtctcaacgtaagggggtctgagtcagggtggtctagttgaaaagg

SEQ ID NO: 25605 - DNA, 201 bp, Homo sapiens
aaggtaagagttacctcctcaaagaagcgggggaaattgtctcttactactctatgacaatgagcaaatcactcaaattctctgactctctcttttggaaraaataacatttactggttgcttttgaggattgaatcagatgagatatagaaaagcccttagcccagtgcttgctaggggaaagatcaatattggttttca

SEQ ID NO: 25606 - DNA, 201 bp, Homo sapiens
ccctctgtcctcttcccaagccgtttttggcactccctagaggaaaccagttctcctctcctcttttacttctgcagtgggcacttgggctccaagtatcttttttttttttttaagttcatcttcatcatcctttaaattaaacacctactcccctgataaatatgatgctctttttaacaattagtctttggatataga

SEQ ID NO: 25607 - DNA, 201 bp, Homo sapiens
cctctgtcctcttcccaagccgtttttggcactccctagaggaaaccagttctcctctcctcttttacttctgcagtgggcacttgggctccaagtatcttttttttttttttaagttcatcttcatcatcctttaaattaaacacctactcccctgataaatatgatgctctttttaacaattagtctttggatatagaa

SEQ ID NO: 25608 - DNA, 201 bp, Homo sapiens
gtcataaagtgagttaggatagcttttcctactttaacctaccctggaatggattatataatgcgggtctcataagtttcttgaaaacgtgaaaggcctaraaccagttttgcaaattatcccttaataacatttgctaaattttccatggctattcagctttcttataatattgaatcaatgttattaattcatatttct

SEQ ID NO: 25609 - DNA, 201 bp, Homo sapiens
aatatttcatccattattcagactattgtcatgatttaacttgtttcatatttggaccattcttgggaaatgttttgggtttaattgccttttttcttgaraaaagaaacacatatctttttaccatattgccaatatcttgcaattgtttaatgctttagtaagtatcactctatttctaggtctgtttcaaagctgtca

SEQ ID NO: 25610 - DNA, 201 bp, Homo sapiens
aattcattttcaccaatgctacctggttaccttgtaactccagagttttttagagaggttttgtatatgattgcttgagctatagctttttccctttttgyaagctattattgaaataaaaacgtaacttacctatttcacggtgtatggatgtttttaagtggaataagttcatgctgttttaacttaggttcaccaaac

SEQ ID NO: 25611 - DNA, 201 bp, Homo sapiens
ttgcagatgaagcatctagccccttacagtcttctcttctccagtgtaatatattctgctgctcttcaagcagtgcatttctagacactggaaaatcctgwcagttcttttctgaccaccgtctcttttccaaactctttcctcaggtgtcctggacggaaacaaaagggagtaaaaaagtgttggatttatttagaataa

SEQ ID NO: 25612 - DNA, 201 bp, Homo sapiens
ttaaggatagtactggaatttcctcatcttcctattgtccacattgcccagcgtgaaattttggcccagtaggaaggctatacatttgttgaattaatttkgatctgtaaggcatattcttccacgaaaaggacattgcacaatcacaatattctccataaacaaatggacactcagaaagaactgttgtgttcttttatc

SEQ ID NO: 25613 - DNA, 201 bp, Homo sapiens
ccccttacagtcttctcttctccagtgtaatatattctgctgctcttcaagcagtgcatttctagacactggaaaatcctgacagttcttttctgaccacygtctcttttccaaactctttcctcaggtgtcctggacggaaacaaaagggagtaaaaaagtgttggatttatttagaataaaaagggagtattacttcac

SEQ ID NO: 25614 - DNA, 201 bp, Homo sapiens
ttagaaaacttaagtttgtggattcatatccaaatattgccctttactgatctagctttttctgctgtaagttctaggaaccttttaattcagagaggggwaaagaaaagagctagcatacactcaatagcttttatgttttggatgcttcataaatatcacctcatttggacccttacaagagctttgggaggcagggag

SEQ ID NO: 25615 - DNA, 201 bp, Homo sapiens
ttcaaaaaatgcacaattgagaaaaaaagtccacttttctttctttttttttaaggttttccacaggttgtgattattcaacacatggctacaatcgactratgagatttaactgatttaatgtatgataatataatctaatgacaagtcaaaataattagggggacagggacaacctcatgagtgttgactttaaaaatc

SEQ ID NO: 25616 - DNA, 201 bp, Homo sapiens
gtctctttgtaaggtcatattcgtaaaggttgcaaaagagaccaaacaatgtattccaattgagaagtccaggtagagtatttggttcatttgtgctgctrtaacagaataccatagactgggtaatttataaagaatagatctttatttctcacagttctggatcctgggaggtcaaaaaacaaggcactggcagcttct

SEQ ID NO: 25617 - DNA, 201 bp, Homo sapiens
ataaatatgttatttggtaatggacttgttttcttaacaattataatatattctttccaaatgctgtaatttaattctgccattgtgctaattagtcagcygatcagccttcagcattgtttcaatatcccacccaccacatttttatattaaagctcatttaattggtgttgtgggttgaattctgttcctccccaaatt

SEQ ID NO: 25618 - DNA, 201 bp, Homo sapiens
caacttttccctcacaggcttaaatttttataaaactgcttctcttagtgtgtcgtgttttttgttgttgtagttgtagttttgtttttagcttcttcttmttagcccaacctccttgtttggctttacagttaacctggcttaggtctccttatctccagtgagccaattttagattctcttatcctgtaggagcagaat

SEQ ID NO: 25619 - DNA, 201 bp, Homo sapiens
agttgatgagtgcaccagaatctcagaaattaccactaaataacttactcatgtaaccaaacaccacctgttccccaaaaacctattgaaataaaaaaaawttttttaaaagaatttgttcctttcctttttttaattacatgtaaaactaggtttatggccatggggcatctgtgactcctcctctttttctttagagat

SEQ ID NO: 25620 - DNA, 201 bp, Homo sapiens
atggggagtggtgttgatcattgttggctagtggccctgaatggagcagggagtaggttcctgaatgggcacaggtaggaatcatgtgggaaatgggcacrtgtgcatctttcaaatccctccatagggctgctgcctactgcttgtattaaaaggcattttatgttgcatctacttgaagatgcctaaatatgctatact

SEQ ID NO: 25621 - DNA, 201 bp, Homo sapiens
gcagtgcatagtaccctaaaccagtgcccgcataagcagtctgtataaaacatgcttatgcttttcagcttcccaagtgaatctttcctagagagaattgtttttttttttgaatgtttgaggtcatcttacaataattatgcataatcagtaatggaaacaatttaaagagtttacactatgtgcccggaatatgatcat

SEQ ID NO: 25622 - DNA, 201 bp, Homo sapiens
ataattttttcaagcggagagattagttgtggtcacagtagaaaatttttcataattctccaagtactataaaaagtaacttgatggcataaagtgaattsccatgatgagagtcatcctgtcactgtgaattgctgtgatcatctttaaagtgatatatctttccacactgtctgtcagcaactatgtagggtttgtttt

SEQ ID NO: 25623 - DNA, 201 bp, Homo sapiens
gtgaggtgggtcaagggagaaatagaggttattaaggagtataggtaggtattgaagaagagcctcattttatacacatacagacacatgcacacatatayacctatatatactctctctccatatatacatatatttatatttatgcacatgtaaatacatatatgtaatttatatttattttcccccaatactcctcat

SEQ ID NO: 25624 - DNA, 201 bp, Homo sapiens
ggctccttggctgacatgctgaaggatatgtcttcacattcttaaactccaaacctcccttggaaataatttcctaacagtgaaactgccctaataatgcygtagtttgtttccaggggagaatatttgccttcagagcaggctccttctgccagctttccatttcataaatgcattttatgactccctcttcagagctca

SEQ ID NO: 25625 - DNA, 201 bp, Homo sapiens
gttgcttgttggagatgcattacttttttataatacatgattcaagtacaaacagttgtttttcctcacacagcttgatcttcacaaaaaataaaatttawaaaaccattttggtaaatgtaaatttgtaaaaggaggttttggtacttgtacttgatttaccatcattttctttaaaattgtactgttgtttaacttctc

SEQ ID NO: 25626 - DNA, 201 bp, Homo sapiens
aatagaaataatgaaaatctatagaagtaagaaaaccctggggcctggcatttgtctgctaatccctgtttgcctagagcatgggttttaatgagcagtgrgtgcatctaggacaagtacaaaacttggggccactagtgtactttataagatattgattaactttagacttattaagatgaatatgtaacctataatttc

SEQ ID NO: 25627 - DNA, 201 bp, Homo sapiens
gagaagcagaagcagatcatgatggcagaccagaagcaagactagattgcagctgtcactcggatggacagaacagtgtgtggagacttgcattgtgaacttttactcaacaatgactgcaggaatacattaggaaagccaagagaacccatagaccctctgaaggaagcagattactcctgcaggacctgggagacaccc

SEQ ID NO: 25628 - DNA, 201 bp, Homo sapiens
aacaactactaaataatagaaagtatccaaaaaatgaaagtcatcattttttctttttcttcaaattattaataaaactgacaaactgcaagcaagatttaaaaaaaaaacagagaagacactgataatcaacatcaagaatgaaaaagagggcatcactatagatgctgcagacatcaactaaaattaaaaacaggatat

SEQ ID NO: 25629 - DNA, 201 bp, Homo sapiens
agcagtgtctgtcaaaatactccactaagaattcttcctcttttatccccaggagccagtctacttgatgacttatacaagtatttcttcttccatcactcccacggagacaccatgactgtcatggatccaaagcagatgaatgttgctgctgctgtttgggctgttgtttcttatgttgttgcagacatggaagaaatg

SEQ ID NO: 25630 - DNA, 201 bp, Homo sapiens
actaaatgaaattgaaacaagaaaatacaaaagataaatgaaacaaaaagctggttttttggaaagatagataaaattgatagaccattagcaagattaamcaaggaaagaagagagaaaagcaacataagctcaattagaaatgaaagggacatattacaactgacaccacagaaatgcaaaaggtcattcaagggtact

SEQ ID NO: 25631 - DNA, 201 bp, Homo sapiens
tcttacatcctctttggatttccgcatagattttgcaagccgtaaatacaaaatttgtctagagttcatagttggttctgtttactggatttttttttttytttttttttttgagacagggtctggctctgttgcccatggtggaatgcagtggtgcaatattgactctgtgcagccttcgcctcctgggctcaaacaatt

SEQ ID NO: 25632 - DNA, 201 bp, Homo sapiens
actcctccagaaagctcctagaactgatacaagaattcagaaaagtttccggatacaaaattaacgtacagaaatcagtaggtcttctatataccaatagygaccaaactgagaatcaaatcaagaactcaaccccttttaaaatagctgcaaaaagataatataataaaatacttaggaatatacctaaccaaggatgtg

SEQ ID NO: 25633 - DNA, 201 bp, Homo sapiens
gattctaataaaagtagacacagttctggtacactactatgtggttatttccagaaatataaatgagtgttattttatatatatatattatatatatatawaatatataatatgtacatatatagtattgaaccgacagtaggtacttatgccttctaaaaatgtagtagtaagtgaacataggcaggcaatataggaggt

SEQ ID NO: 25634 - DNA, 201 bp, Homo sapiens
acgtttatagcagcacaatttgcaattccaaaaacatatatatatactgtatatagtatatatatacagtatatatatactatatatagtatatatatacagtatatatacagtatatatatacagtatatatacagtatatatactgtatatatagaaactgtagtgtatatatatacactatgtatatactatatatat

SEQ ID NO: 25635 - DNA, 201 bp, Homo sapiens
atttggaatgtaggagagttcttagtacacagattgtcccccacatagctgtctgtctagtgtccccggcctctgccaactagttaccagtagaatctccataccatggtgacaagtaaaagtgctccccccacatattcaaaatggcccctaggggcagcatcatccatattaaaaacaactggcttagattaatgggac

SEQ ID NO: 25636 - DNA, 201 bp, Homo sapiens
cgtttatagcagcacaatttgcaattccaaaaacatatatatatactgtatatagtatatatatacagtatatatatactatatatagtatatatatacagtatatatacagtatatatatacagtatatatacagtatatatactgtatatatagaaactgtagtgtatatatatacactatgtatatactatatatata

SEQ ID NO: 25637 - DNA, 201 bp, Homo sapiens
cttactgttctcatcaagacttggtaaattttcttggatgaatgttgtcctttgctgtatgcccttaggggagttttgagagacattaaattattttttawataatttttcccactaaatattttgtggggtgaagatctgctgagttactcatgctgccatgctggaagaatcactgggatagccagttttgatctctct

SEQ ID NO: 25638 - DNA, 201 bp, Homo sapiens; identical to SEQ ID NO: 5635

SEQ ID NO: 25639 - DNA, 201 bp, Homo sapiens
gcagcacaatttgcaattccaaaaacatatatatatactgtatatagtatatatatacagtatatatatactatatatagtatatatatacagtatatatacagtatatatatacagtatatatacagtatatatactgtatatatagaaactgtagtgtatatatatacactatgtatatactatatatatacacactat

SEQ ID NO: 25640 - DNA, 201 bp, Homo sapiens
ttgcttattatagaaagcatgtacataaatataaaaataataaaaatcacctgtattggtccattttcacgctgcttataaagacatacccaagactgggcaatttacaaaagaaagaggtttattagacttacagttccacgtggcttgagaggcctcacaatcgtggcagaaagtgaaaggcatatctcacatggtggc

SEQ ID NO: 25641 - DNA, 201 bp, Homo sapiens
cagcacaatttgcaattccaaaaacatatatatatactgtatatagtatatatatacagtatatatatactatatatagtatatatatacagtatatatahagtatatatatacagtatatatacagtatatatactgtatatatagaaactgtagtgtatatatatacactatgtatatactatatatatacacactata

SEQ ID NO: 25642 - DNA, 201 bp, Homo sapiens
tgtattggtccattttcacgctgcttataaagacatacccaagactgggcaatttacaaaagaaagaggtttattagacttacagttccacgtggcttgaraggcctcacaatcgtggcagaaagtgaaaggcatatctcacatggtggcagacaagagaagagagcttgtgcagggaactcccctttttaaaaccatgag

SEQ ID NO: 25643 - DNA, 201 bp, Homo sapiens
acagtatatatatacagtatatatacagtatatatactgtatatatagaaactgtagtgtatatatatacactatgtatatactatatatatacacactatatatatatatactatatatgttactcaaccataaaaacgaatgaattaatggcattcgcagtgacctggatgagactggagactattattctaagtgaag

SEQ ID NO: 25644 - DNA, 201 bp, Homo sapiens
cagtatatatatacagtatatatacagtatatatactgtatatatagaaactgtagtgtatatatatacactatgtatatactatatatatacacactatatatatatatactatatatgttactcaaccataaaaacgaatgaattaatggcattcgcagtgacctggatgagactggagactattattctaagtgaagt

SEQ ID NO: 25645 - DNA, 201 bp, Homo sapiens
ttttttaaaagcaaataggacaaagagacttgcgatgaataggctaatgattttgtaccatgaattgaggcacataattaactgaacactctgaatttgatttttttttttttttttgagacagggtctcactctgtcaccctggctggagtgcagtggcatgatcttggctcactgcaacctctgactcatgggttaaac

SEQ ID NO: 25646 - DNA, 201 bp, Homo sapiens
ctgtagccacagtcttctggactcaagtatcctcctacctcagtccaccttcccctctccagtagctgggactatagacgtgcaccactacacccggctattttttttttttcaatagagatgagttctcactacattgtacaggctggtcttgaactcctggcctcaattgatcctccctccttgacttcccaaagtgct

SEQ ID NO: 25647 - DNA, 201 bp, Homo sapiens
ggtgacatcttagagcctcacactactcccttcctcaacttatttatttattggaaaatataataaaattgagataatttttacctttaacataaaagttyggctctaaaaaatgtttggcaaagcagaaactctaagtactaatgaggatatgagttgctcctacagccactttagagagctactaaatgcaaataagca

SEQ ID NO: 25648 - DNA, 201 bp, Homo sapiens
gctggggagcggcgggttgggagcctgtggctgccccttcggtgacagtggagtcaccgagcctagaaatggggaagctgtgacgtgggggtggtggaggrtgctgcgggacagcagcgagcacggccctcagccgtccttcccaacacggtttcacttcccctcagctccagggctcagccccaagccgcccccttcatc

SEQ ID NO: 25649 - DNA, 201 bp, Homo sapiens
catgctgtcaaaagcatatcacatttctccactgctatttccttccttcttaactaaaaacaaaacaaaacaccatagacaacaaatagacacacacacamaaaaaaagacactaggtgagagtgaaggtagtttgtactattttcatttttcgtgtgttcaatcgtatttctctcagcaaatatgattggaagtggtgct

SEQ ID NO: 25650 - DNA, 201 bp, Homo sapiens
gaacagctggcaatttaaaaagcagagacttgctaagggggaaggaggtaaagaagatcaaacagaaatgcctccccctttagtgaagtatgaactgaggrtgctgcatagtagcaataaaatcagattcttaaatgctttcccttgtttagtgtgtatatgtgcttatttttatttagtcttcaaagatgactttcctta

SEQ ID NO: 25651 - DNA, 201 bp, Homo sapiens
atttatggagattaaaattcataaattgttatagagttaaaacagatgaaataatgcttctttgacagaccatttagttttttctttcatctttaaacaaygctgcactaaaatttgtctgtaatggcataaaaaaaaccctgatatttgccttttcttctccattccccatgcttgtcaatcgttacagagattatgctc

SEQ ID NO: 25652 - DNA, 201 bp, Homo sapiens
ggaagtcacaggcagacagtgtagaacatcagaggtatcctagctgtggaaaagaagctttcatcattggctgaggactgatccctggcacattatcttcygcacttccaggctgctcctgaagcaggctgagaaagccctggggagactgcataggatggcctacctctagtgagaaacactgagtgccacactggttgt

SEQ ID NO: 25653 - DNA, 201 bp, Homo sapiens
tgaaatagtcctcagctctgggtcaaactctctggcttctattttcaggccctgccacttgggcaaacattccttctctgtggaaaagtagaatgttggcyacaatctcctaaagtcattctagctttgatagggtgtgattgtaggagcctgcaaaggaatctagaatcattgtaggtttcctaatgtctgtagctctat

SEQ ID NO: 25654 - DNA, 201 bp, Homo sapiens
ataaaatcatgaatggggactttgtgagtcacttaacatttgcaagaagcatatgaacgtgattgttcttttagagtttgttaggtgggtggtggtaaagyaatacaattttctaaatggtaaaatcatgaatctcatgcatgtcaaaaaatttattcaattcattaattaatgagaatatcagtaagatgttacaccatt

SEQ ID NO: 25655 - DNA, 201 bp, Homo sapiens
cttcacagagcattcaatcatggcagaaggcaaagggggagtgaggtgtcttagatggcaggagcaggagcaaaggggaggggagatgccacacacttttmaacaaccagatctcatgagaactcgctaacacaagaacagcaccagggggatggtgctaaatcattcatgagaaacagcctgtataatccaatcacctct

SEQ ID NO: 25656 - DNA, 201 bp, Homo sapiens
attctcaagaaatgctagctaatattgaaatatgaaataatacttctttggtccaaagatgtttaagcattcctatttggtaaagagaaggagcaaaagamcaagagaaaaattagataattggtacagtatgaacagagtatttggctttggaaaggagggtgggcagttctttcactgggacaggagctcagaatgact

SEQ ID NO: 25657 - DNA, 201 bp, Homo sapiens
cagactccacagccaatgcctttctgtaccctacaccgtccatcatggatttaggtagcctggggacctgaactccccactaggtttaaggtctaattctygaatgaaacctcacgcatttctcttaggttcagggacaatcagattgtcagagtagaaagagactttggattcaacatttgctaacccactggcttccta

SEQ ID NO: 25658 - DNA, 201 bp, Homo sapiens
ttttctatgtgttgtggtagaccacaacatcatataagggttgttctagattcagcaacattcaattaatattttctgaacatgtactatgttccatacaytatgttatgcattaatgttagcatcaaaaagatctaccctgaccttacaaagcctacattctaaaggacactgacgattaacttgaattataaggtgtta

SEQ ID NO: 25659 - DNA, 201 bp, Homo sapiens
atcctcgaggcaagagagtaacttatttttaagaagaagctctaaaattctatacatattggactttatataaaaaaaagaatagttaaaagaactattctttttttttttttttttgagatggagtctcactttgttgcccaggctggagtggagtggcaccatcttggctcactgcaacctccgcctcctgggttcaag

SEQ ID NO: 25660 - DNA, 201 bp, Homo sapiens
accaacaacatgtgggagtcctagttgctccctatctttcccagtatgtggtatcattagcctttttatttttagccattcttataggtgttatgtgtttwtatttttcaaagtacagttctgaagagttacaagaaaaatcctgactcctctcctaatggccactattcttttgccctccctgcttcttcttgccttaag

SEQ ID NO: 25661 - DNA, 201 bp, Homo sapiens
tataataggcctcattatggtacatatgataaattatcttgtccaattaatttatgccactttagactaaggactgtcatatatatacatatatatacachcatatatatacacacatacatatatatgcacatatatatatatagtttctttaggtcttaccaaagtattaaatactttttgaacaaataacgtattttg

SEQ ID NO: 25662 - DNA, 201 bp, Homo sapiens
ctaatctgcttttcatgggaataatgttgctgtcttctcttctcttctcttggaaggagaacaggatgtcatttctcatgtcctgaaatggacaaaggagaaaaaacatacctagcttcaactggatttctggcatttgttaatcttttccattttaaggaaaaatatgatctggcataattataatgagtaaggtaatct

SEQ ID NO: 25663 - DNA, 201 bp, Homo sapiens
ctcccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttg

SEQ ID NO: 25664 - DNA, 201 bp, Homo sapiens
tactaacctaagtaaaacaattgccttttaaagttactcctaagaatgttgtgccaaaactttgaggtttcttgtcaattatttggctggcatttattctyccctcctgaaaccgtgaagaatggcttcagcttgtatctagtctgttttaccagcttacaggagagtgccttctggcacaaatagtttctgcctcagtgc

SEQ ID NO: 25665 - DNA, 201 bp, Homo sapiens
cccttctctctgaaaagcatttcacctctatgggagtgggtgatactggatttcatctaaaaatattatagaggtcagcaacactagagaacattatattatatatatatatatatattatgatttgttgctgttggattcaaaatttgagaatcccctggagggtagtttgatttgaccagtttgattggacactttgtg

SEQ ID NO: 25666 - DNA, 201 bp, Homo sapiens
attatgatgttagctggttattttgatcgttagttgatgcagtttcttcctagcctcgatggtctttacaatttggcatgattttgcagtggctgctaccrgttgttcctttccatgtttagtgcttccttcaggagctcttttagggcaggcctggtggtgacaaaatctctcatttgcttgtctgtaaagtattttatt

SEQ ID NO: 25667 - DNA, 201 bp, Homo sapiens
tgggtttttggtgtggatgtcctttctgtttgttagttttccttctaacagacaggaccctcagctgcaggtctgttggagtttgctagaggtccactccygaccctgtttgcctgggtatcagcagcggtggctgcagaacagcggattttcgtgaactgcgaatgctgctgtctgatccttcctctggaatttttgtct

SEQ ID NO: 25668 - DNA, 201 bp, Homo sapiens
ttgagggttttctttttttgtttcattttgtttttgtttttctgaggcagagttttgctcttgttgcccaggctgcagtgcaaatggcatgagttcggctmactgctacctccgcctcccgggttcaagcgattctccggtctcagcctcctgagtggctgggattacaggcacccgccaccacgtccagctaattttttg

SEQ ID NO: 25669 - DNA, 201 bp, Homo sapiens
gcagcggtggctgcagaacagcggattttcgtgaactgcgaatgctgctgtctgatccttcctctggaatttttgtctcagaggagtacccggctgtgtgwggtgtcagtctgcccctactggggggtgcctcccagttaggctgctggggggtcaggggtcagggacccacttgaggaggcagtctgcccattctcagat

SEQ ID NO: 25670 - DNA, 201 bp, Homo sapiens
cagcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgt

SEQ ID NO: 25671 - DNA, 201 bp, Homo sapiens
gctccttgagctgtggtgggctccacccagttcgagcttcccggctgctttttttacctaagcaagcctgggcaatggtgggcgcccctcccccagcctcrctgccgccttgcagtttgatctcagactgctgtgctagcaatcagtgagactccgtgggcatagtaccttccaagccatgtgcgggatataatctcctgg

SEQ ID NO: 25672 - DNA, 201 bp, Homo sapiens
agcaattgcttctgagtttctgcagactgatatttgttttccttttttttttttttttttaaactatgcagctctgatgttgaggagtatgaaaagagcttttttttttttttttttttgcaagagaaataaggatctcaatataggtttgcagaggccagcagggatgtatctttaggatgggtttacctcatatctgtg

SEQ ID NO: 25673 - DNA, 201 bp, Homo sapiens
gtatttaaaatactgctcattgcaatccttttgaaaagagattctgatgctcgtaaatactccaaaaaggcattaaggtgttacactgatttttatttttwttttattttattttatttatttatttatttatttatttatttatttatttattgagatgcagttttgctcttgttgcccaggctagagtgcagcagtgag

SEQ ID NO: 25674 - DNA, 201 bp, Homo sapiens
ctcattgcaatccttttgaaaagagattctgatgctcgtaaatactccaaaaaggcattaaggtgttacactgatttttatttttattttattttattttwtttatttatttatttatttatttatttatttatttattgagatgcagttttgctcttgttgcccaggctagagtgcagcagtgagatcttggctcaccac

SEQ ID NO: 25675 - DNA, 201 bp, Homo sapiens
gggggggttggtaaaattatcaaaaacagatgacagctgagaaggcctcaatggaggagtctgacaggcaaagaggagagaacacacctggtggagggagmaaggacacccatttggattatactctatttaggagactatacagcaggtaacactgacttagccctatcactgctaccaccacttctttctctccttccc

SEQ ID NO: 25676 - DNA, 201 bp, Homo sapiens
tttattactacctcaatttcagaactcattattgttctattcagagatccagtttattcctggttcagtcttgggagggtgtatgtatccaggaatttatycatttcttctagattttttagtttatgcgcatagaaggttcataatattctctgatggttgtttgtatttctgtggagtcaggggtaatatcccccttat

SEQ ID NO: 25677 - DNA, 201 bp, Homo sapiens
atgtcagtattttttaacactatcagacaatgagaatattcctggccaggtccacttagtgatttcttcattgaaggatacaatttagaagattggaggarcaattataaaagaaagtaatacaatttagaagattgggggagcaattataaaggaaagtagctgtaggtctccaaaagttaaagtcccttaatcccagtt

SEQ ID NO: 25678 - DNA, 201 bp, Homo sapiens
tcaaataatatttttgaatgcataaaataaaatgcatagtattacaaggatatgaattttattaaaatatagttaccaaaaattttaagctaaatttgcartatagttatatatgtggttttccaaatgaattaaacaagatcttgaaggattatttaattatgactatgatatcaaagtaatgatgaacataaagaatac

SEQ ID NO: 25679 - DNA, 201 bp, Homo sapiens
attgcttgagcctgggaagccaaagctgcagtgagccaagatcatgccactgcactccaggcttggtgacagagtgagaccctatctcaaaacacacacayacacacacacacacacacacaaattgtgttgttcaagtcagtgactttgtggtaatttgtgacagcagcaataggaaactaatacacaattagacatcta

SEQ ID NO: 25680 - DNA, 201 bp, Homo sapiens
gaatagtgcagcagcttttagtcattcttttacaactgctgtacacattgcagccagaaaagacattttagttgtcaggtagtcaataaatatttattacmtgcttcctgtatactggttctccactgggaactgttcctaaaggtttgttttcttgttacttttcttgtccctgtgttcctcataactcaaaactgctga

SEQ ID NO: 25681 - DNA, 201 bp, Homo sapiens
gacattgcaaacattggactgcctgaaaacataggtttgtctcagaacagaatacctctgtgcacacacacagaatgataggtctggaaagggatctccartggctactcattctgttcctgtctccaggtacgatggtggctaaaccatagtaggagtgcagtgacaagatggttagatccacagaggctcctgcatgtg

SEQ ID NO: 25682 - DNA, 201 bp, Homo sapiens
attacaagagtttaacacattttctaagacaccaagtgagtaatgtagatactgaggagatattcagtagaaaaagccaaatcactaataatagcatattytcaatatacaggcaatttctcagttgaaaagcttagctattattgctatggccatggcttcaaagctgtgaggttcgctttttatttatattggcaattt

SEQ ID NO: 25683 - DNA, 201 bp, Homo sapiens
aaccctgagcagatattaactaatcctatgatctgaccataagaggttaccttggagcattcctctacattgcattatgtatattacatggtaatgaatgwcagttttcatggctcctaataatgagcagcttctctttatttagagaacaaaatagggggtttacagataatatctgagtttatcattgagctgctcagc

SEQ ID NO: 25684 - DNA, 201 bp, Homo sapiens
tggtgaaggtgagggtaaagggaagaagagttgaggctgaattaatgagcttatttcttttgcatatggcatgtaggagaggaaaaggattcctaggtttmtcatagtcaagaatgtactgattatatgcatttgcttcattaatgaatacagtgctattttgtttagtgtttcaggaaatgctttgattccagcattgtt

SEQ ID NO: 25685 - DNA, 201 bp, Homo sapiens
tcagatatttgtaggtgttcagccttatttctgggctccctactctgttccattggtcttgtgtctatttttgtaccaataccatgctgttttgattaccrtaatcctgtagtataatttgaagttgggtaacgtgatgcctccagctttgttcttcttgcttaggattgccttggctatttgggctattttggggttcca

SEQ ID NO: 25686 - DNA, 201 bp, Homo sapiens
tttggatgatttgacttacccttcctttttaaaattcagactctaaatttaaggctatacatcaccatagtgtttatgaagtgaattaaatcttacagaaygttccagtgcaatctgaaactacagcaactacttgaggttttatgtctgaaaagtgttttaatcagtgatggatttggaattattgcagctgattcctga

SEQ ID NO: 25687 - DNA, 201 bp, Homo sapiens
gatatagaagaatatacaaaatatgggtggtgatgatcataactaccatttataaaccacatgttgtctgtcaggcacagtacagtgctttatatatatatttttttggtatgattatcagaaggaatataaagattaaaaggtgctgcattacttaaataggttcccttaaacctggaaagaataaaatcctggtcacaa

SEQ ID NO: 25688 - DNA, 201 bp, Homo sapiens
gaaattctagattttttctgagcctgaaatatttcaacaagaacttcttaaaaattgagaaaccctgaataagctgctgtgtggtagctgtgaggaaaagmctggtagactgtgggtgaatgagagtgcagacggggggtggttcaaggtgaggtaaggagctgaaacctaagacagaattgggaacaaaaacttgtccct

SEQ ID NO: 25689 - DNA, 201 bp, Homo sapiens
atatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagttt

SEQ ID NO: 25690 - DNA, 201 bp, Homo sapiens
caaatgctgaataagcaggatccatgtctgtaggaagagtaagataatgccaatgaggtttattaactataatgcaagacacaactgtaagttatgattamtttagtaacgacatcactcattgagctgtcctctttcattgcatattgtgttgttttaaaaatcatattttagtttatgtcatcttttctataatagttc

SEQ ID NO: 25691 - DNA, 201 bp, Homo sapiens
tatctttctaataatttgccacaggtgctcaaatgcctgggagctagaatttcaaggattcaaattgctactgtgatagcttcaggctttgcttccaggtttttttttttttttttttttttttaagcaggctgtggcacatgtttttaagaatttaagtctgtttattggtgatgctgcagtttgcttgattacagttta

SEQ ID NO: 25692 - DNA, 201 bp, Homo sapiens
ggttagcttaataatcgtgaagataagaataaagacttcatcacagaaaactaaataaagctacattaaaatttctaagaaaaatatctaaaattacttgaaaagccagtggagtataaagaagaaggatttcaaaatatgttttctccttgtcagccatgtgagatttttctctctctgctttaaataattaggaaatgt

SEQ ID NO: 25693 - DNA, 201 bp, Homo sapiens
atgaattacatggattgcttagttaatttaattttcagattactctttgctattgttttgcttttgcatcgttcattgctgctgcacaattgatttttgtrtgctgatcttttatctgctaaccttgatgaacttcttaattagttctaatcgttttgtgtgtgtatgtgtgttccttaggattttctatatgtaagatca

SEQ ID NO: 25694 - DNA, 201 bp, Homo sapiens
tgttgaatcccagacatcacgtaaggtaatatgaataataaatatttagattgtcttcctacatgttgcaaggtaatttttggtcattaatcactccactrgctcagtgggaaaaattaacaccaaagaagtaataacaactaatttttactaagtaattactatgtgccaaacactgtcttaaatcctttatgtatacta

SEQ ID NO: 25695 - DNA, 201 bp, Homo sapiens
ccacacctggctaatttttctgtatttttagtagagatggggtttccccatgttggccaggatggtcttgatatcttgacctcatgatccacctgcctcagcctcccaatgtgctgggactacaggcatgagccaccatgcccggcttgcagtctactttttagaaatgttcatagagggtatactcagatggtactaatc

SEQ ID NO: 25696 - DNA, 201 bp, Homo sapiens
tacagaaatagttcattgattattataaatatcatgtttgaaaaacttttaaaaatgaagttacacacagatattgtttaatacctttagcactatactgygaagtgcactgcagaaataaagccattgtttatttagatgggtcagtgattccagactcactactcctcacacaagattttatctgagataccctgatca

SEQ ID NO: 25697 - DNA, 201 bp, Homo sapiens
tgctgtgagggacagtccctcctggtccattgagtccctggatgccagaacattaagaatacagaaaataagagaatatagttaatacattgtataccaaygccaggaaagattctgatttgccttacttgagtcattccagctctgtagtttaggtgcagagtacagggtgaggaatggtattgtgattgacagtcaacc

SEQ ID NO: 25698 - DNA, 201 bp, Homo sapiens
aaggcatagcaagttgtcaggctgcagataatattttaaggaaggagcgaacagaatctgatggtggattgcatatggagtatgagagaaatagaggagtyaagcataaactgacagtttggggcccaaacaactgaaatgaggggagttaggcagggggaaaagggggagataaggagtatgggtttgaacctgttaagt

SEQ ID NO: 25699 - DNA, 201 bp, Homo sapiens
aacaagccagacgtggtggtgcacatctgtaatcccagctacttgggaggctgaggcagaaggattgcgtgagcccagggtttgtgatcagcctgagcaaygtagcaagaccccatttcaaaaaaattagaaaaattgtgcttaagtagccttttggtcctgatttgcttgagagtccagcttgtacccattgtcctgaca

SEQ ID NO: 25700 - DNA, 201 bp, Homo sapiens
atcagattatgaattgcagtgaaataaacttacttttatttttaaaatacaaccaccattaacagctccccagttagaacaactgaatgtcaaataattgyattctcaaatttaaactagaaaatagtagagcttgaggaaggggagtggaaactcaatagtgacacattgagatgggttagaaggtattcagttctccat

SEQ ID NO: 25701 - DNA, 201 bp, Homo sapiens
tcctgccctagatctgaaatcagctatctcttcaaagaatccaatttattttcctaggtcatagtatttagaggccacagtctgaacagtaagtgtgtgtrttgctactggattgttcattgtttctaggtcttttcagcagacaggactaggaaacactttttttctccaacatgaaattatattactaattatatgata

SEQ ID NO: 25702 - DNA, 201 bp, Homo sapiens
tctttttgtttttagtatgtatattctactagagatgtacaaatttctgttaacctatgatgcatattactctaaatatgatatcatttccatttctctcyctctctctctctctctctctctctctctctctctctccctctctccttttttagagatgggatctcacccaggctggagtgcaaaagtacattcatagct

SEQ ID NO: 25703 - DNA, 201 bp, Homo sapiens
ctttttgtttttagtatgtatattctactagagatgtacaaatttctgttaacctatgatgcatattactctaaatatgatatcatttccatttctctctctctctctctctctctctctctctctctctctctctccctctctccttttttagagatgggatctcacccaggctggagtgcaaaagtacattcatagctc

SEQ ID NO: 25704 - DNA, 201 bp, Homo sapiens
ccagttagcaataagcccagatttgaacccaagcagtcttgttccagaccttctgtttttaacaattctacattgcagtttctctaagtaaatagtcaccygaaatatggctacaacaatacagtcacaccaagaatgtagttagagataagaatgcatcattgtgtttgtgcatgtggagactggagctgcttctatagg

SEQ ID NO: 25705 - DNA, 201 bp, Homo sapiens
gaagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacat

SEQ ID NO: 25706 - DNA, 201 bp, Homo sapiens
ggtgcccatcaatggtgggctggctaaaaaacaaatatatggtcatatatatatatatatatatatatatatatatatatatatatatatatatatacatmccatggaatactacccagccatagaaaagaatgaaatcatgtcctttgcagcaagatgggcacaactgaaggccattatcctaagtgaattaatacagaa

SEQ ID NO: 25707 - DNA, 201 bp, Homo sapiens
aagtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatc

SEQ ID NO: 25708 - DNA, 201 bp, Homo sapiens
tattgtgttaattatcttatttaatcctttcaaagcttagtgaatttgcatatattttctgtattagtccattctcacattgctataaagaaatacctaaractgggtaatttataagaaaagaggtttaattggttcacagttctgcaggctgtacaggaagcatggcggcatctgcttctgggaaggcttcacagagca

SEQ ID NO: 25709 - DNA, 201 bp, Homo sapiens
agtctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatca

SEQ ID NO: 25710 - DNA, 201 bp, Homo sapiens
tcagacaacattcaagagcctactgaaatggcaccttccctgagaagcctctcttaattacacacccatatacaatgtttctctcttcagaacttccatakgtctcttttttatgctttccataaaatttgtcacaaatcccataccttatttatgtgcatataggagcatctaatgggaactcaaaattgctttaaagaa

SEQ ID NO: 25711 - DNA, 201 bp, Homo sapiens
tctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcaca

SEQ ID NO: 25712 - DNA, 201 bp, Homo sapiens
ttatttatgtgcatataggagcatctaatgggaactcaaaattgctttaaagaacataaatgaatgaatgaacatgaatgagctaatgaatgaaagaaaarttatgccttctgcaccagcagaagctaatgactaaaataaaatggttaaactggactagaaatttaagattgttatgggtttctagtctaggaaacaccc

SEQ ID NO: 25713 - DNA, 201 bp, Homo sapiens
ctcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaa

SEQ ID NO: 25714 - DNA, 201 bp, Homo sapiens
aaagaattatggtgaattgtgttttttaaaaatagacttctagggcagagtaggggaaaaacatagggaaccgttaattaaggtatcagggcttgagaacktttttgtctgcccaagacccttcctttggaaacagcacctctcccaacatttgtgctcctagtggactggtaacttgcactcctaagaactggaatcttg

SEQ ID NO: 25715 - DNA, 201 bp, Homo sapiens
tcagatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaat

SEQ ID NO: 25716 - DNA, 201 bp, Homo sapiens
cacaggtttttaacatttttactgatggttcccaaggctccacctgtcccttcattctattctatactgcctctttattggatttctcccccactgcaacktgtgtgtgtgtgtgtgtgtgtgtgtgtgtgtgtgtctgtgtgtgtgaggagagagagacgagagagagaggagagagggagaagagagagagaagagaga

SEQ ID NO: 25717 - DNA, 201 bp, Homo sapiens
cacagtttcctctgaaacttcccctttaggagggatggaaaccacaggatgggcattctggtaaatgctcaacatagatacctatggactgggtagcaggygacccctaggaaaacctcaaatatcctataaggtcctaataagggccagttattctaagcaaaggagcttctgtgagtcatagtgcaatccatagatatg

SEQ ID NO: 25718 - DNA, 201 bp, Homo sapiens
agatgtgagcaaataaagtctgactctaattagacatacttaatctgctcgttgaaacttggagtcaaataagtcttagagtgacatttcagtcttagagtaacatttcactgatttcttataagagctttgctaaaaaatatgcttatcaatttaatcaattataggattctagaaatcacaggaaaaacatcacaatta

SEQ ID NO: 25719 - DNA, 201 bp, Homo sapiens
taacctacacagtacatgactagaagcactttgcctgattttcttgttggaagaatgggatctgcctgcaatatggaaaccctcacaaacaagatgactcrattctgttttcatttgcaagatatattgtgaatgttcttttctcctttttgcaggagagggaaagggtttagggttgtgggtgtggcagggcatagaagg

SEQ ID NO: 25720 - DNA, 201 bp, Homo sapiens
taatattttagcgatccacgtgctttttacccaccagaaggttcccctgggtaagtaaagaggtggagcaggagagagcaggtttgcaccgaaagtagttmcaaaacaaaacaaaacatataagacatcaaccacaagaagcccttgctccaaaatgcaaatgacttatttgctacttcaaaaatgcacctcatcaatgaa

SEQ ID NO: 25721 - DNA, 201 bp, Homo sapiens
gcccagaagcagcatcgttcataaggtaagggcacaggctgtagtatcggccagacctttggtcgagttctggctgtgcagcttgactgtgtgatgtcaartaagttctcagagcctccctttccccatctgtaaagtgatgataacggtgcccacccattagctggtgctgtgaggatcggatgagctaccgcatgcaaa

SEQ ID NO: 25722 - DNA, 201 bp, Homo sapiens
aaaataaaatttctgttttaatagagcacaatgaatactagtaggccaggttgtccacggaaaccttaagcttttgttcaaggtataatctgatgatttcyaaaactgggataatagtcctcaccttgtatttgtttacccatctgtatccctccactctttctaaattataagctcctcactcccagagattctgattta

SEQ ID NO: 25723 - DNA, 201 bp, Homo sapiens
ctccacctcctggccttaagcaatcttcctgtctcagcctcccgagtagctgggattatgagtgtgcaccaccatgcctggctaacttttgtattttttayagagacagagtttcgccatgttgcccaggctggtctccaactcctgggctcaagtgatctgcctgccttggcttcccaaaatgctgggattataggcatg

SEQ ID NO: 25724 - DNA, 201 bp, Homo sapiens
atcctgaacctacttctcttcttcctgacttccagacccttgacccttccccacccttcactggccctgctccatcccattcctgcttctagccataatcmatttcaagggtgttcttaatagctacggtgcactttcattctccatgctctgctagtttcccacattggcaatgatctccactgttggtctatgccatac

SEQ ID NO: 25725 - DNA, 201 bp, Homo sapiens
atccatttcaagggtgttcttaatagctacggtgcactttcattctccatgctctgctagtttcccacattggcaatgatctccactgttggtctatgccrtacaactcagaattgcttcattcatctcaggcaaaccccctttcagattctctatagtgctgtgttctgaacccttaacatgctcttgagaccacagttc

SEQ ID NO: 25726 - DNA, 201 bp, Homo sapiens
cctgagctcagtgttaaaaaccaaactggagttttaggcatcatttaggttttctgattctcttggtgaggtaccagtgttttcctcaatgcctacctcaraaaccttagctttgactcccttcctttcccttctatcaagtcatttatcttcttctgaaatagctcccagatttacttcttccttactcatattagctgt

SEQ ID NO: 25727 - DNA, 201 bp, Homo sapiens
aatcctgctacaatgagttttaaaaaaataaccaacaacacttcacttcagtcatctgtgtaattttcctttagtttggggcattttctaggtaaagtttyagctaaacaatacagaaaaattaaaaagttcagagatcttttaatgatatgaaaaactgtttctaataataataaatgttaaaatcatttcactattcaa

SEQ ID NO: 25728 - DNA, 201 bp, Homo sapiens
atgctttttatccattcagcttgattatatcttttaagtgaagactttaatctgtttacattcaaggttattattgataaatgaggaaatattcctgtcaytttgtaatatgatttttggttgttttatatatcatttgtctctttcttccttttttattttttatcattgtggtttagtggttttctttagcggtaatgt

SEQ ID NO: 25729 - DNA, 201 bp, Homo sapiens
ttttatcattgtggtttagtggttttctttagcggtaatgtttcacttctttttctttctcatttgtgtatcttacttttatactttcatgtgtttttatkatggtagagattatccatttgctttcagatgtaggattccgttaagtatttcctgcagggctgatctagtggtgatgaattccctgtttttgattgtctg

SEQ ID NO: 25730 - DNA, 201 bp, Homo sapiens
tgagagaagggaaaaaaatcaacccaaaagaaggcaagaaagaaagaaaaaaaagaaacctagaaaacataataaacagatagaagcaaaaaaattcaacyctaaactattcataagagaaactcctaaaagtatgagatagagaaaggctgccagtaaaacgatgggaaaggacataccagggtaatactctgcaaaaag

SEQ ID NO: 25731 - DNA, 201 bp, Homo sapiens
acctagaaaacataataaacagatagaagcaaaaaaattcaactctaaactattcataagagaaactcctaaaagtatgagatagagaaaggctgccagtraaacgatgggaaaggacataccagggtaatactctgcaaaaagaactaggtgtgcctatcttaattattaggaaaaactggacttccagaacaaaaagca

SEQ ID NO: 25732 - DNA, 201 bp, Homo sapiens
taaggtgttaagtctttctgggaaagaaattacatctaagctgagacctgaagactgagtggaagtaagctaaggaaaatggagagggagggaggaggtgrgtactgcaccttggcagagggacctgtgtgtgcaaaggcaggagatgagacagaggaaagcacaccagagaaatggaaaggaattcagagtggctgctgc

SEQ ID NO: 25733 - DNA, 201 bp, Homo sapiens
catgaagcagtgggtcagtagggaaattataaggaagaccaaagagaatgaaatggttaccaaagtgtactaatgtgagagatacaaagatggatggatadatggatggatggatggatggatggatggcagagagagagagagagaggatgaaaatgtcatgctcatctgaacctcattcttatcaccccagggaaactg

SEQ ID NO: 25734 - DNA, 201 bp, Homo sapiens
caaaaataaaagttggatagaaaaaagaaagaggtgtgagaaaagaccccactgtgacacataagtggcatagataacagtggagattcactcacatttgwtgagtattacctagacagtggagattcactcacatttgatgcgtattacctagacaaggaggacaatggcccctcttcctttctgtattctttgtaaagg

SEQ ID NO: 25735 - DNA, 201 bp, Homo sapiens
aaaccaccaatcagaatttgaaatctttaaagtaatcaatttatccgctattcatttgccttctactttaaatctaaagttttgtcacagccaatatttakagtctctgacatcactgggatcagaatggaaatactagaatctgttttgtggtatcctaaattcactgaattagtatttattgtaggactcccatagggt

SEQ ID NO: 25736 - DNA, 201 bp, Homo sapiens
aacaaacaaacaaaaaagaattaataagagttaaaatgtgttgaactcctaatgtgtaggaagtacctaggctttttgcagacactgttttatccatacarccatcctatgaaggaggtacaattatcataatccctattttgcagatgaagaaacagactcataagggttaaatgacttgcccaagactatactgccctt

SEQ ID NO: 25737 - DNA, 201 bp, Homo sapiens
caccaatcagaatttgaaatctttaaagtaatcaatttatccgctattcatttgccttctactttaaatctaaagttttgtcacagccaatatttatagtstctgacatcactgggatcagaatggaaatactagaatctgttttgtggtatcctaaattcactgaattagtatttattgtaggactcccatagggtgtga

SEQ ID NO: 25738 - DNA, 201 bp, Homo sapiens
ttaaaatgtgttgaactcctaatgtgtaggaagtacctaggctttttgcagacactgttttatccatacagccatcctatgaaggaggtacaattatcatratccctattttgcagatgaagaaacagactcataagggttaaatgacttgcccaagactatactgcccttagggcaggagtcaccctgagaacaggccat

SEQ ID NO: 25739 - DNA, 201 bp, Homo sapiens
atttatccgctattcatttgccttctactttaaatctaaagttttgtcacagccaatatttatagtctctgacatcactgggatcagaatggaaatactaraatctgttttgtggtatcctaaattcactgaattagtatttattgtaggactcccatagggtgtgagtctttacaaataaaggtagggaatgccctttat

SEQ ID NO: 25740 - DNA, 201 bp, Homo sapiens
ttatcataatccctattttgcagatgaagaaacagactcataagggttaaatgacttgcccaagactatactgcccttagggcaggagtcaccctgagaasaggccattttggcttcaaggctggtggcccttttctcacaatatgcaacaacactgaggggtctggaatgctgagaagcctccaaatctccggcagtgtc

SEQ ID NO: 25741 - DNA, 201 bp, Homo sapiens
gccttctactttaaatctaaagttttgtcacagccaatatttatagtctctgacatcactgggatcagaatggaaatactagaatctgttttgtggtatcytaaattcactgaattagtatttattgtaggactcccatagggtgtgagtctttacaaataaaggtagggaatgccctttatttgtaagggcaaataagtt

SEQ ID NO: 25742 - DNA, 201 bp, Homo sapiens
cattctttgttctactcccttctttaactctgaaagatcagaaaggtttacataaagtcagtagctcatttagatgactctaaatgtttccttgaatgctrttttatttcctttagagcattagaagacagaaccaaattactgctgtcttccttttattacttttgagttatcctttgatatttcaaatttgggctattc

SEQ ID NO: 25743 - DNA, 201 bp, Homo sapiens
aggtagggaatgccctttatttgtaagggcaaataagttcctccttctcttgtcaaggggatgtgaaaacctccttgcacattttttcttttctttttttctctttgcagaatgagtgttctgagaagaacaaaactcttttctgacaactcttataaaacacttttgtgtttgattctccaacgactaagatttggacac

SEQ ID NO: 25744 - DNA, 201 bp, Homo sapiens
aatttcaggtacctcactgtgtgcagtggcttacccctgtaatcccagcactttgggaggctgcaaggtgggagaattgcttgaggccaggagtttaagaycagcctgggcaacacagcaagacccccatctgtctctaaaaaaaaaaaaaaaagaaaaggatgaagaaccatatttgggttcttcatcttttttctaaaa

SEQ ID NO: 25745 - DNA, 201 bp, Homo sapiens
aactcttttctgacaactcttataaaacacttttgtgtttgattctccaacgactaagatttggacacacaattctccattcatttctcaagtgtcaagaragaattgagtttaaaggctccaattcccttgcaggttacactgtctatctagatgaattagtattcagcacagctttgggaaaatctcaaatgatttgca

SEQ ID NO: 25746 - DNA, 201 bp, Homo sapiens
cctatccccatgtcctcccctgctcagcaaaccagcccactctccatccattttcattctttattttctgttcctatagcatgtgttcctcttcttatccmgggctatgttctgagtccggtccccctctatgccctcaagcaactcaaactggcaattatttatatcctattgcttcaattctctctcttctctaaactt

SEQ ID NO: 25747 - DNA, 201 bp, Homo sapiens
gatgtactactaatgaataaatgtttctaggcaatggaaaactgaaaatagaatcctacctcacacccaacacaaaaatcatttcctattctggatgggtrgagaacttaaaaatgaaaataaaatatttttaaaatttagaatagaatttcagagaatatctttgtaatattagggtaaggaaggacttcttaagacata

SEQ ID NO: 25748 - DNA, 201 bp, Homo sapiens
cagtttttggcatttatgagtagagctactatgtacgtacttatacaagtgtgcaagttttattttctttcttggaaaaatatctaggagtgggattgccrggtcacaggttaaatatatgtttaactttctaagaagctgtcaaactattttccaaagtggtttttaccccttttcattcttcacatcccaccagcagtg

SEQ ID NO: 25749 - DNA, 201 bp, Homo sapiens
actttgatcttcttataccagtttgccagatgtagcagaaagagcatgtatgtgacctttcctgtgccaattcaacccagctgatgggaaactgtaagttwatcttgcatgacttttatttctaggcattacagcagaagttctggtggtgacctctttcgatgaactgcagagaagggcctcagaagcaagagggaagat

SEQ ID NO: 25750 - DNA, 201 bp, Homo sapiens
actcaaactggcaattatttatatcctattgcttcaattctctctcttctctaaacttttcccatcagaatataaatatttcaagtattcgccattaaaawatatatatatatacagctttacccaactttatgaacctccagctctttcttttctttgcagccaagctttttgtcctctcactcattcctccttccagtg

SEQ ID NO: 25751 - DNA, 201 bp, Homo sapiens
tgtttgatttttctgaagcattgacatagttgaccaccacttacatcttgaaactctgtatgtccttagcttctcttaactcctcttttcattcctttttygcttcccttccttgtgccagtcccttacgtgttagtatatgctaggatctcatccttggactctatttattcaggtcactgttcctggaagataactcta

SEQ ID NO: 25752 - DNA, 201 bp, Homo sapiens
ttaccacaacccatctctaggaatagaaattatcgtccaagtcgctcaaacctgaaaacttggcattgacttagacttattttcctcattcactctccctyattcagtcaatccttaagataatgccatttctaccctttaaatgtagcctctcctttattcattgtactgctgccttagttaaggcactcaaaattcctc

SEQ ID NO: 25753 - DNA, 201 bp, Homo sapiens
aaacagctcttctttgaactttatctcctagaaagggaaataagatatgaacctccctaaataactaggcaaaatattataaatgctaaaacgtacaactrctataaaaatggaaagagagaaagtttaaactggttgaggaaaactcaggaaagtcatcttggagaaggcggcatttgatatgtgcctgaacagttgagt

SEQ ID NO: 25754 - DNA, 201 bp, Homo sapiens
tcatagagctttctccctgcagagaggggaagagtatagtccctcatgactcagaatctcttggttgctgccatgcaggcatctatggaatcacaaaagcraggcccaggaaactttaaactaacctatgcttcccgcccagaattcagtctatttccatattagtgggtgccttctgtccatacctatttctgtgtgcaa

SEQ ID NO: 25755 - DNA, 201 bp, Homo sapiens
tctatggaatcacaaaagcgaggcccaggaaactttaaactaacctatgcttcccgcccagaattcagtctatttccatattagtgggtgccttctgtccrtacctatttctgtgtgcaatgtgttgagtcttttgagtggtggcttaacagcccaggagagaattgagctatactgaggcttcatatatgaacacagtat

SEQ ID NO: 25756 - DNA, 201 bp, Homo sapiens
gatacataaagaatgcagtcttcccaactttacactactctctttttcctggatcatggctttctgcagctgcttctcatttagttcagtccaaaaacatkaattgaaatcccaccatgaaccaagcactgttgtaggatctggggagtcaatgatgcacaagacagtctctgccctcaagatgctgagtctagtggggtc

SEQ ID NO: 25757 - DNA, 201 bp, Homo sapiens
gcaacccggtatttttttcaccaagtttttaaagcattcaagatgctaaattttccaagatgagttttctggaagaagtcccaaaactcccttctctctcttttttttttttttttttttttttttttgtgatgaagtctcactccgttgcccactaccaggctggagtgcagtggcacgatctcagctcactgcaacatc

SEQ ID NO: 25758 - DNA, 201 bp, Homo sapiens
tctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagcca

SEQ ID NO: 25759 - DNA, 201 bp, Homo sapiens
ctctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaa

SEQ ID NO: 25760 - DNA, 201 bp, Homo sapiens
tttaatggtactttaagggttcttatgtttaaatctttaatctgtctcagatttattttggtgtaaggtgtgttatatatatctagcttaatttttcttcrattagttatcaatatttttttgtttttatatcactttttgaagttcattttttccgatgggattcaaatatacttatcacattaaaattttctaactata

SEQ ID NO: 25761 - DNA, 201 bp, Homo sapiens
aacatcaagtgtaattgatttccattttctgtatatatccttttttctataatcattaaaaaattttacttttgctataatcctttttaacttggttattyacattttattctgatcactttttaaatttgtgtccttcataattcttactttgttttcagcagcatttactctgtttggattgtctccaatatgaccttc

SEQ ID NO: 25762 - DNA, 201 bp, Homo sapiens
ttggattgtctccaatatgaccttcatttctctgatggttttatttttctctcctgtttatgagctctgccagtccaatcatcatctccttgtattgcctygccttattttacttgggctcttgtatacttagtttgcatttttaatttatagaggtatgtgcttatttttttgtttatatcattatatttggtcacaatt

SEQ ID NO: 25763 - DNA, 201 bp, Homo sapiens
ttcactttttatgtttattaatttctttttttctattttcctgtttttcattttattctaacttcttgaatgcttatattatctctttcattctttcttgkttattaatatttcagctatatcacctagataattgtatattgttctttcttcgattgttatttcccagatatcctataatttcagttttgattttatatt

SEQ ID NO: 25764 - DNA, 201 bp, Homo sapiens
tctctctctctgtttctctccttagagactctgagtctaaagcagacatcactaatcaatcacagattctttccaactgagtctttttttcttttttctttttttttttttttttttgccttttgaccaggaaaaggaatccaactgagttttgatttggccattatgtctctttgagatatagggctctaagtagccaat

SEQ ID NO: 25765 - DNA, 201 bp, Homo sapiens
attaccagatattagtttttcctgtgcttgaacttcatataaatggactcacacacgggtatgtatcatatttagcactgcatactgtttctgagattcayccacgctgttgcatttatcaataattcattctttttgattgctgagtactattccattatataaatacaccacagtttgtttatccattttcctgttaaa

SEQ ID NO: 25766 - DNA, 201 bp, Homo sapiens
ggtactccactctgtcctcacctcccatttcctataaaatatgtttattcattaaaaagtatttaatgccttattttttattatttttattttttttttatttttttttttgctaagacactgtggtaagaattagaagtccaacaacagacaagatgaaaacagtgtctacttctggggcttatattttactaggagata

SEQ ID NO: 25767 - DNA, 201 bp, Homo sapiens
aggagaatcacttgaacccaggaggcagaggttacagtgagctgagatggtgccactgcactccagcctggacgacagagtgagactccatctcaaaaaaaaaaaaaaaaaaaaaaagatagtccaagatccaggattcttttaggttctgtgtcactatgtgatctcaggttaatgatttattgtttctgattctgtttc

SEQ ID NO: 25768 - DNA, 201 bp, Homo sapiens
atagtctcctttaaaaacaatgccctcatttcatttcctctctctggctggactcttctcctccctcctgctttcctaaaatccatcttgtttccctgtaytgtttgctgaatgggcagtttaatgaatacagcatttccattttgaaatgtacagagcacaaggcagaaactgaatttcctcctggacagtttccatcca

SEQ ID NO: 25769 - DNA, 201 bp, Homo sapiens
agagaagtaaaatatcctacctcatgtcacaagctgctatatttggagtcaatattcaaactcagtggcactgactttataattttgctactaaatagttacagtgctgtattgacaagtaaagcaactgtcaggtgctgaaatgtaggagcaagagcaatacataacatgtgttctaccttcaagaaactaataagaatt

SEQ ID NO: 25770 - DNA, 201 bp, Homo sapiens
ctggccacatgccatttttctaattcattatttcactttttatgtttattaatttctttttttctattttcctgtttttcattttattctaacttcttgartgcttatattatctctttcattctttcttgtttattaatatttcagctatatcacctagataattgtatattgttctttcttcgattgttatttcccaga

SEQ ID NO: 25771 - DNA, 201 bp, Homo sapiens
gttcagactccacgttgaagtaccaaatacacagattactcagaatttcacgtattttccatcttgcttatttctgcccaatacctcatatggcattaagmagaactaaattaaaactttccatttctacatttgcaaaggcctttcctctaaaatgttctaagaaaggagacctcaggacacaagtagaaatggtactgt

SEQ ID NO: 25772 - DNA, 201 bp, Homo sapiens
tggagtgcctggtaagaccaaaagatgaagttgtgttccttatatattgccaacaatttaaaataaaatttctgttttaatagagcacaatgaatactagyaggccaggttgtccacggaaaccttaagcttttgttcaaggtataatctgatgatttccaaaactgggataatagtcctcaccttgtatttgtttaccca

SEQ ID NO: 25773 - DNA, 201 bp, Homo sapiens
gcgtggtggcaggcgcctgtagtcccgggaggcggagcttgcagtgagccaagttcacgccactgcactccagcctgggcgaagagcaagactccgtctcaaaaaaaaaaaaggacttctggcttttctactgggaaatgtggttatctgtgccttctggaggtcaagatgtcatcatctggccctggtccctctcacttc

SEQ ID NO: 25774 - DNA, 201 bp, Homo sapiens
aacactgtacagtgatgtttgaagggattgatgctccatggtaagcagacttcgccctactgggaacatgaaaaggaacctctctgatttgtggctgtaaycctcaagccctcgtttaaatagccagggcagtttcatttaatcaacaagcatgtgttgagtgcctgctgtaaaccaaacgctgagacactgaggagagag

SEQ ID NO: 25775 - DNA, 201 bp, Homo sapiens
ttaatcaacaagcatgtgttgagtgcctgctgtaaaccaaacgctgagacactgaggagagaggatgaaaaagactcaacaggtctctgatcttgtggagyttacattgtgatggaggggtgggacactgggaagatacagactataactaagaaatagattaagaatagagaaaaacagtagacattgataaaggctata

SEQ ID NO: 25776 - DNA, 201 bp, Homo sapiens
tagtgctaatgaatagatgtcttatgaaccttttttttgcaccaacaacacattggaaaaatgtactttcaagaataaattgcaatctggtgaaatttttytattagttaacaaaatttagcttttaaaaacaagtatcagtatagtggctttagtggctttagaaaccaggaccctatgcatataaatagttgtaataaa

SEQ ID NO: 25777 - DNA, 201 bp, Homo sapiens
gagggattaatcaaagcagtgttttagaatgtaaatccctaaagcttgtgcatgcctagagcatccaggtcacactcaagtagaaggctcaaagtaagaasacttaaagggaacgaggagcttgaggaagtagcaaagggttgaaaacaattgctttagaaaatcagataatgacattatgatgttgctccattgtatgta

SEQ ID NO: 25778 - DNA, 201 bp, Homo sapiens
cacacaaaaatctgcatataacttttgactccccaaaaacttaactactaatgagctactgttgatcagaagtctttatgataacatagtcaattaacacatattttgtaaatgtattatatactgtattcttataataaagtaagctagagaagagaaaactgttaagaaaagcataaggaagagatacatttatagtac

SEQ ID NO: 25779 - DNA, 201 bp, Homo sapiens
atctaatcaggaaattgatttaaacaaagcactccatgccatacaagatttgattgagctgttttttcttttttcccaagatgaaagagtgcctaggagcrtggttatttttgcccctatatccaatttagcacctctttcaagttaggtttgaagttggaagaattacaacatatttctataaaataatctgtttaatga

SEQ ID NO: 25780 - DNA, 201 bp, Homo sapiens
catgtcctgccctagatctgaaatcagctatctcttcaaagaatccaatttattttcctaggtcatagtatttagaggccacagtctgaacagtaagtgtrtgtgttgctactggattgttcattgtttctaggtcttttcagcagacaggactaggaaacactttttttctccaacatgaaattatattactaattatat

SEQ ID NO: 25781 - DNA, 201 bp, Homo sapiens
tagtcttagttattgctgccacacagttttaccaccttacagagatgactcattatcacacagttcagatactgtgggacctgcaagtccaccagaggtgwtggtgttgacctaaactatttggtcaaaattatgcccatagccaagccaaggtttccaaagagatagaaggtacatgggcttagtggcgcacctaaaact

SEQ ID NO: 25782 - DNA, 201 bp, Homo sapiens
aagggttcttatgtttaaatctttaatctgtctcagatttattttggtgtaaggtgtgttatatatatctagcttaatttttcttcaattagttatcaatrtttttttgtttttatatcactttttgaagttcattttttccgatgggattcaaatatacttatcacattaaaattttctaactatatttgtgtctatttc

SEQ ID NO: 25783 - DNA, 201 bp, Homo sapiens
atatctagcttaatttttcttcaattagttatcaatatttttttgtttttatatcactttttgaagttcattttttccgatgggattcaaatatacttatsacattaaaattttctaactatatttgtgtctatttctgggttctctgttctgtttcattgatctatttttctgtttacaaaccagcaactcaccatttta

SEQ ID NO: 25784 - DNA, 201 bp, Homo sapiens
tcacatatttcttgttatacatttttctagttactctataattttggttgctacttttaatgcaatctattcttactttggatctcctatttgcattgttygtatgtatgaaaagtagtggtgtcacaatattatttttgtattcattcacttaactgaattctgtcattatttatagttttccagttgattctcttgtgc

SEQ ID NO: 25785 - DNA, 201 bp, Homo sapiens
gcttatatgctggtggtggaaatgtaaattggttcagccactgtggaaagcagtttggaaatttcccaagaaacttaaaacagaactgccattcaacccarcaatcccattatttggtatatacccaaaagaaaataaatcattttaccaaaaaagacacatgcactcatatgtttaccatagcactattcacaatagcaa

SEQ ID NO: 25786 - DNA, 201 bp, Homo sapiens
tttctggatcagctacctgtaaaaggtttgtgtgagaggggcaccccattgtgttctaggctaataacaattgtccttatgatttaatgagtatttttttwaatttagcttttactctcttccccattgccttgccttcagacagatttctgaaaatatagcttatacatgtgatttgttattcagtctcagttacttgct

SEQ ID NO: 25787 - DNA, 201 bp, Homo sapiens
gttgacaagatgttgtcttagtctattttgtgctgctataacggaataccatggactggatagtttataactaacagaaattaattggtttacaattctasagcctagaaagtccaagattgaggggccacatctggtgagggccttttagctgcatcaaaactttgcaaaaggcatcacatagtggaagggcaagagagg

SEQ ID NO: 25788 - DNA, 201 bp, Homo sapiens
gactggtatggcccacaaacccatgctttgagtagcactgtttaaagcatggactctagagctagaaagcctttgtgtatctttggcaaactgcttaatckcttggtgcctcagtttcctcatttgtaaaataaaggtaataataaactaccttatagagttgttgtgaggattaaatgcattaatgagtgtagcatactt

SEQ ID NO: 25789 - DNA, 201 bp, Homo sapiens
ttttccaaacctaaaagagtgcctcaatcaatgtttgttgagttttaaataaatatctttatttcagtaatatttaaaaatgtatcctaaatctacttgtygtctgtattttcaaacatagggaaataagcaccaatagctaattggaggaataggatgggggatggggcacagcatgaggagaggagtgagagtatgtct

SEQ ID NO: 25790 - DNA, 201 bp, Homo sapiens
aattctgtcattatttatagttttccagttgattctcttgtgctgtccaggtaaataatcatatagtttccaaataatgatattttagttttatcttttawaattttacctgcattttactgtctagttatgttattcaggacctccaaaaaattaatggtggtcatagtagacactcttgtcttcaacttattgttaata

SEQ ID NO: 25791 - DNA, 201 bp, Homo sapiens
tttccaaacctaaaagagtgcctcaatcaatgtttgttgagttttaaataaatatctttatttcagtaatatttaaaaatgtatcctaaatctacttgttrtctgtattttcaaacatagggaaataagcaccaatagctaattggaggaataggatgggggatggggcacagcatgaggagaggagtgagagtatgtctc

SEQ ID NO: 25792 - DNA, 201 bp, Homo sapiens
ggtgtttcttaaaaatttgtcagtattccgctagtgaaaccaactatgtgttgaactattttgttgggagtaaattgacaatttgtcctccttttaaaacmgatagtgatatgttagattttcaaatttatctgggatgtgatttcttagaaaagcatcttaattctcaaatttactcacactgaattgatcaaactggtg

SEQ ID NO: 25793 - DNA, 201 bp, Homo sapiens
gagaaaagtgaagactttatgaagacagtggagttgagcagagccatagagctatagacttccaataggtggaggagagaggagcgggcaaaccaggcaargagagatgagagaagtaacacaggaggtaatgagcatgttgcagtgggaaagtgggcttggctctggtcagaggaatcatgcaatggattaatagaatcc

SEQ ID NO: 25794 - DNA, 201 bp, Homo sapiens
cttttgattgtggttttcttagtgggaaaatagctcatataatggcccccgaatgtatgcctgggaagaaatatgttaaaaaatgaaatctagtgattgaytgtttattggataatttcaaaatagtacaagggaaaaaattattttagtactcctaagtattagaaataattttacagttcaatttgtgtgattaaatta

SEQ ID NO: 25795 - DNA, 201 bp, Homo sapiens
atccctgagggtgaagtctacaggactaattggattcttgtgcccttgtgaagcaggtgtgggaagtgtttctaaaatatttctgccgatccacatgtaakgaatacttttaatttcactgagagtcttttcctaacattcactggcctacataacaaactaccaatttcatcaacagaaaatctgtttctgactttcagt

SEQ ID NO: 25796 - DNA, 201 bp, Homo sapiens
tgttaacacatttttattgagcacctactatgtgtcaggcactctgccaggtgcttaggatacctcagtgaggaaacagtgctccctgctcttgcggcackgcgtctagagctgctccttgggagccactggccacatgtggctaataaaatatgtttaagtttaggaaaattaggtaaaatttaaaattaaattcttcag

SEQ ID NO: 25797 - DNA, 201 bp, Homo sapiens
gcaagtgagtgagcatagagaagagaagagccctggcagttccatcattaagagcttggggataaagagagagaatcagcaaagagccgagaaagagaggscagtataggaagaaaacgaaagagagtggaatactagaagccagtgaaaaagcgtattgggatagagggagtgattctcgtgtcacatgctgcaggaata

SEQ ID NO: 25798 - DNA, 201 bp, Homo sapiens
atgcactgtttttaagtatataaagtactaatattccatgttgtatagctctttcactggcatagtttctccatgaggaaactgaggcacagagagacaawcatttgtcaagggacacataacaactctgctgccattttctcctgacttatgatataacaggcagctcctactggccttttgaatgtttttcttgattta

SEQ ID NO: 25799 - DNA, 201 bp, Homo sapiens
ctcctttcttctcataaattttatttttaagtgtcaaaacacgcaatttcttttcagatactgaaacctgtgatattatgtgccctttgcctactgcaatygctttctgaatagtcaagtgattcagcgattacctctgtgcacccaaatcctacctgattggaaggaagtcaccggggaggggatggtgagatgacgcac

SEQ ID NO: 25800 - DNA, 201 bp, Homo sapiens
tgccactttagactaaggactgtcatatatatacatatatatacacacatatatatacacacatacatatatatgcacatatatatatatagtttctttargtcttaccaaagtattaaatactttttgaacaaataacgtattttggggggcattattctgtccacttacctaaatcaaggatgatataaacaataaata

SEQ ID NO: 25801 - DNA, 201 bp, Homo sapiens
cctagtctacccaaatgagaaggaaccagaaaaacatctgggtaatatgagaaaacaagtttcttttacatcccccaaaagatgataccagttcaccagcratggatccaaaccaagatgaaatctccaaattgccagaaatagaattcagaaagttgattattaagttaatcaaggaggcaccagagaaaggtgaagtcc

SEQ ID NO: 25802 - DNA, 201 bp, Homo sapiens
gagtttattttgatgcaaaaaagttgaaatctatttttttataatacacatttttcatgaacttcttgaagacccctcctatttgccagacactgttcttycattgactaataaataaattctctctcctttcttttttcatttttcagctcttgggttttacagttttaaaaattaatttttaattagacaagtaaaaat

SEQ ID NO: 25803 - DNA, 201 bp, Homo sapiens
ggtgttataggagtcttttaattttttttgtttctgggatcttcctcattgtttcttgttctttgtatttgtattttctatccttataattaaaaatgttytggcgagttaaaggttttgtttcgtgttatttctcctcctccacccatgaaacatctgttgggtttacttattctttcacattccatttttcttttcttt

SEQ ID NO: 25804 - DNA, 201 bp, Homo sapiens
gtagccatatgtagtttcttttgacatcttcttgcaactccgtttgagctgtgatacaaagtttacatgcccagtgcaggggaaatgatgtgtgtctgccrcttttgagtgctatgattgttcacttctttagattctcatagtctgtcctgataattgcaggaattagaaaaggctggcctagagtcctttcctcaccta

SEQ ID NO: 25805 - DNA, 201 bp, Homo sapiens
ttggagactcacatagtgaacttttgctctaagaactacctcaagaacatatcaggaaagccaagagaatccacagaccctttgaaggaactggatcaccrctgcaggcttcctgagatgccaaaaaaaactatgagtctgtttgctttctcaaaggagaggctcttggtctggggcaagttctcagccctagttacctgt

SEQ ID NO: 25806 - DNA, 201 bp, Homo sapiens
agtcttccctgatcacctaatacaaagaagttttctgtccccctcattcttcagttagctaaaaataatagaaaacccaaaacaatagttgcttacacacmatagaagtttctttctctgtcatatgaaattatagataactatgcaccagagtgttagcaacccagattccactgtccagatgttcctttccaagcctac

SEQ ID NO: 25807 - DNA, 201 bp, Homo sapiens
agacatttaattcaaaaattgcaatgaaattgtggtaagttctctgaatgtaggatgtacaaattactttgggcacctggtaaagaaacagaccaacatgscttggctgggtcagagcaacttcactaagatgttatttgaactttctttcataaagataaatagaaattcctgagatgaacagtgcagaatgaagtattc

SEQ ID NO: 25808 - DNA, 201 bp, Homo sapiens
attattgtgattcccatttcacaggataaaaaaaagttaagtagcttattcaggatcaaaaggctggtgagctttatagccagcattcaagccagggtatrtagtgataggcatttcttgttattgacaaagaaatcctctgctttaagcatatatcgaataatgcataatgtaataaataccctgttttttcaaaaaaaa

SEQ ID NO: 25809 - DNA, 201 bp, Homo sapiens
cgtgttaacttgaagagctggtccagtggggatctctgatatttggaaatatttttctaagattcatccttctggtatcttcttctttgtcttcccctctyaccactcttatagattcacttttttgctcaagccttcagcttaaattatattcaattaatctaacagaagagttatttgtgctttgtaaatataatcagt

SEQ ID NO: 25810 - DNA, 201 bp, Homo sapiens
aagtttcttctttataggaaacttcctagatttcttcctttagtcagaattaatgctgatttatgttctctcatgaaattgtactttgtactttcatttastgctgtgactgttctttttaaagttattgtttacttatttttttctcctccagattatacaatccttaaggatagtactggaatttcctcatcttcctat

SEQ ID NO: 25811 - DNA, 201 bp, Homo sapiens
cagaggtgaagacttctgaaatcagaatcaattttctaaaacataccacattaaaataagaccatagacacgtttttctgtctataagtctttttattttratggtagaaaatgttgtaagattatttcattatcttcttattgttaactgttttggggaagaatcaaatcaggagagactgagattggagtctttttatc

SEQ ID NO: 25812 - DNA, 201 bp, Homo sapiens
attcttacagattaaggaaaagaattgctgacaacttaggctgacttttatatacctatttgttttccttcctaattcctcttaaaatgaaaatgccaagmttttcttttgatatttgttacatttgtgaaataatataacaatgcagttaatgggaagagcatgacccctggattcagatatccaatagttacaaatctc

SEQ ID NO: 25813 - DNA, 201 bp, Homo sapiens
aatatagctattactgttattatcatcatcaattattctacctatagaaatatgcaagttccttggaagtatacatttctggagagtgatcagggatgggrtattatacttttattttttcggtttctcttcattcattcagtgggttatgggtatgtgtgtgtgtgtgtgtgtgtttcacacattatgtgctaggcacta

SEQ ID NO: 25814 - DNA, 201 bp, Homo sapiens
tcgtgctgataggcttataataaaaactagcagcccctttctctcactccttgtgcacctttacctgttccccaagaacaacactttcaactcttttagcygttcacatcaatttgtctaaaatctaaataatgtactttacagcttgagatatcaattttaaacattatacattgatttcctattattgtaggtaaggat

SEQ ID NO: 25815 - DNA, 201 bp, Homo sapiens
ttcggtttctcttcattcattcagtgggttatgggtatgtgtgtgtgtgtgtgtgtgtttcacacattatgtgctaggcactatttcaggcacttggaacktacattattgtaggggtacaactggaaactgataaatgctgtaaaaaaaattaaacaagctaagaggtacaggaggttgggagagagttgcaattattaa

SEQ ID NO: 25816 - DNA, 201 bp, Homo sapiens
actagtgatttgcattggcaactgtggtgtctagattaggttttggcactttaggactccactctcttgtttgttaaaaacaaaacaaaacaaaacaaaamaaaacttgaatggaagcatagaccataatgaagtaccaccctcgtgtgactttaatttcacagtggcctatgaaaatttatagaaatttggcttcatttc

SEQ ID NO: 25817 - DNA, 201 bp, Homo sapiens
tatgttttaaatttatccaggggataatgcatagctaaagatgacaattcgtgctgataggcttataataaaaactagcagcccctttctctcactccttstgcacctttacctgttccccaagaacaacactttcaactcttttagctgttcacatcaatttgtctaaaatctaaataatgtactttacagcttgagata

SEQ ID NO: 25818 - DNA, 201 bp, Homo sapiens
agtgttcatcagggttctctttcttttttttcctccttttacacattgcactctttggaaggaaatcactacactgtgtgtagcccacactaaagagttgkaaggtgagagacagacaggtacaaagaaagaggcagttattaattccaggatttaaaaaaacaagatggcattatactccacctctttaagggtgtagtt

SEQ ID NO: 25819 - DNA, 201 bp, Homo sapiens
gctgaagtatttaggcagaggagttcttgagagccagagggctgagatagtgctggctctgacagcttcatgagggacattaacatcttctggctaggagrgcttgggcctatttgtcagctcagcctgactcattcttttattttttaaaatcagctgaattgaggtataacttatataaaataaatcaaccaatctaat

SEQ ID NO: 25820 - DNA, 201 bp, Homo sapiens
cttggaggaggattgagattttgtgtagaggagagtttggtaagagtccaagaaagtggcgttcgctctagactgggcgctgttgggaagtggggaccatsctatgactgtgtatcttaataaactgtgtctacagggacagaagcccagaaggagactaaagctttaattagtaaagatgcagccatcacttatatttct

SEQ ID NO: 25821 - DNA, 201 bp, Homo sapiens
gtctagattaggttttggcactttaggactccactctcttgtttgttaaaaacaaaacaaaacaaaacaaaaaaaaacttgaatggaagcatagaccatartgaagtaccaccctcgtgtgactttaatttcacagtggcctatgaaaatttatagaaatttggcttcatttctagtggctccaatccggatgccaaaatt

SEQ ID NO: 25822 - DNA, 201 bp, Homo sapiens
agaagaggggatgtctgatattttgtggtttgccagtgactttgttttttctgggcttaaatgaaattatgaactggctagttttgactgacttcagtacrgtcacagagtgaccttgtctgttgctggcgttccatgagattagttatttgttcatgaggagaacagatggcatggtttctttaacagcactgataccta

SEQ ID NO: 25823 - DNA, 201 bp, Homo sapiens
cagaagcaagagggaagattgttgtttataaccaaccttacatcaactactcaaggacggtgcaataccgaacgcagggggcggtggaagctgccaaggtkggggctttggcatctctcattcgatccgtggcctccttctccatctacaggtttgtcacaatgttcatttgaattcctttcaaaaacaagggttttccgt

SEQ ID NO: 25824 - DNA, 201 bp, Homo sapiens
agaagacctcacagttgtctgactgtgtcctccatcacagtcctcccagtattcaggacagatcttaggattcctctcttgagggtcacgtatccctgctktgtaattcacctcctctgtcctctatttcaggatgctcggctctaaatacactgcttgcctcaaccttccctttggattgtaagttccttaaaggaactt

SEQ ID NO: 25825 - DNA, 201 bp, Homo sapiens
gtgtcagttctctttatccatgacaggagacatgatgcttcttatgaagcctatgtttggattaaatgagagggaacaagtaaatcctagccattgtgtgkccggtctgtggggtttttttccccttctttccattcacatttatgatagatgaagagatattggtccagagaggttaaatgccttgcccaatatgataca

SEQ ID NO: 25826 - DNA, 201 bp, Homo sapiens
agcttcctagttgctcagaaatttccgagtactaggattactaaggtgaattccatgtgttttttgtcctcaagaaatatttttatgtagccaaaagagamgggggtaagaacatgtaagtgattagtgttatttattttatatttagtgctaagtgaatgattgggggaaagggataaagaaaggaaattactatttatt

SEQ ID NO: 25827 - DNA, 201 bp, Homo sapiens
gacatgagtcatgtcatcccccagaggagagctgggagtggacatctaagaaactctggtagccagcctgcctgtctgtgaatatatgggaacatttatasagggaggtgatataaaagctgaagacatgtttaacccagattacttaggcttttatttttcattaagtggaaaaactaatcaaatttcagactcatgaaa

SEQ ID NO: 25828 - DNA, 201 bp, Homo sapiens
gtgcctactttcattgtgatggggttatagaactgtgatagtcttaaactaggtcaggtacccaccactgaaaccaagactcaaggtcagtctcacccaawccatggatgactgtggggaagaggaggttcccaagaggttaccaggtttctgtttccaaaagagagggaaatagatgttaagctagtatgtgttcactca

SEQ ID NO: 25829 - DNA, 201 bp, Homo sapiens
ttcatataaacatagaatggattcaggatttgaggtgatgcattccttttccaataggtacttctgcataactacccagtagagaaggatcctttcacaaraggtgtgggaaaactatactacaagcctgcagtaaccaaaatggcatgttacgggtacaaaaacagacacataggccaatggaacaggttagagaagcca

SEQ ID NO: 25830 - DNA, 201 bp, Homo sapiens
tattttggagcccgcattctggagactccatgcctgtgtctttgttcagccacttgccagatgtgcctcattggtgcctcagtttcatctgtaaaatgggkgaaatatcttctttgtttttcttcctggagttttgagggttttctttttttgtttcattttgtttttgtttttctgaggcagagttttgctcttgttgcc

SEQ ID NO: 25831 - DNA, 201 bp, Homo sapiens
ctgccccatcacccaagtgtgatttttgtgattcttgtgtttctctagtgtctcaccaactgtatttctaaagcttggtcagtgttccatcttggatttcwtgttttgccacttgtgatggcaatttataataaaaccaagatatgacctgttttgtatccagcaatgaaacaagttggaatctgcctgtgatgtgcaatg

SEQ ID NO: 25832 - DNA, 201 bp, Homo sapiens
taaacaaccagtgtgagcctgttttctcatctgtaacatgtggagaacaatgtttacctcatagagttgttgagagaattaaatgaaatcaagcccttgayacagactgaaacatgggaagtgattgatgaaatataactgacgtcttatcttggccatggtcattattatcactgtcatcattagatagtgatgggacta

SEQ ID NO: 25833 - DNA, 201 bp, Homo sapiens
tgttaataaatgtgctgttgataggaaaatgttggcagaagtgccaatatgaatagtcttctagttgcttttctgatggttgtgacataatgaatctcaartgtgacttttgtcatataattggaggctctgaacattaagaacattttcttaaggatcatccaggcagaaaatgagttcacaggtttttaacatttttac

SEQ ID NO: 25834 - DNA, 201 bp, Homo sapiens
taagaaattgcctaactttttatttttatttttattttttgagacggagtttcactcttgttgcctaggcaggagtaaatggcgcgatctcggctcactgyaacctccgcctcctggattcaagcgattctcctgctttagcctcctgagtagctgggattacagtcatgcaccaccacacctggctattttgtattttta

SEQ ID NO: 25835 - DNA, 201 bp, Homo sapiens
tttatggcttcactaattggccagagctactactgtgctgtggagtatcagtgtttcctttgatgtgttgttcctagcctctctatgggcttatatctagyatcccaggtaaacctgagagttatcctgggcaatgtggatgctggtattccattttctcaattttagggttctcctcctgtatcctgtacaggtcatgag

SEQ ID NO: 25836 - DNA, 201 bp, Homo sapiens
cctcattgcatcacataaggaaacaaataatgtcacttttccttattggtgagaccaaatttgatcacttgtctaaggcattatctctggatttctttatygaaaggtagcattccacctttgtagaggaaatacattgcaattattgtgggatgctcttgagactttgtgaatcttaagttctttaacaaaatttcaccc

SEQ ID NO: 25837 - DNA, 201 bp, Homo sapiens
atggaaagacagggaactttgttccagaatacatcctgtgttccttggaaattatattaactcctctcagccttagttttccctcatgtaatgtggataakgatacttaccctttccaaaatcagaggtcttagaaaagtattttaaaaaataaactggataaaagaggtaatgctagttacttagaataggaatttatgt

SEQ ID NO: 25838 - DNA, 201 bp, Homo sapiens
gatgctcttgagactttgtgaatcttaagttctttaacaaaatttcacccagtgagattttaacatccgttgatgacccctgcctgaatcaatcattgtaytggaagttgcaaatgtttttctaattcaattatttctattacaattatttgctgtgtgcttttgtaataaagagcatctgcctccttttccttctttttg

SEQ ID NO: 25839 - DNA, 201 bp, Homo sapiens
ctttgccttctaggaggaaatactctttcctaggtgccacactgttgatacttctcaagaccaaaataccacaggcctccagctccttgataaagctttamtgtgttgaattggcataaatcaattccctaagtctgcctagcagaaccaaactctgaatatggtgacctcacagggtcacctagctcaaggcagccagca

SEQ ID NO: 25840 - DNA, 201 bp, Homo sapiens
gccacttcaggacttggatgagatactaagccatggggcacgcaatgtggccccacatgtgttggaagaagccagatgatacaccctggacatgaaggagmgttaactccttgtagggtgaaatttgaccagaggagggcaatggacaggagggaagtggctaaattccctcatcttgcactgtccaatcgacttctctga

SEQ ID NO: 25841 - DNA, 201 bp, Homo sapiens
ttccccctcaaaagcagagtgtgaaacaaggacttacatgtgagtagtttatttgaggaaattatcccaaggaacagaagtgggagactggaaatgattgktcacaataatctctgtcatttcatagccatagtttttcatcaacactttcctaatgagctcatctttgggatgccaagtgacattgctgtgtgctttctt

SEQ ID NO: 25842 - DNA, 201 bp, Homo sapiens
caagaataagtacaaaacctgaataagccaataaccatgaaagaaattgaatcattagttaaaattgttatcataaagaaaacatcagactttgatggctytgttaaaagttctacaaaataaccaggaaataaataattctaatcttacacaaactatcccagaatgtataaaaaaaagaaggaaaaccatgttatgcat

SEQ ID NO: 25843 - DNA, 201 bp, Homo sapiens
aggctggcctaagaatacagtttcctggtctagtttgagttattagagatagtttgggaaagagagaacgtgaaaccacctagatggtcctcatagattcrttgaaggcagaagctttatatatattttttctcatcaaaattttaccatgtttaccatctcacaccagtcagaatgggtattactaaaaagtcaaagaat

SEQ ID NO: 25844 - DNA, 201 bp, Homo sapiens
aaactatgcagctctgatgttgaggagtatgaaaagagcttttttttttttttttttttgcaagagaaataaggatctcaatataggtttgcagaggccarcagggatgtatctttaggatgggtttacctcatatctgtgtaatacagagaactataaattatccacccactccaacctccccatgtcatcagtggttgt

SEQ ID NO: 25845 - DNA, 201 bp, Homo sapiens
tataatgcactgatttatcattttggtcatggcaaacattgggatatatttgtctgcaaataaaagaaaactcgactaatggtggttgtattagtcaggaytatccagagaaacaaaaccaataggatgtgcaagtaagcagaaattttaacatacggtagaattaaattggaaaggaaacaaggaaactcatatattttg

SEQ ID NO: 25846 - DNA, 201 bp, Homo sapiens
aaactgtagttttgtatggcttttgtctgggaatgccatactttgtcagaataagatgtggtgtatattttaacatgtaatccaatatgttaacacaaatraaactgtgacttcatacatagatgcatttgctctttgagctctacaatcacaggaattctgataaattctattttgcatgacttccttaaaaatataaaa

SEQ ID NO: 25847 - DNA, 201 bp, Homo sapiens
gaaatacgttatttaagcaaatatactgataatgatgcacagatgctgtttgtatacattactttcctcctttgaattcactaagtactgatttcttattkgtgccagcgatcttcagaattagttctgtccccttctgtatcattgtgtgagacaaatatctcatatacaacttttctaaagattagaagactaaaatat

SEQ ID NO: 25848 - DNA, 201 bp, Homo sapiens
gctgcccacttcttccagacagccagtctcatatgtcaacctctgccacatctgaaatttctctcccactgctctaatgcgtgggtggacttacagcctgraagctggaggagggaggaggtacagaggacacagagaacatctctttccttcctgaaggatggagggagaagaactttccccctgtctgctccaggcctg

SEQ ID NO: 25849 - DNA, 201 bp, Homo sapiens
cccagagcacttgacccattcagggatcctgtgtttgtcatttctcttcagaaatgattatattggcacctatctcagaattgatatacagattaaatacrgtcatggatgaaattatttagcccactatgtatcatcaatattcattagatagtaatcatttttattgctactaatagtaatcatcatcatcattagagg

SEQ ID NO: 25850 - DNA, 201 bp, Homo sapiens
atagtgtctatacagaagacataaatgtgcgtaaatgggtataaaataaatacaatgctgagtgatacttcgatatagaagaatatacaaaatatgggtgrtgatgatcataactaccatttataaaccacatgttgtctgtcaggcacagtacagtgctttatatatatatttttttggtatgattatcagaaggaatat

SEQ ID NO: 25851 - DNA, 201 bp, Homo sapiens
atcctttagttggtctttagtgtgtttttatggtgtccagtttcagtattcatgttgatctcctttcaccctttgtcttcactgagtcactcttggctcastatggtaatcattagcactggtttctagatatttctggctcttcacctgcacataaaacagggctgtacatctcagtcccttggagtttgggtgaggaca

SEQ ID NO: 25852 - DNA, 201 bp, Homo sapiens
actttcaaaccatagaataaagaaaacgaaagggggaaaactgcaaacaaatgtgctatgagattagatggatttgaaggggactcgacagtcttgggccytttgttttggaagatggattttgaaagttatcttttattgtattcctgtgaggcccatttgtttcctacccttttctcttgtccccctcttccttctctt

SEQ ID NO: 25853 - DNA, 201 bp, Homo sapiens
atacaatcatagtggaaggcaaacagcgagcaggcatcttacatggcaggaacaggagcaagagggcgaggggtaggtgctacacactcttaaatgacccrtgagaactcactcactatcttaaggacagtgccaagagggatagtgctaaaccattcacgagaaatccacctccataatccaatcacctcccaccaggcc

SEQ ID NO: 25854 - DNA, 201 bp, Homo sapiens
agatggcacggctggagaaattcttatcgggctcccagctcacgttccaggcggcctctctgtctctctcctctattcttatttgttcatggttgacccaratggaaacttgaaatgcaaatgtatttcttcttggaagtttccaagtaaaaaaggtgatagtgactcagcataagatgcttacatgcccccaaaagaata

SEQ ID NO: 25855 - DNA, 201 bp, Homo sapiens
tgactgattttgttggccctcactttccagaaagggaaccgtggacataaatgtcatgggaaggtatttagtagaaggtgtgatttttgggggcgcatatraaacattctaaaattcaaggccagggcgctgtgacaggctctaatctatgaatcattatattcttaacatattctgagaacaggaagagaaagctcaacc

SEQ ID NO: 25856 - DNA, 201 bp, Homo sapiens
gctatggttgttctagatcatcctatcacctagcctttacaatcaccacagagtagcacgttggtttctgacttttggaacaatgttaacctgctttttcrcagagttacgtatctcaataaatggaattactacctacatagttgtctcggcaaaatcttgggaattcttctttatcacccaccattcaccactgttgaa

SEQ ID NO: 25857 - DNA, 201 bp, Homo sapiens
ggagctctgtcccagggagagatcagagctctgttcataaaacagttgctggaggggcttaaggaggtcctctctagcgaggaggaatgacttggggtccygcttacagaagcagtctggctgctttttggtagggcaggtgtgctgcattgtagcagagggaacccttcctagtttagaccgtctgtattctccacatcc

SEQ ID NO: 25858 - DNA, 201 bp, Homo sapiens
ttttttgttttcttttcttcaacttttaagttcaggggtacccattactgggtatatacccaaaagaatataaaccattctattataaagatacatgcacrcatatgttcattgcagcagtattcacaatagcaaagacatggaatcaacccaaatgtccatcaatgatagaccagataaagaatatgtggtacatataca

SEQ ID NO: 25859 - DNA, 201 bp, Homo sapiens
gtgtctttatagcagcatgatttataatcctttgggtatatacccagtaatgggatggctggatcaaatggtatttctagttctagatccctaaggaatcrccacactgacttccacaatggttgaactagtttacagttccaccaacagtgtcaaagcgttcctatttctccacatcctctccagcacctgttgtttcct

SEQ ID NO: 25860 - DNA, 201 bp, Homo sapiens
tagcagcatgatttataatcctttgggtatatacccagtaatgggatggctggatcaaatggtatttctagttctagatccctaaggaatcaccacactgwcttccacaatggttgaactagtttacagttccaccaacagtgtcaaagcgttcctatttctccacatcctctccagcacctgttgtttcctgacttttta

SEQ ID NO: 25861 - DNA, 201 bp, Homo sapiens
ctatttttcctctaagattgcaacagagactatcacaaggcatttggcaacctgagaagccctggatggccagataactacgacaatgacaaggattgcaycgttactctcacagccccccagaaccacaccatttccctcttttttcattcacttggcatcgagaactcagttgaatgcagaaacgatttcttggaggtg

SEQ ID NO: 25862 - DNA, 201 bp, Homo sapiens
catttatccccctaatgtggaatgtgtctggaacatcgtcagttcccctggcaaccggctccagctgtcttttatgtaaatccttttttatggtgtattgyttcagtgctaatgaatctgtaggaaagaagttctggtgctaataggatgggcaactcatagtgtacgtgaaatttaggaagtatttttccaaatttcctc

SEQ ID NO: 25863 - DNA, 201 bp, Homo sapiens
agtgtacgtgaaatttaggaagtatttttccaaatttcctctgtttcagtcatagtttgagttataaatagcatgaagtttctctcgaccatggttcttgvgtcctgtctaacatttccaaaagtacattcttgagtccttggtgaatgaatgaatctgtggcgcattcatgttcagagtacaggaatcttatcttttttt

SEQ ID NO: 25864 - DNA, 201 bp, Homo sapiens
tttcttggaggtgatatgcatttgaatatcgtttgaatgaattatttaaaagatggtggatcacttaagattttacaccttttatctagtgctgctaataytatatgattcttatttgtttcattaatttattcattaccctttcattccctaaacatctacagagcaccagtccaaacaccggaaattgggaaccttagg

SEQ ID NO: 25865 - DNA, 201 bp, Homo sapiens
cttccccttgccttccgttcccctcccttcccttcccttcctttcccttccccttccccttcccccttcccttccttttcccttcccttcccttccttttyccttcccttcccttccctttttcctttaccctttcccctttcctgtttgttcatgctttcatttcattggggtataaacctagaagtgaaattgctggtt

SEQ ID NO: 25866 - DNA, 201 bp, Homo sapiens
gtttcttggtagcttcagcctttgttcccaacaaaacatcttctgcttcttagcaccaagggctttctttctttcttttctttcttcttctttcttttctsccctgcaacccccctcatccgatttggctcctagggctgctggcaccttctgcccagcctggccaggaagggtgttctggcatatggtctttgcatatgg

SEQ ID NO: 25867 - DNA, 201 bp, Homo sapiens
cctctttgttctgaagacgtgattcttgttgtttccctgctcactttgttttgttttgtttgtttttgtttgtttgtttttgagacagagtcttgctcttsacacccaggctggagtgcaattgctgcaacctctgcatcctgggtacaagcaattctcctacctcagcctcccgagtagctgggattacaggcacctgac

SEQ ID NO: 25868 - DNA, 201 bp, Homo sapiens
cacttcagcctctatctcccaggcttaagccatcttcctgcctcagcctcccaagtagctgggattataggcacaggccaccacacatagctacattttawtttttgtagagagggggtttcactgtgttgctcaggctggtctcaaactcctgggttcaagtgatcctcccacctcagcctcccaaagtgctgagattat

SEQ ID NO: 25869 - DNA, 201 bp, Homo sapiens
tttcttggtagcttcagcctttgttcccaacaaaacatcttctgcttcttagcaccaagggctttctttctttcttttctttcttcttctttcttttctgscctgcaacccccctcatccgatttggctcctagggctgctggcaccttctgcccagcctggccaggaagggtgttctggcatatggtctttgcatatggg

SEQ ID NO: 25870 - DNA, 201 bp, Homo sapiens
ctctttgttctgaagacgtgattcttgttgtttccctgctcactttgttttgttttgtttgtttttgtttgtttgtttttgagacagagtcttgctcttgwcacccaggctggagtgcaattgctgcaacctctgcatcctgggtacaagcaattctcctacctcagcctcccgagtagctgggattacaggcacctgaca

SEQ ID NO: 25871 - DNA, 201 bp, Homo sapiens
tccttaaatgtttatttgtgaaagtaaaacgagcatcttagatttcttctcatgtcaacatttccaggaatctttgagtcagtgctcgcaacaactgcaartttttagagtttatagtctcttgtaagatgtgaagactgagtgggagagtgtagcacaaagaaataggggtgaacgcatcgtgatatgagatgtggggtt

SEQ ID NO: 25872 - DNA, 201 bp, Homo sapiens
acttcagcctctatctcccaggcttaagccatcttcctgcctcagcctcccaagtagctgggattataggcacaggccaccacacatagctacattttattttttgtagagagggggtttcactgtgttgctcaggctggtctcaaactcctgggttcaagtgatcctcccacctcagcctcccaaagtgctgagattatg

SEQ ID NO: 25873 - DNA, 201 bp, Homo sapiens
tagcttcagcctttgttcccaacaaaacatcttctgcttcttagcaccaagggctttctttctttcttttctttcttcttctttcttttctgccctgcaayccccctcatccgatttggctcctagggctgctggcaccttctgcccagcctggccaggaagggtgttctggcatatggtctttgcatatgggtttagctt

SEQ ID NO: 25874 - DNA, 201 bp, Homo sapiens
ggtgggaagatcgcttgaacctgggaggcagatgttgcagtgagccgagatcgcaccactgcactccgcctgggcacaagaccctgtctcaaaacaaaacraaacaaaacaaaacaaaaaggtgcataaaaatgcagcatcttcatataactctacttatcagaatgtaagaatataacatgcaggaacaatggtgcagga

SEQ ID NO: 25875 - DNA, 201 bp, Homo sapiens
ttgttcttctctctccctctccctttttgtctctttctctctctcctccctgtatctctctctcactctctctttcttccctccctcctttatgccccacsacaggaatttttgtttccatctgatacttgaggatgatctttttcaaacgtttatcttgtgacttgcatttgtattaacatgcttagctactttgcttcc

SEQ ID NO: 25876 - DNA, 201 bp, Homo sapiens
gaaagatggaataatcccgttaggttggagtcacagtgcaactaactcttaactcactccagcttgaatggaccattattgatcagagtcaacgtttgccrtttgcctgatagatgctgggaagcaaagccttgctttccagccgtggagagtgagaattcctcctcctagctgtccttcattactccacagaatggatct

SEQ ID NO: 25877 - DNA, 201 bp, Homo sapiens
cttggtgggacgatactgtggaaactccttccctctcaattattcttccatcgttggacataccctgtgggtcagatttatctcagatggttctggcagcrgcacgggcttccaggccacatttatgaagagtaagttgtttctattttagtgatagcttccagaatatgtcttacaaactagaaataataattttctcag

SEQ ID NO: 25878 - DNA, 201 bp, Homo sapiens
tgtaaaataggatttttttttttttttttttttgagatggagcctcactctgtcacccaggctggagtgcagtggcacgatctcagctcactgcaaccttyacctcccaggttcaagcaattctcgtgactcagcctcctgagtagctgggattacaggagcatgccaacatgcctggctaattttggtatttttagtaga

SEQ ID NO: 25879 - DNA, 201 bp, Homo sapiens
ccctttctttgttcttctctctccctctccctttttgtctctttctctctctcctccctgtatctctctctcactctctctttcttccctccctcctttaygccccacgacaggaatttttgtttccatctgatacttgaggatgatctttttcaaacgtttatcttgtgacttgcatttgtattaacatgcttagctact

SEQ ID NO: 25880 - DNA, 201 bp, Homo sapiens
caagttgtcagcagtgtcagtggaaattagtatcctgctgctcctctcagagcaacggcattttgaaagaggaccctgagggaaaaacgcccaaactcaaragcgtggtgctggctatggcagccctcccatctactagtggatgactggctactctgtcatggcaaggttactttgtttaaacacttagcagaataatcc

SEQ ID NO: 25881 - DNA, 201 bp, Homo sapiens
tggaaattctttgacatttcatttttactccgactcttcaatctcagggaagggattccttctggagtggtttgcagtggatgcacctgatggtgttttamctaccattgctccaggtgtgtttggtaataaatgaagttctttttaggactgatatgtgcaggccaatgtttcaaaggatcctatcataacaggggtcag

SEQ ID NO: 25882 - DNA, 201 bp, Homo sapiens
gattgcaccactgcactccagcctgggtgacagagcaagactctgtctcaaaaataaataaataaataaataaataaataaataaataaataaataaatargaggatcctccttttatagatgaaataatgaaaagtaggtgaagctaaacattttttgttaacacttcttagcttgtaattgtaatagttgaatttcaaa

SEQ ID NO: 25883 - DNA, 201 bp, Homo sapiens
agccagtttctttgggaatgttctttcctaattttgattaggaaggatggatctccttttctagctattgtacactattagattcgtgggaaatgtagcakttttcaagtcagagaagcaatggtgtgtgcctgttggctgagttaaatcaagtgtagccactcatggcaaaccactgtttagggaaaagtttgaggaaag

SEQ ID NO: 25884 - DNA, 201 bp, Homo sapiens
tttccttccttccatttagttttcatgaattctatttcctggcattgaaaacattcttttgaaaaaaaaatattcttaggtgagaaacttgtaatactttyattaccaattcgcaagaaaattcatcttgtttttttcttgattattgtgatttcatatcttctcactcataatggacataatatggtagaaaatatatac

SEQ ID NO: 25885 - DNA, 201 bp, Homo sapiens
atctcagggaagggattccttctggagtggtttgcagtggatgcacctgatggtgttttacctaccattgctccaggtgtgtttggtaataaatgaagttmtttttaggactgatatgtgcaggccaatgtttcaaaggatcctatcataacaggggtcagatataaaaataagtacagccccaaagcccttccaccatat

SEQ ID NO: 25886 - DNA, 201 bp, Homo sapiens
tggcaaaccactgtttagggaaaagtttgaggaaaggaattagaggaagtaatacagtagacaggtttttcagactgaatcagagagtgctggaaaggaartactgaaagacaaccctagaccaaatcttaggtctgcaggtggtccactgtgtaagtgtgcacgtgtgtacttgtgtgtgttttaatgtcaatttaaaag

SEQ ID NO: 25887 - DNA, 201 bp, Homo sapiens
agcagttttcaagtgtataatacaatattgttaatgatagtcaccatgctgtacattagatctctagaagctattcattccagagaacataaacgttttascctttgaccaacatttccctattgcccccacctctcagctcctggccaccaccattctactttctgcttctatgagtttaactttttttagatttcacat

SEQ ID NO: 25888 - DNA, 201 bp, Homo sapiens
ggccacccgagctagcagcggcaacctgctcgggtccccttccacgctgtggaagctttgttctctcactcttcacaataaatcttgctgctgctcactctgggttcacactacctttatgagctgtaacactcactgtgaaggtttgcggcttcattcctgaagtcagcaagaccacgaacccaccgggaggaacaaata

SEQ ID NO: 25889 - DNA, 201 bp, Homo sapiens
agcccttccaccatatgttcagatgttgttttaaattcataaacactaccttttgtagaaattgtacgtttctttctaaaaaatgcaggtcccattatatwttttatattaattaggggcttgatatccataagatcgtctacttacaatttctagagaccactttagaaatccctgaaaatttgatttgcagatactaca

SEQ ID NO: 25890 - DNA, 201 bp, Homo sapiens
acaaacaaaaattgtatatttatggtgtacaacatgttttgacatatgtacatgttgtagagtggctaaatccagttaattaacatgtctgctcactcacwtacttagcactttttgtggggagagcatttaaaacctctcttagcaatttttaagtattcggcaagtaatcaagtatttcaggtattcaaccttgttatt

SEQ ID NO: 25891 - DNA, 201 bp, Homo sapiens
cagaatggtggaacctgcctcaatctgcatgattcctttttttgtatctgtcccccacagtggaaggtgagtcatctactctttggttaagaatgatggcmggtcagcatctgtggtttccttggaatcatcaggcatatttaattctccatctaaagtttctaggattctgtggcctcccaaatcaaattgaaatatacc

SEQ ID NO: 25892 - DNA, 201 bp, Homo sapiens
agcatgctaatgcactataattagcatatagtgagcagtgaggacgaccagaggtcactttcctcaccatcttggttttggtggtgtttgactgccttctytactgcatcctgttttatcaacaaggtctttgcgacctgtatcttgtgccgacctcctatctcatcccgtgactatgaattccttaaactcctggaaatg

SEQ ID NO: 25893 - DNA, 201 bp, Homo sapiens
ccttctctctctctccctctgtctctccttctttctctctccgtctctccttctctctctttctccctccttctcttcttatctttccctttctttgttcytctctctccctctccctttttgtctctttctctctctcctccctgtatctctctctcactctctctttcttccctccctcctttatgccccacgacagga

SEQ ID NO: 25894 - DNA, 201 bp, Homo sapiens
ctgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgt

SEQ ID NO: 25895 - DNA, 201 bp, Homo sapiens
attgcatgctgctataatgagaaaagggaaaaactggattttttgacttctgttgaaattgtgatggcatcgagcggagctaatcaggaagctggacttgmaggcaggtttcaacacatttggtaatatatttgcactttctgctcagtcaccttcaagtgtctggtgtaattaaccttgggctctcctcaatgacacatc

SEQ ID NO: 25896 - DNA, 201 bp, Homo sapiens
ttattcctcctgatgccatcagtttatggcatatagtttcaggaaaatgccagccagcaaagcgctgactgcatttgagcagtcgccgggcaatacagcakttactttttaaattttgtgccttggattccatttagctgtttcattactggtttgcttttattaaagctcttataaaaaaaacacacagatacgaactta

SEQ ID NO: 25897 - DNA, 201 bp, Homo sapiens
tgtattctgccagagatggaggctatgaaaaatcaccattgctgggaatattctatggctcaaatctacccccaacaatcatctctcatagtaacaaactrtggttaaaatttaagagtgaccaaatagacacaaggtctggattctcagcttactgggatgggtcatcaacaggtaaatagcaaagagctgtcttttact

SEQ ID NO: 25898 - DNA, 201 bp, Homo sapiens
tgaggcaggagaatcgcttgaacctaggaggtggaaattgcagtgagtcaagatcatgccgttgcattccagcctgagtgacccagtgagactccatctcaaaaaaaaaaaaaaaaatagaaaaaaataaaaattggatttttaggctataactactctttcatgatgccattttgctgtgcaatttgatttaaaggatag

SEQ ID NO: 25899 - DNA, 201 bp, Homo sapiens
aagaaagtcaatggtagcttgatgggtatagcattgaatctataaattactttggacattatggccattttcatgatattaattcttcctatccatgagcrtggaatgtttttccatttgtttgtgtcctctcttatttccttgagcagtggtttataattctccttgaagagatccttcacatcccttgtaagttgtatt

SEQ ID NO: 25900 - DNA, 201 bp, Homo sapiens
cttggtttggaatagatactgtggaaagtcgatcccgccatctctcacaagcagtggtaactcattgatgctggtgtttgtgactgactccgacctcgctyatgaaggcttcttaataaactatgaagcaatcagtgcagcaacaggtaacaaaacagcattgcatactcggttttattgactccattgcaaaacagtgct

SEQ ID NO: 25901 - DNA, 201 bp, Homo sapiens
gaaattccttcaaatagatgggtattttcaaccactcataaccatattaattttcttgttacatatcagctttctatttctaaaccacaatttatctgcaratttgtcaagctacctcggtatattcgaaatttcttactcttgggttagtctctcatggcagtgaaaagttacactttgcaaaatgttctatagcattca

SEQ ID NO: 25902 - DNA, 201 bp, Homo sapiens
gatcatatgttttttgtcctctattctgtaaatatagtgagttaaattgattgattttgaatggtgaatcaactttgcattcatcaaatattttccatttkttcatggcaagttatgctttttatacattgctagattttatttgctaatatgtatttttaggatttttatatctatatttgggtgatattcttttgtaat

SEQ ID NO: 25903 - DNA, 201 bp, Homo sapiens
gctgggcaccataatcgtgatttggtaaagcgtaatggagaaagctacagaaaggaggatgcttttgaattgggctttaaaggaggctttggcagaaagagggggggaggaaagagatgaaacatttccaggacctgaactccatttctttcgactcatttgaggatgaaatggcaacaaaaaggtgtttaaaaactcaaa

SEQ ID NO: 25904 - DNA, 201 bp, Homo sapiens
atctgtgtacaattttctttatgtcacattcgtgaaaagttcttctactgaaaaccatggtttcatggctaagttcagtgctgaggatttgggtaagagaytgttcccttttttttttcctcctcttgggcttgtatcagaataagtgaatgatagaaataaattatatgaaaatcatctgtactgtgaaaaattttaaag

SEQ ID NO: 25905 - DNA, 201 bp, Homo sapiens
gaagttcatgaggcattagagagttattcgcatctcagatgttattttgagaattacagtaatatttgtcattaatggaatgcccatcatgtgctagacastactaccaatactttgatagatataattgtctgtcctcatagtagtccagtaactgagtataagtatgctcacaggagaacagggattgagatggggaac

SEQ ID NO: 25906 - DNA, 201 bp, Homo sapiens
tcttggtttggaatagatactgtggaaagtcgatcccgccatctctcacaagcagtggtaactcattgatgctggtgtttgtgactgactccgacctcgcytatgaaggcttcttaataaactatgaagcaatcagtgcagcaacaggtaacaaaacagcattgcatactcggttttattgactccattgcaaaacagtgc

SEQ ID NO: 25907 - DNA, 201 bp, Homo sapiens
ttgaaggactcacacttcctgatttcaaaacttagaacaaagctacaataatcaagacagtatcttattgaagtaaggatataaatatagatctatggaayacaattgcaagtccagaagtgaacacatacttttatggccaattgatatatgaaaatgatgccaaaacatatcaatggagaaaaatcattttttcaacaa

SEQ ID NO: 25908 - DNA, 201 bp, Homo sapiens
catggacttctccataagggctttgctttctctctgtgctctccgaatctgtttaaaggcaaatttcttctgtccttggaaagaccttgcatccgctctartaagtgaagcgtaaatcagtgtttgtgtttgcagtgcacgtcactgctggtcacatgatggcataacagattccaaacaggtgccaaggatgattcttca

SEQ ID NO: 25909 - DNA, 201 bp, Homo sapiens
aaaattgagataaaattattaatatctggacaagcactactataatttttatgcttacagcttgcggggatgaattaactggagaaggggtcattcgctcrcctttttttcctaacgtgtatcctggagaaagaacctgtaggtggaccatccaccagccccaaagccaagtcattctcctcaacttcactgtctttgaaa

SEQ ID NO: 25910 - DNA, 201 bp, Homo sapiens
tagtcattttatgtcctcaagtgttaagtggaaaatattctcatagaaatgttatattcggttatctcctcaggcagtattagattttgcaataaaattgrgataaaattattaatatctggacaagcactactataatttttatgcttacagcttgcggggatgaattaactggagaaggggtcattcgctcgccttttt

SEQ ID NO: 25911 - DNA, 201 bp, Homo sapiens
tgcactattattattcccatatttgatctggtatataagctggcaatggactgtgaatttatttttctagaactgtgtttaggatttgtgtatctatattrataggtgacatcagtctatagtttttatttctataatctatgttgggatttggtaacagcgttctaacaaaaattatttggaaattattctatgtttgag

SEQ ID NO: 25912 - DNA, 201 bp, Homo sapiens
gatgcttattttaatgcataattttctccccccaaaggcaaaaagaaactaattgtcattcatcagtgttgccccccaaacctactgcctagcccctccacccccacccagtacttttacaatgtgttattaaagaccactgaacagctgagatccaggggtctccttcaatgcgtaatcccatccagaaggaaggaaaaa

SEQ ID NO: 25913 - DNA, 201 bp, Homo sapiens
atttgaattgctttgaattaaaatttaatgcttattattttagaaattatagtataaaaccaaatctggattcatagcagaggaagacaaatgagcgtgcrtattaagacatggctttgggacttgactcattccagatgttaaagctcacgactcactaggctcaaaagcccacatttaaaatttcatgtaaatggtgtt

SEQ ID NO: 25914 - DNA, 201 bp, Homo sapiens
gtcctccgtctgaaccttttctttcaccaccttcccctgcatccttccctctacttctccctccccgctacactcctgcttcagcctaagcagccctcccrcatctcctgcatgtctttagatgaatgcaaattcacaaaggacctccttttgtgacttcttaggcattgagatgattccactatgagcttgggattgggt

SEQ ID NO: 25915 - DNA, 201 bp, Homo sapiens
gagagttccataagcactcattaaagaatagattttaactgcaaaagataagaatgatattgacccagtgtagcatatctttctttttttttaacacaagkaacacacattaacatgttaattcttagatttatatatctctcttaagtgaagtttctacttttaaagatatacattacccatggaagatgtgacatggct

SEQ ID NO: 25916 - DNA, 201 bp, Homo sapiens
ggtttagaggggggttgactttgtcctttactgactccattgatgagtaaaagcagtccacccaaaattttagaaagagtggagaagagaaaagaaattcyacagagatgtgggagaatgatcctaaggacatttactttgcatgtgaataggtgtacttttaagaatcctagatcttctctttgtgtggttttaggtgcc

SEQ ID NO: 25917 - DNA, 201 bp, Homo sapiens
tttgtgaactgaacccgttttctaaaaagtatattcacttctcttgttgttcttcagatagtggtcatacaagaaagtgatacaggaaccaaattctaatracattattatgactcaatatattgttccctaaaatgatgtcttcattttttaaagctatctctaaaaaatgaaatatttatgaaaaagaattaaaaaaag

SEQ ID NO: 25918 - DNA, 201 bp, Homo sapiens
aagagtaacaaagaacatctttacttgtcccctttcttcatttccttttctttccacggaatctggtgccaacctcctgttcccctttcaattgttttccrtgcaaatcaactccccctggctacatcttgctattctgtattcattttttctttaatctgcttcatgtatacagttatgtagtttattttgttacatgtt

SEQ ID NO: 25919 - DNA, 201 bp, Homo sapiens
gcttcccaagtagctgagattacaggcatgcgccaccatgcccagccgatttttgtatttttagtagacagagcgtttccccatattggccaggctggtcycaaactcctgaactcaggtgatccaacctcccaaagtgctgggattacaggcatgagccaccgcgcccggccagattactttaaattctacatttattca

SEQ ID NO: 25920 - DNA, 201 bp, Homo sapiens
cacatcactggcgtcaactctgggcatgcaaagatctctacaccatcgaaagcacacagacaacaacttgattttctcccacagttactttatcaagtttkttttttttttttttttccattctgctctcaacccccaattttcaaagtacagtcctggaggaagttatccctgggttgtgatatgcaggcaaaggcacgt

SEQ ID NO: 25921 - DNA, 201 bp, Homo sapiens
ctctgggcatgcaaagatctctacaccatcgaaagcacacagacaacaacttgattttctcccacagttactttatcaagtttgttttttttttttttttycattctgctctcaacccccaattttcaaagtacagtcctggaggaagttatccctgggttgtgatatgcaggcaaaggcacgtgtgtggaggatggaaga

SEQ ID NO: 25922 - DNA, 201 bp, Homo sapiens
agcagtgtttgtggggcgagagcaggaaccagacagtgtaaagaggtacaaagaggagagtgagtgtagactgaagtctaggtccctgaattctgaggctstctgtaacaaaccagagtaagtgatggcttcttttctccaatccttatccttcatttccctaactggtcctcatctagttcacgtgtgtgggacacactc

SEQ ID NO: 25923 - DNA, 201 bp, Homo sapiens
gcccttccaccatatgttcagatgttgttttaaattcataaacactaccttttgtagaaattgtacgtttctttctaaaaaatgcaggtcccattatattktttatattaattaggggcttgatatccataagatcgtctacttacaatttctagagaccactttagaaatccctgaaaatttgatttgcagatactacac

SEQ ID NO: 25924 - DNA, 201 bp, Homo sapiens
tctgacacatttgccagaggctttattcgaaagggtgaagattaaacatattctctcagtttgtgattggttatataaaacaccataccagctatgaatgwtggttattctttgttaagtcattcaaatatgatttttaaaaatttaaaagtgaaaatcgtgttttttagagtaagtgtagtgtttgagagaaattacttc

SEQ ID NO: 25925 - DNA, 201 bp, Homo sapiens
catcgaaagcacacagacaacaacttgattttctcccacagttactttatcaagtttgttttttttttttttttccattctgctctcaacccccaattttmaaagtacagtcctggaggaagttatccctgggttgtgatatgcaggcaaaggcacgtgtgtggaggatggaagaggtggaggtggcagtgggaagagagg

SEQ ID NO: 25926 - DNA, 201 bp, Homo sapiens; identical to SEQ ID NO: 5646

SEQ ID NO: 25927 - DNA, 201 bp, Homo sapiens
tgagcattgtcctatcagtatttctttctttttttttttctttttttttttttttttgagatggagtctcgctctgtcgcccaggctggagtgcagtggcrcaatctcggctctctgcaagctccgcctcccgagttcataccattctcctgcctcagcctcccaagtagctaggactacaggtgcccaccaccacacctg

SEQ ID NO: 25928 - DNA, 201 bp, Homo sapiens
gcaagctccgcctcccgagttcataccattctcctgcctcagcctcccaagtagctaggactacaggtgcccaccaccacacctggctgatttttttgtakttttagtacagatggggtttcaccgtgttaggcaggatggtctcgatctcctgacctcatgatctgcccacctcggcctcccaaagtgctagaattacag

SEQ ID NO: 25929 - DNA, 201 bp, Homo sapiens
cagaatcacctgtggagttacttacattagacttccagttcccaccgaaacccactgaatcgggatttcccagggaggagtcacagcacgctgtttttttwaaaaaaagctccctctgtgacgtcagtgcactgcctagggttgaatacccatgtttatttctgcataaatagaactgtagaaaatttggacacgtggctc

SEQ ID NO: 25930 - DNA, 201 bp, Homo sapiens
tgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtg

SEQ ID NO: 25931 - DNA, 201 bp, Homo sapiens
aggctcccgactctaccgtggaactcaacattctttccctggacattgaatctcaccgaacgtgtgcctatgatagccttgtgatacgagatggtgagaayattataaagaatgctgagtttcaaccctgacacataattagttctagtccattatcatcagacttgcatactgcctccatccgtttggtttggaattaca

SEQ ID NO: 25932 - DNA, 201 bp, Homo sapiens
tttaatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgagg

SEQ ID NO: 25933 - DNA, 201 bp, Homo sapiens
gaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtga

SEQ ID NO: 25934 - DNA, 201 bp, Homo sapiens
gctgaaaaaaatacttataattgtaatgtgactggacatagtggttcacaccataatcccagcactttgggaggtcgaggagaaggatcacttgagtccargagttccagaccagcctgggcagcagaatgagaccctgtctctaaaataataataagaagaatataaaatagtaatgtattcatttctctttgtcccctg

SEQ ID NO: 25935 - DNA, 201 bp, Homo sapiens
ttaatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgagga

SEQ ID NO: 25936 - DNA, 201 bp, Homo sapiens
ttcagacggtaaagaaatataatgtctccaaagtactctgaattggctgagataataagtgtgaatatttgtgtgtctgtgcatgtgtgtgtggggggggkggagagagagagagaaatgataaagtaatgggagcagaatacaaatacataataaatctgggtaaaaagaattcaggagctcattcttgcatcttttaaa

SEQ ID NO: 25937 - DNA, 201 bp, Homo sapiens
cctgcctctactaaaaatacaataattagtcagaagtggtggttcacccctataaaaccagctactcaggaggctgaggcaggagaatcacttgaaccccrgaggcagaggctgcattaaaccgagactgtgccactgcactccagcctgcgcaacagaggaagactccatctcaaaaaaaaaaaaaaaggggggggtggg

SEQ ID NO: 25938 - DNA, 201 bp, Homo sapiens
taatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgaggat

SEQ ID NO: 25939 - DNA, 201 bp, Homo sapiens
atttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtgg

SEQ ID NO: 25940 - DNA, 201 bp, Homo sapiens
acttgaaccccggaggcagaggctgcattaaaccgagactgtgccactgcactccagcctgcgcaacagaggaagactccatctcaaaaaaaaaaaaaaargggggggtggggtggggtgggggtaaagaaaagggcaggaagcaccattgcaagctggagccagaatgatatcacccctgaggggtccttctttttgagg

SEQ ID NO: 25941 - DNA, 201 bp, Homo sapiens
cgagctacagattcgctagctacagtaaaagtaacctttccccagcccttctaaagtgagcctgagggattcatgtgcaatatattgggatgaaaccgagrattgctctgaaggaaggtcatagctttattgagggagccttggcctttctagctgctataggcacttggaactgtttctgagagactctgttcaaatggc

SEQ ID NO: 25942 - DNA, 201 bp, Homo sapiens
aatgtcttaatacctgcagcgtggcagtgccttgatcaatatttgccaaatgaatgaatagaaagtgagagacaacggggacccatgtatccccccaacacacacacacacacacacacacacacacacacacacacacactgttccacagaagtatatgaaaataaatctcaagaggaaaaactataaacactgaggatg

SEQ ID NO: 25943 - DNA, 201 bp, Homo sapiens
tttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggc

SEQ ID NO: 25944 - DNA, 201 bp, Homo sapiens
cttgaaccccggaggcagaggctgcattaaaccgagactgtgccactgcactccagcctgcgcaacagaggaagactccatctcaaaaaaaaaaaaaaagrggggggtggggtggggtgggggtaaagaaaagggcaggaagcaccattgcaagctggagccagaatgatatcacccctgaggggtccttctttttgagga

SEQ ID NO: 25945 - DNA, 201 bp, Homo sapiens
ctctgaaggaaggtcatagctttattgagggagccttggcctttctagctgctataggcacttggaactgtttctgagagactctgttcaaatggctaagyatttctgagcccaggatcccagcagagccagtgttgacttaggtggtgatgaaggttctagatctgtcatcttggtggaccattagcacaaaaggtggga

SEQ ID NO: 25946 - DNA, 201 bp, Homo sapiens
ttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggct

SEQ ID NO: 25947 - DNA, 201 bp, Homo sapiens
tggcttaagagcatgggctttggaactagacctaagatacattttcacctctacaatttaactagctgtgtgagatgtctgcccttactgatgagcttctrgtccctgacaactggagaattaatgcctcctccttttatcctcttcctttatctcctgccctctcactctcatgtatatattactatgtatcgcaactca

SEQ ID NO: 25948 - DNA, 201 bp, Homo sapiens
tccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggcta

SEQ ID NO: 25949 - DNA, 201 bp, Homo sapiens
ctttcttccctttctgctttctgagaagcagaagaaaacaattttgcgtatttcacattgttgatcatattatgagtaataaaattgagcctgaatgtatrcacaaaagttggcagccatcccaaagatggatttagaccaattccttgcaaaataaaaaaaagattgaagatagaaatattgtgttataaatcatcagat

SEQ ID NO: 25950 - DNA, 201 bp, Homo sapiens
gtgtgtgtctatgtatatatacatacttggcagctcccggtctagaatgtatttcaaatttaacctgtgagtggtataatggactttggagactcagaagyggggaggatgggtggggtatgagggataaaaaactacatattaggtgtaatgtatactagtcagggaaccagcgcactaaaatatagacttcaccagtat

SEQ ID NO: 25951 - DNA, 201 bp, Homo sapiens
ggattaactgaagtcccagtttatgggttatatctaatagaaagcttaaagaaaaaaagtaaaaaaaaattagttttagatttttctttttgacatttttytccccatcaagaagcacaataaatgagctttgtcagttttctttatttcctcctatttaaattttttaaaaactggtattgctcaactgctgtttcttct

SEQ ID NO: 25952 - DNA, 201 bp, Homo sapiens
ggctggagtgcagtggcatgatctcggctcaccgcaagctccacctcccaggttcaagcgatcctcctgccttagcctcctgagtagctgggactacaggygcccaccaccacacccagctaattttttgtatttttagtagagatggtgtttcaccatgttggccaggatggtcttgatctcttgacctcatgatccacc

SEQ ID NO: 25953 - DNA, 201 bp, Homo sapiens
tgtgttataaatcatcagattgtcaaaggagacaaatatgtggtttgttttgtctgatgtggatatatcctgatttcaattatcagttatagcttgctgtraaaattccatctagtctagtccagatggtctatactgtagtgacccaccttggtgggattctgagagccaccagcttaccaccaggcttactgatttggt

SEQ ID NO: 25954 - DNA, 201 bp, Homo sapiens
agaaaaaagtgggcagtggtccttttgaaatgtttcctattgatattttattcaactggcagagcactggagcagatggtgtagtttctgtgaaatccctygtttgcctgtgttacactccaatttgctttaatttgtttggccttcgtgcgcaatggaacttagctgtatactagtacatgcttccccctcctctgaatc

SEQ ID NO: 25955 - DNA, 201 bp, Homo sapiens
cattatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaata

SEQ ID NO: 25956 - DNA, 201 bp, Homo sapiens
ctttcctttccttccttccttctttttccttccttcctttcttttcttttcttttcttcacagagtcttgctctgttgcccaggctggactacagtggtgsgatctcagctcactgcaacctccgcttcccaggttcaagcaattctcatggctcagcctcccgagtagctgggattacaggcaccagacaccatgcccag

SEQ ID NO: 25957 - DNA, 201 bp, Homo sapiens
taatcattatttatgtttttccacatatgcattgaaaaatcacaatttagaagacagttttggcgaagtagagaagataatatgagtcattccactaggayttttcacagtacagcaattcaccattgttcatttgttaaaaatctaaataaaaatgtattgaagtgtcatgaatcataaactatggaatcaaaaaacaag

SEQ ID NO: 25958 - DNA, 201 bp, Homo sapiens
ttcttttcttcacagagtcttgctctgttgcccaggctggactacagtggtgcgatctcagctcactgcaacctccgcttcccaggttcaagcaattctcrtggctcagcctcccgagtagctgggattacaggcaccagacaccatgcccagctaataattgtatttttagtagaggtggggtttcaccttgttggccgg

SEQ ID NO: 25959 - DNA, 201 bp, Homo sapiens
tgagcagtcgccgggcaatacagcatttactttttaaattttgtgccttggattccatttagctgtttcattactggtttgcttttattaaagctcttatwaaaaaaacacacagatacgaacttaaagatagtacctacataggagattattattaaatgtttcagtactggaattttataactcatggcttgttttgga

SEQ ID NO: 25960 - DNA, 201 bp, Homo sapiens
cagctcactgcaacctccgcttcccaggttcaagcaattctcatggctcagcctcccgagtagctgggattacaggcaccagacaccatgcccagctaatwattgtatttttagtagaggtggggtttcaccttgttggccgggctggtctcaaactcctgacctcaagtgatctgcctgcctcggcctcccaaagtgttg

SEQ ID NO: 25961 - DNA, 201 bp, Homo sapiens
ccagggaagcgttcacactggaggcgacatttaagtggcagagtctcgccagtagaaatgcagcagtgaggccacgaggggaggctgcaagggaaggatgrggaaatggtgcacgcacatttgggaataaaaaatgagagtgttgtccctggagcgtgaagaaatgctggggagcatgtggagaccaaggggctacagaag

SEQ ID NO: 25962 - DNA, 201 bp, Homo sapiens
cagattgtcaaaggagacaaatatgtggtttgttttgtctgatgtggatatatcctgatttcaattatcagttatagcttgctgtgaaaattccatctagwctagtccagatggtctatactgtagtgacccaccttggtgggattctgagagccaccagcttaccaccaggcttactgatttggttagagacctaccaat

SEQ ID NO: 25963 - DNA, 201 bp, Homo sapiens
taagaatttgaaattatcctataggtagtatggagtcagtgaaaattttctgtaaaacgggaataacatactcagagctgtattctacagtgacaacaggyagcagtgtgtgaagaatggcttggcagagaaaaagaaagatggtagcatgtctgtttgggaagcaatggaaaaagcttggatcagaggtgataaggtctc

SEQ ID NO: 25964 - DNA, 201 bp, Homo sapiens
ttctttgcttatattcattttcttctagatcactaagaatttataatgaaaaaaatcaaaagggaaagatctttgattagtaacatcatgacaaaaattcwaactatatgtccagccttggaattgaaatccagtcacaggccaggcgcggtggctcatgcctgtaatcccagcactttgggaggccgagatggtcagatc

SEQ ID NO: 25965 - DNA, 201 bp, Homo sapiens
tctccttctgagactcaaattacacatatgctgaaggttttgactgtttctaatagttcttatggttttatattcttgccttctttttttgctttgattcyatttggttattttgttttggaaagtctgtaagtactgttgaaatgttcttcaactattttgtcaaccttttcctctaagttttatcataattattttgga

SEQ ID NO: 25966 - DNA, 201 bp, Homo sapiens
agaattagaaaaaacttttttgttgttttttaaagaaaaaataccctatatattcatagtgatcttacactatattggaatattgagattatagagttgctttttttttttttttttactttacatttctacctcttctctcatacagtaaaaatcctggttcccaatgacatgaacatattatttatgtacttagtccta

SEQ ID NO: 25967 - DNA, 201 bp, Homo sapiens
ctcagaaaaagtaccttttaagtttcaatatcaggaagagtaacaaagaacatctttacttgtcccctttcttcatttccttttctttccacggaatctgstgccaacctcctgttcccctttcaattgttttccgtgcaaatcaactccccctggctacatcttgctattctgtattcattttttctttaatctgcttca

SEQ ID NO: 25968 - DNA, 201 bp, Homo sapiens
aatgttgaatagtcaagtaagattaatacacatccaactacatccttgtttgagatagttgtctgttgagagaaagggcatattgggtattgcagattgcktagcaatagtcctggcccctacccactagatactacccatcacaccgagtgtgacaatagaaaaatgactacaaaccttgccagaggtcccaaaattgct

SEQ ID NO: 25969 - DNA, 201 bp, Homo sapiens
tattttttcaaatattgcattgccacttttttcctctttcttctccttctgagactcaaattacacatatgctgaaggttttgactgtttctaatagttcytatggttttatattcttgccttctttttttgctttgattccatttggttattttgttttggaaagtctgtaagtactgttgaaatgttcttcaactattt

SEQ ID NO: 25970 - DNA, 201 bp, Homo sapiens
agagaggtttgtgcatgcgagcagtgcagtctctctggattttatcctcgggtcaagtccagctgcacaggggctggggctggcttccagcatcacagtgycccagactctagagcttcacttccagccaaatactattagctgttaggacctcagttgctttgataccttaaaacaaacaaacaacaaaacacaggaaat

SEQ ID NO: 25971 - DNA, 201 bp, Homo sapiens
aaccttctcaaatgaaaattatgtcacacttaaccattttaatatgcaaagtgatctggtttgctgaaacacacagaggttggcagaagttctggaattcyttacaatttcacatacagaaattaatatcatcaaagtgaaaaagatgactctacaatcctggtattcatcgctcagatggttcagccctgtttaaatagt

SEQ ID NO: 25972 - DNA, 201 bp, Homo sapiens
tatgtaaatttcatatcttacacatctaaaatgttacctatctcacttatttctaatgtctgtattactacagtctggatttttattatttagtgtttctrtcatttgatttacagtagcatttctcatagaaatctaagccactacagattctttgttaaataaatgtgggtattaatgaagagcaggttcttccagtca

SEQ ID NO: 25973 - DNA, 201 bp, Homo sapiens
tcacacccagtcttgtttccaatcttttggaattccaaatgttactgcaacaaaataccttattcacttgtcgtattgtatttttgccaatgtacctttgsgatatctttccaatggtagtattgtttggtcaaaagaaaatgaaatgcataggtttttgctaggtattgctatattctcttatgtagtgatcgtaccatc

SEQ ID NO: 25974 - DNA, 201 bp, Homo sapiens
ctattgacggacatttggcttgtttccagtcctttggccattttctttttagtcttttgttttttatttttgagacagggtgcgatcgtgtctcacagcarcctcaacctcccaggctcaagtgatcctccttcctcagtctccccagtagctgggactacagacacgcaccaccatacccagctaatttttattttttta

SEQ ID NO: 25975 - DNA, 201 bp, Homo sapiens
ataaactagaattaaggccccagaagtttttaggaaaatgctatttccagaattttgctaagtatatcaaatatgatatattacatttcaaaaatttccawatcagaaggaaaacgttgaaagattctctgtaaaatacagcagtatgtttatatagttaatagtatagtttctttatcgtgttttctctgacacatttgc

SEQ ID NO: 25976 - DNA, 201 bp, Homo sapiens
ttctgatctcctcaggttgaacttcccattaaaagcctcttttgcactttctctaatggttttagcattctttaggttcagtatttagatgagttattcaytgagacctacaacatgataatagtttgattttattatttcttctttatttatttattatttgaagttctttaatggaatagaagttactcatatcagcta

SEQ ID NO: 25977 - DNA, 201 bp, Homo sapiens
aatgcagtctagtaggtctcagccctattttatccagcccctattcaagatggagttgctctggtttgaatgcctatggtttattaccccactcccttttmcaaggggacctttaatcctaagggttgtagagggatgtcagtccattttctgtaactccttcaggatgaataggggtgatgatattcctgcctaactatt

SEQ ID NO: 25978 - DNA, 201 bp, Homo sapiens
acgcctggctaatttttgtattttttttagtagagacagggtttcaccatgttggccaggctggtctcggactcctgacctcaggtgatctgcccacctcrgcctcccaaagtgctgggattgcaggcatgagccaccgcacccagcctacttctctctatattataaattcaccttactattatttttgctttaaatcac

SEQ ID NO: 25979 - DNA, 201 bp, Homo sapiens
gtgactatgaattccttaaactcctggaaatgcagtctagtaggtctcagccctattttatccagcccctattcaagatggagttgctctggtttgaatgyctatggtttattaccccactcccttttacaaggggacctttaatcctaagggttgtagagggatgtcagtccattttctgtaactccttcaggatgaata

SEQ ID NO: 25980 - DNA, 201 bp, Homo sapiens
tgttcatatggtatatcttttttcattcttttagttacaacttagtttcaccattatatataatggcatcattatatataatgtgcatgcatagtaaaaarcatataattgggtcctgctttttctgtgttttagttgaagtatttagaccatttacaactaatgtaattatttttatggttgaatttaacataccattat

SEQ ID NO: 25981 - DNA, 201 bp, Homo sapiens
aactattacttcatgcatgcacatttaggattattatgttttactgataaattgtcccctttgtcattatgaaatgtctttctataaatctaataatattwtccttcttgaagtcacttttgtttgatattatttcagtgatttcagctttcttatatttactgttcatatggtatatcttttttcattcttttagttaca

SEQ ID NO: 25982 - DNA, 201 bp, Homo sapiens
atgtcttaatacctgcagcgtggcagtgccttgatcaatatttgccaaatgaatgaatagaaagtgagagacaacggggacccatgtatccccccaacacmcacacacacacacacacacacacacacacacacacacactgttccacagaagtatatgaaaataaatctcaagaggaaaaactataaacactgaggatga

SEQ ID NO: 25983 - DNA, 201 bp, Homo sapiens
ttggcctttttcttaatcttgacaggaaagcgtttagtcctttaccacttaagtatgatgttagctttggattttccatagatgccattcatcagtttgtkgagttcccttctgggcatacttgctgagtttttatcctggataggtgttgaatttttctgcatcttttggtatctttcaaagcttttctttttttattct

SEQ ID NO: 25984 - DNA, 201 bp, Homo sapiens
cgtgcatccttctagaagttgttttttttttgagacggagtctcactctgtcgcccaggctggagtccggtggtgcgatctcggctcactgcaagctccgwctcccgggttcacgccattctcttgcctcagcctcccgagtagctgggactgcaggcgcccgccaccatgcccaggtaattttttgtatttttagtagag

SEQ ID NO: 25985 - DNA, 201 bp, Homo sapiens
acgtgcatccttctagaagttgttttttttttgagacggagtctcactctgtcgcccaggctggagtccggtggtgcgatctcggctcactgcaagctccractcccgggttcacgccattctcttgcctcagcctcccgagtagctgggactgcaggcgcccgccaccatgcccaggtaattttttgtatttttagtaga

SEQ ID NO: 25986 - DNA, 201 bp, Homo sapiens
gtataatggactttggagactcagaagcggggaggatgggtggggtatgagggataaaaaactacatattaggtgtaatgtatactagtcagggaaccagygcactaaaatatagacttcaccagtatgcaattcatccatgtaacgaaaaaccacttgtatcccaattagattagatagatagatagatagatagataga

SEQ ID NO: 25987 - DNA, 201 bp, Homo sapiens
gtgtaatgtatactagtcagggaaccagcgcactaaaatatagacttcaccagtatgcaattcatccatgtaacgaaaaaccacttgtatcccaattagaytagatagatagatagatagatagatagatagaaaaaaaaatttcacctttgaaagttgaacactttattcccacccttttccatgccaccaccccccaat

SEQ ID NO: 25988 - DNA, 201 bp, Homo sapiens
gacataaatggataagaattgcgtactccttcttttgcaatgtaaaggagttgatgaaattttaatttgtctttccagctaagaaatggtcctgatatctrttctccacccttgggaccccctggaggaaatggtcatttttgtggcagtcatgcttcatcaactctgttcacctcggataatcaaatgtttgttcagttt

SEQ ID NO: 25989 - DNA, 201 bp, Homo sapiens
gtatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtccttta

SEQ ID NO: 25990 - DNA, 201 bp, Homo sapiens
tttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacc

SEQ ID NO: 25991 - DNA, 201 bp, Homo sapiens
tatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttac

SEQ ID NO: 25992 - DNA, 201 bp, Homo sapiens
ttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacct

SEQ ID NO: 25993 - DNA, 201 bp, Homo sapiens
atttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttaca

SEQ ID NO: 25994 - DNA, 201 bp, Homo sapiens
tcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctc

SEQ ID NO: 25995 - DNA, 201 bp, Homo sapiens
ccaaatatatatgtgtgtgtgtctctgtgtgtgtatatatacacacacatatatacacatcatatatgtgtgtgtgtacatacacagatgatttttatttwttttttttaaaggaaaatctcatcttggagcacttatgaagtatataatagtggttcttaacagtcatttctttttccagcatgtgagaatgtggtaata

SEQ ID NO: 25996 - DNA, 201 bp, Homo sapiens
cacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctct

SEQ ID NO: 25997 - DNA, 201 bp, Homo sapiens
aacttccttattgttcaatacagacatttaataaattgttgatgagttttgattatgtctcgtaccactgccatttcatgaatgaactttctgtatttcarctagttcctttaatcaactatttgtcaacataatcaagtataagtgacactataccttatgtttcacagccttttcactgttttctaagacaactgccac

SEQ ID NO: 25998 - DNA, 201 bp, Homo sapiens
acttctccataagggctttgctttctctctgtgctctccgaatctgtttaaaggcaaatttcttctgtccttggaaagaccttgcatccgctctagtaagygaagcgtaaatcagtgtttgtgtttgcagtgcacgtcactgctggtcacatgatggcataacagattccaaacaggtgccaaggatgattcttcaatttc

SEQ ID NO: 25999 - DNA, 201 bp, Homo sapiens
acctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctg

SEQ ID NO: 26000 - DNA, 201 bp, Homo sapiens
caagatttcaatccagcatcagcaatttttccctacattctgtgattttggttttataacttgatatattgttgctaaataatttctataactaatgcacmatttttttattctcaaactcatctactttgaattttttaaaattccagtggagcttttgatgtcttaaagacaaatactgaggttataactaaggtacat

SEQ ID NO: 26001 - DNA, 201 bp, Homo sapiens
tcttccagctcaaaggtctatgatttcacgttgttctatgaaccaggttcttctctgttcctgagaccatctgcagcaggtggtgagaattttaagaggcwtaataataataataataataataataataataataaatgtttagtgttttactgtagcaggataattggcagagggaaggctgaggtttatggaattaaa

SEQ ID NO: 26002 - DNA, 201 bp, Homo sapiens
ggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctgcctc

SEQ ID NO: 26003 - DNA, 201 bp, Homo sapiens
ttgggtcattcccaatggggcatttgtaagtaagtaaattttgtgtgttggggtgatgtggatcattagatatatgttcaagttagcatcgccatgaaatraaagcattttgttcttgtggcttgtaaatgaaaatgggaaaatatttcacattgttaatcatcagagcaattaaaattaaatatcacaatgaagtttcgt

SEQ ID NO: 26004 - DNA, 201 bp, Homo sapiens
ggttcaccaatcagaaagacataatctttgcccaaagccccattgtagggggtactatctggaattttaggatccctcctcagacaagcaggcctatcaawagctattcctgaagctaggatatgggtagcatcagaaattgtatccttcctattcatataagtgaggacaaaaggcatcactcttccaactctggagatc

SEQ ID NO: 26005 - DNA, 201 bp, Homo sapiens
tagcagcgctattgacatgttgggctaggtagttttttgtgggtcccagagggtccggggtgtaggtgctgccctgtgtatagcagcatcttcaggagcawccctggtctctactccactctacagtgtgacagcaaaaatgccttcagatagtgctaggtgttcttggggaggcaacacggtccccagtttacagtcact

SEQ ID NO: 26006 - DNA, 201 bp, Homo sapiens
gcaaagaaatctccaagggaccacaaaaacccccgggatattggttatgtacccttcaagctgtaggggaaggagaatttggcccaacccaggtacatgtmcccttctccctctctgatttaaagcagatcaacgcagacctggggaagttttcagatgatcctgataggtacatagatgtcctacagggtctagggcaaa

SEQ ID NO: 26007 - DNA, 201 bp, Homo sapiens
gctgtgccctgtggttgggccccttcattctccttcagacctggcatataggaagcctgcccagaaagcagccgagctgacctccgtccccctgtgactarcctcttacccacaattgtgtctactatgtgtttacagcattgaatctatgagggcaaggacagctgtttcttaactcagggttttcctcaaccctagttc

SEQ ID NO: 26008 - DNA, 201 bp, Homo sapiens
ggggtgtaggtgctgccctgtgtatagcagcatcttcaggagcatccctggtctctactccactctacagtgtgacagcaaaaatgccttcagatagtgcyaggtgttcttggggaggcaacacggtccccagtttacagtcactgagttaaaggaaccgttatctaaagaaaggaaattctgaattgtttcaaggtggaa

SEQ ID NO: 26009 - DNA, 201 bp, Homo sapiens
tgacctccgtccccctgtgactaacctcttacccacaattgtgtctactatgtgtttacagcattgaatctatgagggcaaggacagctgtttcttaactmagggttttcctcaaccctagttctcaatttttagagaccagcaactgtcatacatattcatttattcatttgttcatcaaacatttattgcctgtatgtg

SEQ ID NO: 26010 - DNA, 201 bp, Homo sapiens
ggtggaaagtgtctactgtgaagtcctacctgttttatcatacctgtgcttgttttgtagttagagtaaacattgtttcaacaggaaactaagttaaatayctcgtttctcattttaatttttatagcaattgcatgagtcatcatcacatttttgtttttatttttatggccttaattgtttgtgtaggttctgatcata

SEQ ID NO: 26011 - DNA, 201 bp, Homo sapiens
atcagatgaagagtgttctttcctatgtcaactactattgctgtataactaatttcccacaaatttagtgttgtagaacattaatcatttgactttgtttytgattttgtgggccaggaatttggaaagaacctaacatgacagttgctacttgaaatctattcagcagttataagcgggtgtcagctgggactgtagctg

SEQ ID NO: 26012 - DNA, 201 bp, Homo sapiens
tacatagatgtcctacagggtctagggcaaacctttgatctcacttgaagagatatcttgctattgttagatcaaaccctggcctttaatgaaaagaatgyggctttagctgcagcccaagagtttggagatacctggtgtcttagtgaagtaaatgataggatgacagctgaagaaagggacaaattctctactggtcaa

SEQ ID NO: 26013 - DNA, 201 bp, Homo sapiens
gtgcccatgcctgggttccaatatccagagacaggattcagttggtctgcagtggggccctgactattgctaatttctaaatgctccttaagtgattcatccgtacagtcaggatggagagtttgggagggcagtgattttgctgattactttctcctaagtggctgcttcctctcccctccaggctgttctagccttact

SEQ ID NO: 26014 - DNA, 201 bp, Homo sapiens
gtctatctatctatatatatatgtatgtatacaatctaaatgtattttttcagttttcagcctggatcctggagctcaccataatgaaatttacatctgcrtgtttattttattttacttatttatttatttgagactagctctcactctgtcgcccaggctggagtgcagtggcgtgatctcagctcactgcaacctcca

SEQ ID NO: 26015 - DNA, 201 bp, Homo sapiens
attttttttctcaaggctgttgaaaggaagcatttattatatattttatatataaatatatattatttagtctatattttcaaaattattccatattatgrattgtttattagagctactgccaaaataaattgaaaatgcaggctgggcatggtgtcccatgcctgtaatcccagcacagggaggctgaggcaggcaggt

SEQ ID NO: 26016 - DNA, 201 bp, Homo sapiens
taagctataataaacccaccacaaaactctaaagtaaatccatgtaagaagccttgcttgttcaggaactctagaaatcgttatttgaaatgacaaagaayaagacctgaattaaacactgtataagacagagaaaagttagggatgcatctgtcaggataggttatgcacatagtaacaaacaactccacctcacagcag

SEQ ID NO: 26017 - DNA, 201 bp, Homo sapiens
ttaagaaatgggagaggctttacagtaagatgggaaacacagcaaccaggtatgtgtgaacctggagaaaaaagcaagcaaaattttgaggttattaagtkttcttaatcagtgttagacttttggatacatgagatgttttgggatctgaagatatataatatttttataatttattttattttattcatttatttattt

SEQ ID NO: 26018 - DNA, 201 bp, Homo sapiens
actatttttgttccacatcctacatttactaacagatctaagccaaagggtgtagttgcttataaaatgtaccagcctaaagcaaagacttccaagcatawtaaagctttttttatagtttaatttaatccttctaggtatttgcctaccaccatgtccaacggaatgtcttttctgccatctagcactggattgcagtag

SEQ ID NO: 26019 - DNA, 201 bp, Homo sapiens
ggaagagtaaatatggtatttttaatgagacctaaaaaactaaagtattgctgggatagtaaatatcagttcaacttgtcaaaagttgttctcagatggaytttaatatgccctagactgtgaattccttgaaaagtaagactgtatcttactcactttgacatccccagctgctgtcacagtttttgttgtattgtaatt

SEQ ID NO: 26020 - DNA, 201 bp, Homo sapiens
gacttgtctatagagctaaacttttaaatcctcttgttttcctaggctggcaaggcaatggatatatttgcgaagatatcaatgaatgtgagataaataayggcggctgttctgtggctccacccgttgagtgtgtgaatacacctgggtcttcccactgccaggcctgtccaccaggtgctgcctcggttcaatgtcaac

SEQ ID NO: 26021 - DNA, 201 bp, Homo sapiens
tagtaatgcgtaagagttctaatttctccatatcctcatcagcacttcttattttctatttttaaataatagtcttcctggtggtttgtagtgttatctcwttgtggttttgatttgcatttctctaatgactaataatgtttgaaaatcttttcatgtttttattggccattcataaatcttctttggagaaatgtgtat

SEQ ID NO: 26022 - DNA, 201 bp, Homo sapiens
aaggaaatgcctgtacatttttgaggtgccatttccatgcagctgctttccttatagtatgcagctccaaaaccgccagatgctttggtagccctaaatcrtgagttgtttgtttgccatagcaagggtattgctgtctccttgggcttcacttctttgaattcttgagtgtgtatgggacatactttatatgcttctctt

SEQ ID NO: 26023 - DNA, 201 bp, Homo sapiens
atctctcacctgaactagggcaaaacctacctgactgttttccggcatcctttctgactcctattttccgaattgtaatgttttccaaaaaccaatcttcytggtggctccttgctgtattcaggacagtggcccgagtctctaacgtgtcctgcagccccctctgcaggcttcctcaccccttcctccttggttttctct

SEQ ID NO: 26024 - DNA, 201 bp, Homo sapiens
tcttctctgtgcatttgcagcttgggaatgagctaaggacccaaggaaatgcctgtacatttttgaggtgccatttccatgcagctgctttccttatagtrtgcagctccaaaaccgccagatgctttggtagccctaaatcgtgagttgtttgtttgccatagcaagggtattgctgtctccttgggcttcacttctttg

SEQ ID NO: 26025 - DNA, 201 bp, Homo sapiens
ttttccaaaaaccaatcttcttggtggctccttgctgtattcaggacagtggcccgagtctctaacgtgtcctgcagccccctctgcaggcttcctcaccmcttcctccttggttttctctctcttctctgaactagccacggcctttcctgccatcggggttcgctcggggcaggctcacttcccccagttaggtaaagc

SEQ ID NO: 26026 - DNA, 201 bp, Homo sapiens
aaagtatctcctttctgactgaatgaggcaacacatcccttcagtatttattatgcagtctctcttcaattcttagcaacttccctcccctccgaaactgytctctgttagttagacctgctgtcttctctgtgcatttgcagcttgggaatgagctaaggacccaaggaaatgcctgtacatttttgaggtgccatttcc

SEQ ID NO: 26027 - DNA, 201 bp, Homo sapiens
gggcttgaaacacatgcagattcctgagcctcactccaggcccaactgaattcagaatttccatgacgaagtctttcctgttttttttttttttttttgasacggcgtctcactctgtcgccaggctggagtgcagtggtgcaatctcggctcactgcaccctccacgtcctgggttcacgccattctcctgcaacctcca

SEQ ID NO: 26028 - DNA, 201 bp, Homo sapiens
ccaggcctctgggcctgtgatgggaggggtttcagcaaaggtttctgaaatgcctttggggacttttctccattatcttggatattagcagttggcttttrgttatgcaaatatctctagcaagtggatgcctcacagcctgcttgaattcctctcctgaaaaagctttttctttctctgccatatggccaggctgtaaat

SEQ ID NO: 26029 - DNA, 201 bp, Homo sapiens; identical to SEQ ID NO: 5664

SEQ ID NO: 26030 - DNA, 201 bp, Homo sapiens
tttcataaaagtatctcctttctgactgaatgaggcaacacatcccttcagtatttattatgcagtctctcttcaattcttagcaacttccctcccctccraaactgttctctgttagttagacctgctgtcttctctgtgcatttgcagcttgggaatgagctaaggacccaaggaaatgcctgtacatttttgaggtgc

SEQ ID NO: 26031 - DNA, 201 bp, Homo sapiens; identical to SEQ ID NO: 5667

SEQ ID NO: 26032 - DNA, 201 bp, Homo sapiens
tagagatggcattgaactgtagactgctttgcatagtatggacattttaacagtattctttcaatttgtgaacaccaaatattttctttttttcattaatstggtatagttttcaaaatacagatatttcactttcttggttaaatacattcctaagtatttaactttttgacactattgtaaatgggattttcttcttaa

SEQ ID NO: 26033 - DNA, 201 bp, Homo sapiens
tgaaatagaagggattaaaaaacatgagtcttagttggtcccttatcaaattactgaacagcctttttataagctctactagtagtttactgcaggaataytgaggacattgtccaccccttcatgtagtattccttcatcttaatgatcactcaataattttttctttttgttattattttgttttaattattctatttt

SEQ ID NO: 26034 - DNA, 201 bp, Homo sapiens
tcaagcaatccatctaatttggcctcccaaagtgctgggattacaggcatgagccactgtgaccaaccataattactttaaaatcaaatcaacctagaatkaattagaatttattttgtgtctaaaggcaacaaaataagcatgaaatagaagggattaaaaaacatgagtcttagttggtcccttatcaaattactgaac

SEQ ID NO: 26035 - DNA, 201 bp, Homo sapiens
ttgtgaatggtaatattagccagttcaacttaattcaggtagattttcaaatctccaatttattttactgctttagaaacaatgtcagttatatatttgamataccttggtctggtggacttgacaagtttaatgaaattggggtaaatctatgttattaacattaagattttttgatatattttgatattagttgaagtt

SEQ ID NO: 26036 - DNA, 201 bp, Homo sapiens
ggatagttcaattaatgaacatttgagtttcatttaaactgttttaagaaagtcatgtagtaataggtaactgatcttaaaataccctagcacagaatttwaaaaattccttatattctttttcattaactgaatattgttgtgattttaggttctgatgaaaattaaattcgacagccttcttttgattgtttatctcaa

SEQ ID NO: 26037 - DNA, 201 bp, Homo sapiens
aaagaattttatgggaattacattgaaactataattaactttggaagaaatgacatcttaaaaatattcagcctgccaatgcatgaacataaactattttwaaatttagttctcttttcatttatcctggcaatgttttatagctttcagtgtctaagtattccatatctttgttagatttatttacagatatttgatata

SEQ ID NO: 26038 - DNA, 201 bp, Homo sapiens
ttcagcctgccaatgcatgaacataaactatttttaaatttagttctcttttcatttatcctggcaatgttttatagctttcagtgtctaagtattccatrtctttgttagatttatttacagatatttgatatattatgcttagtgaaatattaattttctaaaatttaatttttcacttgttatgtaaaaatatgtatt

SEQ ID NO: 26039 - DNA, 201 bp, Homo sapiens
tagtaagtcgattcgtcttttaaagatttactttcttactggctagtgttttctcataattttgtatgtacaggtgtcccagcacttctctgctcagttcrtttatcttgtttgttatatttcttactccttagaataaaaatgcaacaaaatgcttaatcatgatattctgagttccctacttgtcttcatccttaaatt

SEQ ID NO: 26040 - DNA, 201 bp, Homo sapiens
catctttcacaatgaaggattttcgtatgattgcattaatttgcagcagttaatgaaccaacgttccaaccttcaaaagagcctctgctctcagattcaaragaaactctgcgtgtttcctctcttcaaacatgaaggacagaattaggatgaataataatcaaacctaaaataatttctgaactaccctgaagcagtaaa

SEQ ID NO: 26041 - DNA, 201 bp, Homo sapiens
ctttgggaggccgaggcgggtggatcatgaggtcaggagatcgagaccatcctggctaacaaggtgaaaccccgtctctactaaaaatacaaaaaaaaatyagccgggcgcggtggcgggcgcctgtagtcccagctactcgggaggctgaggcaggagaatggcgtgaacccgggaagcggagcttgcagtgagccgaga

SEQ ID NO: 26042 - DNA, 201 bp, Homo sapiens
ggatcatgaggtcaggagatcgagaccatcctggctaacaaggtgaaaccccgtctctactaaaaatacaaaaaaaaatcagccgggcgcggtggcgggcrcctgtagtcccagctactcgggaggctgaggcaggagaatggcgtgaacccgggaagcggagcttgcagtgagccgagattgcgccactgcagtccgcag

SEQ ID NO: 26043 - DNA, 201 bp, Homo sapiens
ggagaatggcgtgaacccgggaagcggagcttgcagtgagccgagattgcgccactgcagtccgcagtcccgcctgggcgacagagcgagactccgtctcaaaaaaaaaaaaaaaaaaaaaagagatgacatcttttgttgtggagtgcattctccttctgcataactgttagtgccatagtctgagtcattatttctaat

SEQ ID NO: 26044 - DNA, 201 bp, Homo sapiens
tatggtatttttaatgagacctaaaaaactaaagtattgctgggatagtaaatatcagttcaacttgtcaaaagttgttctcagatggactttaatatgcyctagactgtgaattccttgaaaagtaagactgtatcttactcactttgacatccccagctgctgtcacagtttttgttgtattgtaattactaaaaacaa

SEQ ID NO: 26045 - DNA, 201 bp, Homo sapiens
gttactgttcctgtattgtttatctcttccgttgtggcctgaatcttactactactttctctgttgccttctgttttcttagtgtgtggtgggtctcttcsaaatactcctgaaggaaactttacttctcctggctatgacggagtcaggaattactcaagaaacctgaactgcgaatggactctcagcaatccaaatcag

SEQ ID NO: 26046 - DNA, 201 bp, Homo sapiens
aaggctggaagatgtctttccggcagacattgggtaagaattctggacttgtaaatctatttttcaggactgttacctttctgctttatttaatttccccrccccccccccacccccacctgattatgattgcttttccttgaagcttagaagaatatgccatgtaagggcttggttttaaaacttacgtatgacatattt

SEQ ID NO: 26047 - DNA, 201 bp, Homo sapiens
acaggtgtacatcaccacatacaactaattattaaaattttttgtagagatggggtctccctatgttgtccaggctggtctcaaactcctggcctcaagtratcctccctctttggcctcccaaagtgctggggttacaggcatgagccaccacggctggcctacaatattcttcatatgcttggagactactaacaatga

SEQ ID NO: 26048 - DNA, 201 bp, Homo sapiens
ctagcctgggtgacagaatgagactctgtctcaaaaaaaaaaaaaaaaaaaatcactttggtagcacagtggaggaaggctagaagaacctacaacatggraaggaagaagcttatgatagaaatctagatgggaagtgtcaaagccttgaacggacccagaggggaaagagataaagggaagggcagaaatctgagagac

SEQ ID NO: 26049 - DNA, 201 bp, Homo sapiens
gctgaggcaggagaatagcttgaaactgggaggcagaggttgcagtgagccaagatggcaccactgcgctccagcctgggcaatagagtgagattctgctaaaaaaaaaaaaaaagagctatttagaaggtaggatgggcagatctgatggtggagtagatgtgtgtcaatctgggagacagaagaaggaatcatggatag

SEQ ID NO: 26050 - DNA, 201 bp, Homo sapiens
caagttgtagtcagtgccacaaagaatccatgtggctggttgtataaaagggcatatttactcatgtctcatattctatttttgttttttataaactcgaratttattaattctctgccttaggacaaaagagaaaaaaacaacatattttcccagccacggcatccaagtctgctataatcccctttgctccattttggt

SEQ ID NO: 26051 - DNA, 201 bp, Homo sapiens
ggtctccctatgttgtccaggctggtctcaaactcctggcctcaagtgatcctccctctttggcctcccaaagtgctggggttacaggcatgagccaccayggctggcctacaatattcttcatatgcttggagactactaacaatgaagggagtcaaatggctctaacataggtacacacgatccaaaagaactctgttc

SEQ ID NO: 26052 - DNA, 201 bp, Homo sapiens
aaaaaagacatatggccagatggaaagagctgattgatgcatgatatcattgcttggtgatacggctttagaaaagccctataacgttttgaatctcaatytttatctactaaaaaactgatcaatttgaaatattacaactatttaagaatgtgatggggataaagcagataatttctggaaagcaccttagctgtcaga

SEQ ID NO: 26053 - DNA, 201 bp, Homo sapiens
ccactcccacttctcagcctttaacctaggtccttttgtgaacattttttgacatcaaatcacctagttttataccatttttctccagagacactccttcrctatggttgattgagatttctaggaccctgtggtagatgccttttattctcacctgattaataggcctgttaattaattagtcaaacatttacaaggtgt

SEQ ID NO: 26054 - DNA, 201 bp, Homo sapiens
gatatcattgcttggtgatacggctttagaaaagccctataacgttttgaatctcaatttttatctactaaaaaactgatcaatttgaaatattacaactrtttaagaatgtgatggggataaagcagataatttctggaaagcaccttagctgtcagagtgaaagactctatgtattagaaagtaatattgaagtcccaa

SEQ ID NO: 26055 - DNA, 201 bp, Homo sapiens
atctttgggagaaattatagcttgcttttactctgaaataaagatgtttccctttttgcatggtctggtctaaatgcttaatcatatgggaagaaaaagasaagccagtggattggccttatggaaatgaacgttagaggataaacagttaggggcttgatgaaatgttcaaaggcttttcttgctgattttcatgattgt

SEQ ID NO: 26056 - DNA, 201 bp, Homo sapiens
ctcccacttctcagcctttaacctaggtccttttgtgaacattttttgacatcaaatcacctagttttataccatttttctccagagacactccttcgctrtggttgattgagatttctaggaccctgtggtagatgccttttattctcacctgattaataggcctgttaattaattagtcaaacatttacaaggtgtttc

SEQ ID NO: 26057 - DNA, 201 bp, Homo sapiens
actctatgtattagaaagtaatattgaagtcccaaattttcaagccccccgcccaaccctatttccaaggttggagggtggctgagggtggggtgggcagsgatcaacattctcaacaggaccacatcatgctacagtgatttttcgttctttcctacccactttgcagtgacacctaaccgtcaaatcctaaagtacatt

SEQ ID NO: 26058 - DNA, 201 bp, Homo sapiens
tatggttgattgagatttctaggaccctgtggtagatgccttttattctcacctgattaataggcctgttaattaattagtcaaacatttacaaggtgttycacatcatgcaaaccaccgagttctgccaaggagttcacagtgtggtaaaggagacagacaagcaaaggcacaattagaacatgatataaggctgggcac

SEQ ID NO: 26059 - DNA, 201 bp, Homo sapiens
atgtaataaggaagttgaattataacttgaataattggataaatcactgatcaaacaactctcagtttagcaataatgagggtattgctccaaagcaaccrtggaatgtcatttttctggtttcctaatgtcatttgctccctgtgatgaagtctgagaatgagatgagctgaaactgtaaacccatttaaagaaaaaccc

SEQ ID NO: 26060 - DNA, 201 bp, Homo sapiens
cacctgattaataggcctgttaattaattagtcaaacatttacaaggtgtttcacatcatgcaaaccaccgagttctgccaaggagttcacagtgtggtaraggagacagacaagcaaaggcacaattagaacatgatataaggctgggcacggtggttcacgcctgtaatcccagcactttgagaagccaaggcaggagg

SEQ ID NO: 26061 - DNA, 201 bp, Homo sapiens
cagaaacacctacttcagcccaggacatcagagagggttccaggggaagtggatgaagagatttgcccatcagtgataaaaagatgtgaatgcatagaaartctcaatgttacaagtcatattcaataatttgaaagaattcactactgctagagatcagagtcaaaaagagataaacataatagtgatgaagcaggcagg

SEQ ID NO: 26062 - DNA, 201 bp, Homo sapiens
aaaaggttatgggaggcattggaagtttttgctccaaagcctgaacagcgtgatcagattaaaaacactaatgtagctgcaacactgaaaacattggagayggggaaggctgaagagagagagaccagatgaaagagtaatttagggaaaaaatttactccctgaactaaggcaatggcagtaagaaggtaggagagaggg

SEQ ID NO: 26063 - DNA, 201 bp, Homo sapiens
tgaggctcagatttggacagagtttaaagggtcacagaacaccactgccatggacgtggtgctgcccacctgtgtccatttctccgggtggagtcctctcmctgcagagggaaggttagaggttggaggaggtgagggaaggaatcagggagaggcctgcaatgtaggtccctggaggctctttgagcttttccctgcaag

SEQ ID NO: 26064 - DNA, 201 bp, Homo sapiens
ttctgagctcttagttaccaattcacatcacacctgccttaccaaaagggtccttgctggcagtttctcttctgtgtcctcccttcctccacaagctgcctttttttttttttttttagatggagtctcactctgttgccaggctggagtgcagtggtgtgatctcagctcactgcaacctccacttcttgggttcaagtg

SEQ ID NO: 26065 - DNA, 201 bp, Homo sapiens
aacttcttccataaagtcacttttgactcttctgcccctcacttaaactcctgatttggaatcaacacatttattgagaggttgttgttatatgtttaggrcaatagtagaccctatggaaaaatatgaaagtgtaaaatactgtctccacttatgaactgctcaccttgcagctgaggagacaagaccaaccccaatggg

SEQ ID NO: 26066 - DNA, 201 bp, Homo sapiens
aacttcactcaagcaagttttctttcgtcaccggaccccatgtaccaccatgagtattttccactgtgttcatttatttggaatgtttctcccgataaacstcctcacacatcttccttgtttctcatccagatgtgtctgtccctcaggagcacttccctctcaacttcttccataaagtcacttttgactcttctgccc

SEQ ID NO: 26067 - DNA, 201 bp, Homo sapiens
caatgatcttctataaccaagtctcactcaatccatctaaccttttttttcactagttccctagaaataacttcactcaagcaagttttctttcgtcaccrgaccccatgtaccaccatgagtattttccactgtgttcatttatttggaatgtttctcccgataaacctcctcacacatcttccttgtttctcatccaga

SEQ ID NO: 26068 - DNA, 201 bp, Homo sapiens
gccaggctggtctcaaactcctgaactcaggtgatccaacctcccaaagtgctgggattacaggcatgagccaccgcgcccggccagattactttaaattytacatttattcattatttctgtttataaaagaatatatattcatatatgaaacatatataaggtaaggtaggaagattcaaaaattccttggtaaattaa

SEQ ID NO: 26069 - DNA, 201 bp, Homo sapiens
ggcactacattcctattatttgggttgattaaagtttagtgtctatccatttgttttatggtattatgtgttttttttccccttaggacactgtctctggytatttttgtaagtgtgactcaggttggacaggtgtcaactgtacagaaaacatcaatgagtgtttgagcaacccctgtttgaatggaggaacttgtgttg

SEQ ID NO: 26070 - DNA, 201 bp, Homo sapiens
agtaactttatatttttagctacctgtgtacctgattagtttatgttaagaatagagattttaacattgaaagtacagattacttttttttttttgaaatrgaatctcgctgtgtcatccagcctggagtgtagtggcgtgatcttagctcactgcaacctccacctcccaggttcaagtgattctcctacctcagcttcc

SEQ ID NO: 26071 - DNA, 201 bp, Homo sapiens
  misc_feature (1)...(201): n = A,T,C or G, or insertion/deletion polymorphism (see Tables 1-2)
cagaggaggagacctgtatttacacgtttgtttttatttctgaacaggttccttacctctctgcacgtgtctcccgggttatactggaaatggttatgggncaaatggatgtgtgcagctcagtaatatttgcctaagtcacccctgtctaaatggacaatgcatcgtgagtcctttgtttttcctgtggacagagagtac

SEQ ID NO: 26072 - DNA, 201 bp, Homo sapiens
aaccaaagtttaaaccatggaattatatagggaacagaggaacttccaatattttgaatacatagatcagtaaaatcagcatttccgcatgtcaggctggktccaacatacattgcccgcgtaacgtttccgtaagaagcgtcgagagccctcctggaagcagggctggttgtgaatgcagggtagcagccaggctggggg

SEQ ID NO: 26073 - DNA, 201 bp, Homo sapiens
taaaaaattttttcttggaaatggagtctcactctgtcacccaggctggagtgcagtggcactatctcagctcactacaacctctgcctcctgggttcaartgattctcctgcctcaccctcccaagtagctgggattacaggcgtgtgccaccatgcctggctaatttttgtatttttagtagagacagggtttctccac

SEQ ID NO: 26074 - DNA, 201 bp, Homo sapiens
atccgcctgcctcggcctcccaaagttcagggattacagattccatagggctctttattagtattattattattataattaaaaaattttttcttggaaayggagtctcactctgtcacccaggctggagtgcagtggcactatctcagctcactacaacctctgcctcctgggttcaagtgattctcctgcctcaccctc

SEQ ID NO: 26075 - DNA, 201 bp, Homo sapiens
cgtggatgttaattcatgttttaaatagacacgatcatttcaaattccttttgaccaagttccttcctaacctaattcgattgccattgttttaaccttgwaccttggcaatgaggagctcatcagaagtgtgggagaagttttggtgctggtattttgttgatgtccccatatatttatgttactatattatcttcaatc

SEQ ID NO: 26076 - DNA, 201 bp, Homo sapiens
acaggcgtgagccaccacaaccagcctctgtgattcttgctttgcaatttctactgttgttacaggaacatttcaaagcccttcaaatttaaagtaacctraacttggataaagttccaagtttttccaggagatgtgagtgcaaacctcagcaacaacatttttaacaatcaccctaatgaggcctctccacagatcctg

SEQ ID NO: 26077 - DNA, 201 bp, Homo sapiens
ggatattaaatttagtaaaattttgtaatgtctatgacgagtatttttaacctaacattgcgtaagaaaactgtcaagatgctggatgctctaaaactctwgttagctattacctcatgtacatcataattaatcgtggatgttaattcatgttttaaatagacacgatcatttcaaattccttttgaccaagttccttcc

SEQ ID NO: 26078 - DNA, 201 bp, Homo sapiens
tctagaaggactaaggagaattaggaaaaagcccatgaattattcaatgatgtccaccataactcagggaaaggaagaaaatccttctgccttcctcaagyggctatgggaggccttaagaaaatatactcccctgtcacctgactcactcgagggtcaattgatcctaaaagataagtttattacccaatcagctgcaga

SEQ ID NO: 26079 - DNA, 201 bp, Homo sapiens
ccttgagcagtggtttataattctccttgaagagatccttcacatcccttgtaagttgtattcctaggtattttattctctttgtagcaattgcgaatggsagttcactcatgatttggctttctgtttggctattactggtgtataggaatgcttgtgatttttgcacattgattttgtgtcctgagactttgctgaagt

SEQ ID NO: 26080 - DNA, 201 bp, Homo sapiens
ttgctagcttttaacttttctgtatgttaaatttcgttagaaatttatatatgaggccgggcacagtggctcatgcctgtaatcccagcactttgggaggmtgaggtggatggattgcttgaggtcaggagttcgaaaatagcctggccaacatggagaaaacctgtccctactacaaatacaaaaaattagctgggcgtg

SEQ ID NO: 26081 - DNA, 201 bp, Homo sapiens
cgtgtagaacacattggattccatgcaaagtattcctttacaggtaagaattataattaagatcttgataaaattacttataaagattaatgatttttttccataaagatttcatatatattttgttagatttatttctacatagctattagttttgttaatattatcaatgagattttctaaattacattttttaattgg

SEQ ID NO: 26082 - DNA, 201 bp, Homo sapiens
atatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatac

SEQ ID NO: 26083 - DNA, 201 bp, Homo sapiens
tatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatact

SEQ ID NO: 26084 - DNA, 201 bp, Homo sapiens
atggtgtgtgtgtatatatatactatatatggtgtatatatatacacactatatatggtgtatatatatatatactatatatggtgtgtgtgtgtgtgtgwgtgtatatatatatatatatatactatatatggtgtatatatataatatggtttttttttgagatagagtcttgttctgtcaccctgactggagtgcaat

SEQ ID NO: 26085 - DNA, 201 bp, Homo sapiens
tggtgtgtgtgtatatatatactatatatggtgtatatatatacacactatatatggtgtatatatatatatactatatatggtgtgtgtgtgtgtgtgtrtgtatatatatatatatatatactatatatggtgtatatatataatatggtttttttttgagatagagtcttgttctgtcaccctgactggagtgcaatg

SEQ ID NO: 26086 - DNA, 201 bp, Homo sapiens
gtgtgtgtgtatatatatactatatatggtgtatatatatacacactatatatggtgtatatatatatatactatatatggtgtgtgtgtgtgtgtgtgtrtatatatatatatatatatactatatatggtgtatatatataatatggtttttttttgagatagagtcttgttctgtcaccctgactggagtgcaatggc

SEQ ID NO: 26087 - DNA, 201 bp, Homo sapiens
ctacaccatcgaaagcacacagacaacaacttgattttctcccacagttactttatcaagtttgttttttttttttttttccattctgctctcaacccccmattttcaaagtacagtcctggaggaagttatccctgggttgtgatatgcaggcaaaggcacgtgtgtggaggatggaagaggtggaggtggcagtgggaa

SEQ ID NO: 26088 - DNA, 201 bp, Homo sapiens
ccttgaccacaaaatcccgtggggggcttgaaacacatgcagattcctgagcctcactccaggcccaactgaattcagaatttccatgacgaagtctttcmtgttttttttttttttttttgacacggcgtctcactctgtcgccaggctggagtgcagtggtgcaatctcggctcactgcaccctccacgtcctgggttc

SEQ ID NO: 26089 - DNA, 201 bp, Homo sapiens
ccagctttaaatgtctttgtattctgcttcctgtagtttccagtaaagcttccttcagctgcagcctaaagccacagatggcttgctggaaacaggagagsgcctgaagtcaagccagtctgtatctgctcgtacagcacactgtgcaccttctcagtagtggtcaaccagagacaggcagagatactatccagacaacct

SEQ ID NO: 26090 - DNA, 201 bp, Homo sapiens
tgaccacaaaatcccgtggggggcttgaaacacatgcagattcctgagcctcactccaggcccaactgaattcagaatttccatgacgaagtctttcctgytttttttttttttttttgacacggcgtctcactctgtcgccaggctggagtgcagtggtgcaatctcggctcactgcaccctccacgtcctgggttcacg

SEQ ID NO: 26091 - DNA, 201 bp, Homo sapiens
ctgtagtttccagtaaagcttccttcagctgcagcctaaagccacagatggcttgctggaaacaggagagggcctgaagtcaagccagtctgtatctgctsgtacagcacactgtgcaccttctcagtagtggtcaaccagagacaggcagagatactatccagacaacctcaggaaaatgtcagccgtatagaatgtgag

SEQ ID NO: 26092 - DNA, 201 bp, Homo sapiens
gcaccttctcagtagtggtcaaccagagacaggcagagatactatccagacaacctcaggaaaatgtcagccgtatagaatgtgagccacaaaaatgtcarttctccaaataatgatttaaaaatgtatctaactccactgaagccttcgagatgttttatccaagagaatgtaactattttttcccttatcagattgatc

SEQ ID NO: 26093 - DNA, 201 bp, Homo sapiens
tgccatctatgcaactataactcagacaaattctaagtattgttgaaagaacaaaatcacagtaacctgtcaaaataattgtaaaagttgtttgaagagamtatcagctatcactctgtgcatcagggtcatagaataaattttaagagtgaatgatcacgacaaatggcaaaaccggagaggctgtgggaagctaagcct

SEQ ID NO: 26094 - DNA, 201 bp, Homo sapiens
gtaatcccagctactcgggaggctgaggcaggagaatcgcttgaacccaggaggcggaagttgcggtgagcctagatcatgccattgcactccagcctggscgacaagagcgaaactctgtctcaaaaagaaaaaattaatatatgtgccctgcttttagtaaatactaccattgggcgttctttcttctgctccatctcg

SEQ ID NO: 26095 - DNA, 201 bp, Homo sapiens
gcctggccaacatggtgaaaccctgtttctactaaagacacaaaaaattagccgggtgtggcggcgggcgcctgtagtcccagctgctccagaggctgagrcaggagaatcgcttgaacccgggaggtggaggttgcagtgagctgagatctcgccactgcactctagcctgggtagcagagcaagactccgtctcaaaaa

SEQ ID NO: 26096 - DNA, 201 bp, Homo sapiens
ggctccggtgagaagacagctccacgaatagagaggacacagcaaagagccttccttccatcaggagaaaggatgctttcttagagggagtcagcatagattttcagagagtcaggctctcagctccaggaaaagtacccagggaggcaactggagaaggcaaaaggcacaggaaaagaacagacgcgtcatgaaaagata

SEQ ID NO: 26097 - DNA, 201 bp, Homo sapiens
tactgaaaggatgactggtatctctgtatgcatgagggggccctgactctttagcaaaacctgcaaacctacaaatgtcatatccacaggtcttttctctyggggaggttaaaactccagcgacgaatcactttcagaattaatttttcttctgagtctttagttctaatgtccacattcctttttttgaaatgtattttt

SEQ ID NO: 26098 - DNA, 201 bp, Homo sapiens
aactggcagatcaaagaatagcccttggaatgtggagcttggagctttctttattaaagagatttttctgtgataaatgggacggttgattccttttagatttttttttagagattataatcaaatcactttttagaaaagctaatttaactgaactctgtggtagatacacaagtaaaatcataccaattccattattca

SEQ ID NO: 26099 - DNA, 201 bp, Homo sapiens
ctcaaaaaataaataaataaaaattaaagtaaataaagaaaaatatctgctttattatgtacatgaaatcatcagaaactgatatttaagcttcccttccwagtaacaaatgtcctgatgcattgttaagaaaaactgcccatcagtgagctctgcagaccacattgtaagcacaatggctcatctcctttacattgagag

SEQ ID NO: 26100 - DNA, 201 bp, Homo sapiens
acttccacaatggttgaactagtttacagtcccaccaacagtgtaaaagtgttcctatttctccacatcctctccagcacttgttgtttcctgactttttratgatcgcacataaaaagccttgatgaagaataagagaaggtaattggaagaatttaccaaccaataaagaatattaaaaaaaaaaaaaaaaagaaaaag

SEQ ID NO: 26101 - DNA, 201 bp, Homo sapiens
gtaggatgttgtaaatgccccccattttaatcaggggcactgcagatgcccccagctactgccaatggcagcagagccatccattttccctttagtgatayttgaaatctttgacataagacaaacacacataagcagatgaaaaacgcactgcagacagaaaaaaagctttctgatttcagaaagaaactgccatagtga

SEQ ID NO: 26102 - DNA, 201 bp, Homo sapiens
aatattaaaagaaaaacgctaagttatttcattggtacaagaagcatctgttcctttattaaaagggggcaaattaatggcaaattaatgtcctattatckgtttgatttaaaataatttattagatcaagtggagaattgctaatcaagccattaggacctgccaccattatatttatgtattcctctaaagtaaatatt

SEQ ID NO: 26103 - DNA, 201 bp, Homo sapiens
ctggatattaaatttagtaaaattttgtaatgtctatgacgagtatttttaacctaacattgcgtaagaaaactgtcaagatgctggatgctctaaaactmttgttagctattacctcatgtacatcataattaatcgtggatgttaattcatgttttaaatagacacgatcatttcaaattccttttgaccaagttcctt

SEQ ID NO: 26104 - DNA, 201 bp, Homo sapiens
aaagataaatcttttctcttactatttctcccttcacagtcatgtttaggaaggctttctttactgaactctttaaaaattgtcaagtacatgttcttttwtacttctatggtttctttttttatggtaagatattttatatttttagaatgtattttttatccgtagcatcaaatagagatctggcttggtatttttgct

SEQ ID NO: 26105 - DNA, 201 bp, Homo sapiens
taaataaaatttaaaaaatgaaaaaaattgggtagtaacattaattcaccttggtgataatgaggaatttagaaattctcaatttaaaaattctacacgcmgtaaactgtaaactcagtgtttctcagatccagtaattcttgacaagcattggagggtgcagcagcgcttagctcgtgaggtggaaacaccaaagggaca

SEQ ID NO: 26106 - DNA, 201 bp, Homo sapiens
gggcatggtggctcacgcctgtaattcccccactttgggaggccgaggtgggcggatcatgaggtcagggggtcgagaacatcctggctaacacggtgaawccttgtctctactaaacaaaatgcaaaaaattagccgggcgtggtggcgggcgcctgtagtcccagctactcgggaagctgaagcaggagaatggcgtga

SEQ ID NO: 26107 - DNA, 201 bp, Homo sapiens
cttcccaggttcaagcaattctcatggctcagcctcccgagtagctgggattacaggcaccagacaccatgcccagctaataattgtatttttagtagagrtggggtttcaccttgttggccgggctggtctcaaactcctgacctcaagtgatctgcctgcctcggcctcccaaagtgttgggattacaggtgtgagcca

SEQ ID NO: 26108 - DNA, 201 bp, Homo sapiens
tcatggctcagcctcccgagtagctgggattacaggcaccagacaccatgcccagctaataattgtatttttagtagaggtggggtttcaccttgttggcsgggctggtctcaaactcctgacctcaagtgatctgcctgcctcggcctcccaaagtgttgggattacaggtgtgagccactgtgcctggcccctagaacc

SEQ ID NO: 26109 - DNA, 201 bp, Homo sapiens
atttaggggaacacaaacattccaaccatggtatacataccaactcatagaggtatgttatatattctctctctctttatctgtctatctatctatatatmtatgtatgtatacaatctaaatgtattttttcagttttcagcctggatcctggagctcaccataatgaaatttacatctgcatgtttattttattttact

SEQ ID NO: 26110 - DNA, 201 bp, Homo sapiens
agaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcg

SEQ ID NO: 26111 - DNA, 201 bp, Homo sapiens
agctgcgtataatggtgtagatcctaaaggcaccatttatatcccagtttatatatgattccccctcctcatcattggatagggcgtcccctgcaacgcaytgtagggcaacctggcaaaagtctgtagtgaaggtttagtgttatcagagaacaagagagcagatagagatcttgggtttgaggcagaggagtttagagc

SEQ ID NO: 26112 - DNA, 201 bp, Homo sapiens
tgggaggatcacttgagcccgggaagttgaggctgcagtgagccacgatcataccactgcactccagcctgagtgacaaagcgagaccctgtctcaaaggaaaaaaaaaaaaaaagaacatggtatatggtataataagtgctagaaagaggaatgcacagaacagaaacacctacttcagcccaggacatcagagagggt

SEQ ID NO: 26113 - DNA, 201 bp, Homo sapiens
gaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcgg

SEQ ID NO: 26114 - DNA, 201 bp, Homo sapiens
atcatgaaattttaacttgtttaccagaaaaagtgcatgacctaaaacttggcaaatgtgctcttccatgaaacaaaggggtgaagattagaaaactcgastttcatctgattctgaattaactaaaatcatgtttaagttggaaagacagtgccatctagtggtgcatttctttttcttttacaatgactggttttagtc

SEQ ID NO: 26115 - DNA, 201 bp, Homo sapiens
ggtaagtatggctaaggcaagagatttccttcctctctgagtgtgtcaagaggagttgagatatttgggggtagggtgggggtggggggacctaagccackaaaatcctaaatgaataatctctttaagagaataacaaaagatttcacagaggaaggttttgtaatatacacatctccgcatctgaagatatatttaatg

SEQ ID NO: 26116 - DNA, 201 bp, Homo sapiens
ttaaaaacctaagtaactgtactatatccgaatattaaatttttaaagggtagatattaaattatttttaaatgcatgcactactagattatcacaattctggaaggaaacatattattcttccagtatgctatatttttagaggacaatgaagaagcagcattccatggctttgtgaaaacgtgatttcatttgcgtttc

SEQ ID NO: 26117 - DNA, 201 bp, Homo sapiens
ttgttaggtttttggctgggtggatccattcttcccacagacatttatcaagaactttccatgggacagacactgtatcaggccccggggatgtggcagtaaacaaacaaaatccatgtcctcatggaacctaattctagtgttaagatgcagacaataaataagtaaaatatataatatgccatatggtgaaaggtatca

SEQ ID NO: 26118 - DNA, 201 bp, Homo sapiens
aatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcggg

SEQ ID NO: 26119 - DNA, 201 bp, Homo sapiens
cagtctgggaactagaaggctcaagagggcaatatgtaagttgagacctaaaaggatcagagggaagtctaaggacaacatgctggttctgtaaaatgaarctcaatgatactaaatagctcacctaattttcctgacagctacagtaagtttggggcatcgtcaacatcctctaaagacaagtgtttccttgaataaatg

SEQ ID NO: 26120 - DNA, 201 bp, Homo sapiens
aaatattaaaaagctcctttatcctctggcataacattactaataaattatttcattccattgatcttggttctcaaatgcatctaaatcctgaagaaatstaatgaatgaatgctccccgagttgtgcaaagatatatctgcttagtcttttaaatataccaagatcatagctctgcatcattctgctgtactgaatgct

SEQ ID NO: 26121 - DNA, 201 bp, Homo sapiens
aactggaactgtaacccacaaaatgtgcaaggcacgtggtaaacataaacagggtgacagcctgctaaaataaaagatttgaataggacccaaagttcccyaacataataaatgacatgtcctgggtacaatcagaaagaacacgttgtatcaggaatcaagaacatcacaacttgaaagagaaaagaatcaagtgatgtc

SEQ ID NO: 26122 - DNA, 201 bp, Homo sapiens
tcaacatcctctaaagacaagtgtttccttgaataaatgctccctggtctcaggggggtgtggtctgtcctttcttcaccacaactccagagcttgaattkgggcacagaaatgacttcactgtttgcccatcgtccacacacccaccctccactcccaccccaggacacactgagagagaagcccccttgtgcctggagc

SEQ ID NO: 26123 - DNA, 201 bp, Homo sapiens
ccttctggcccatcactactaccaacacttttaatgaattcctacctgaaactaatgctttgcgcttcatataagagtgaatgaagttctattttgaaggktttttttttctttctgtttttaaattttttggctacctaattttcttttattattgttattattattatactttaagttctgggatacatgtgtagaagc

SEQ ID NO: 26124 - DNA, 201 bp, Homo sapiens
gcttataagggaaagggaagttgtggtttgagaatgttctccatggaattctgataaaccctcaccccctctgcctgtttcaaaaccaccggcttgtggtmttaagcagaacagctgtatctcaaatttcagtcagctaaatgctgtcttctctttatttgctcaggtttagaggcagttaaaatactatatatcattgat

SEQ ID NO: 26125 - DNA, 201 bp, Homo sapiens
tcaggggggtgtggtctgtcctttcttcaccacaactccagagcttgaatttgggcacagaaatgacttcactgtttgcccatcgtccacacacccacccyccactcccaccccaggacacactgagagagaagcccccttgtgcctggagcaggcagaaccatgcgcctcgtgggcctgaaactttggggtcctccagtg

SEQ ID NO: 26126 - DNA, 201 bp, Homo sapiens
taattttaaaattattcaataataaactgcataattttaaaattattaaattttaaaattatccaataattatttaataattaataataataaataattawtaataataattattatttaataattttaaaattattttataatttgcataattattataaattttataattttgcatacatgtaactttagtccaaagat

SEQ ID NO: 26127 - DNA, 201 bp, Homo sapiens
accacaactccagagcttgaatttgggcacagaaatgacttcactgtttgcccatcgtccacacacccaccctccactcccaccccaggacacactgagaragaagcccccttgtgcctggagcaggcagaaccatgcgcctcgtgggcctgaaactttggggtcctccagtgcccccgatgagctccctctgtgctcttt

SEQ ID NO: 26128 - DNA, 201 bp, Homo sapiens
aaattattaaattttaaaattatccaataattatttaataattaataataataaataattattaataataattattatttaataattttaaaattattttrtaatttgcataattattataaattttataattttgcatacatgtaactttagtccaaagatctagctatcctcttattagttttaatatgttgtctatag

SEQ ID NO: 26129 - DNA, 201 bp, Homo sapiens
ctaatgccagccttcaccttgggcattaagaccccacagtctgaaaaaaccgtgagaaagccatgtaaaaatgatgggaatggggcatcaggagagcaaakctctttcaaaatctaaagttataaatgctgctcgtgtggcagtggcttgtcactttccactgacttgtgactatgatgactgtcttagaaattcatttca

SEQ ID NO: 26130 - DNA, 201 bp, Homo sapiens
taatgccagccttcaccttgggcattaagaccccacagtctgaaaaaaccgtgagaaagccatgtaaaaatgatgggaatggggcatcaggagagcaaagytctttcaaaatctaaagttataaatgctgctcgtgtggcagtggcttgtcactttccactgacttgtgactatgatgactgtcttagaaattcatttcat

SEQ ID NO: 26131 - DNA, 201 bp, Homo sapiens
atatatatatacatataataaaatacatttaatatacacttttcttaatggctttttccatgaactaaatgaactctcttctcatgaaatgaatcaatatmaagtattcagacttaagtaaaactttcaagtgctccagttgtaaaactggaatgtggaaaatggcctaggctcattccttctctggattgaatgggggtc

SEQ ID NO: 26132 - DNA, 201 bp, Homo sapiens
tcatgaaatgaatcaatatcaagtattcagacttaagtaaaactttcaagtgctccagttgtaaaactggaatgtggaaaatggcctaggctcattccttstctggattgaatgggggtccctctgataacatcgggcaagcccaacgctgctgccgagtgggatgtattaggaaccctgccaaaaataagtggccgtggg

SEQ ID NO: 26133 - DNA, 201 bp, Homo sapiens
tacccacccagagacaccagggtaggtgggactggaaaaatgggtcccagtcacagaaaggggccagtctgggaagcctctttgtccccacaggccagacmtgctcctcttccacccagagacattgaggtacccgggggtattggtaggggaaaattactataccctttgccttcaactgagaaacacacagagtccctc

SEQ ID NO: 26134 - DNA, 201 bp, Homo sapiens
tggcggcttcactgcttcctatacctccagtgaagatgcaggtaatgtaggatgttgtaaatgccccccattttaatcaggggcactgcagatgcccccakctactgccaatggcagcagagccatccattttccctttagtgatacttgaaatctttgacataagacaaacacacataagcagatgaaaaacgcactgca

SEQ ID NO: 26135 - DNA, 201 bp, Homo sapiens
ggggccagtctgggaagcctctttgtccccacaggccagacctgctcctcttccacccagagacattgaggtacccgggggtattggtaggggaaaattastataccctttgccttcaactgagaaacacacagagtccctcaggtagcaccagcaagaaccagtgagagccccggtagcaccaatgtaaaccaagcagac

SEQ ID NO: 26136 - DNA, 201 bp, Homo sapiens
gaagcctctttgtccccacaggccagacctgctcctcttccacccagagacattgaggtacccgggggtattggtaggggaaaattactataccctttgcyttcaactgagaaacacacagagtccctcaggtagcaccagcaagaaccagtgagagccccggtagcaccaatgtaaaccaagcagaccagaattccacca

SEQ ID NO: 26137 - DNA, 201 bp, Homo sapiens
tatcagcaaaaaaacaatggttacaataaagaactaaatagaaattatagaactgaaaaatacactaacataaataaagaacatgctgaataggctcaatrgtagcatggagatgacagagaatagaatcagtgaacttgaagatagaacaatagaattcacccagtctgcacaataaagagaaaatagactgaaaaaaca

SEQ ID NO: 26138 - DNA, 201 bp, Homo sapiens
agttcagacatatcttaattaaacttctgaacactgaaggcaaacaaaaagtcttgaaagcagtcagagagaattgggacattacctagagaggaagaccrgttagaataaaagcagatttctcatctgaaaccatggaggccctaatgaattgacaatatattcttcaagtgctgaaacaaaggaattgtcaaccataca

SEQ ID NO: 26139 - DNA, 201 bp, Homo sapiens
tcttcaagtgctgaaacaaaggaattgtcaaccatacattttatatctggaaaactatctttcaggagtaaagaggaaataaaaacttctcatatgaaggwaaactaaacaaaattatcactaggaaacctaccattaaagatggtcaaacagaagttcttcaaacaaaaatgaaattattaaagaaccgtggagcatgag

SEQ ID NO: 26140 - DNA, 201 bp, Homo sapiens
aaagatggtcaaacagaagttcttcaaacaaaaatgaaattattaaagaaccgtggagcatgagaaaagaaaaaggaaagtggaaaaagcaaaaatatgtrtacatacaatagaatatccttttccccataaagcttgtgaatcatatttaataaaacaagaaattataatgccctctgttattcagtataatgatatgga

SEQ ID NO: 26141 - DNA, 201 bp, Homo sapiens
ggcaatacagcaaaatcccctctctacaaaacatttaaaaattagccaagtgtggtggtgcacacctgtagtcccagctatttgggaggctgaggtgggaggatcccttgagcccaggaggtcaaggctgcagtgagctgtcacaccactgtatgccagcctgggtgacagggtaagaccctgactacaaaaataacaatt

SEQ ID NO: 26142 - DNA, 201 bp, Homo sapiens
acaacagaaaaagaggaatcttacataatgataaaaggatcaatccaccaggaagacataatgatcctcctaaatgtgtatgcaccaaacaacagaggcayaaaatacataaagcaataactgatagagctaagaagagaagtagacaaatcttcggttatagctgaggacttcaacactctcctctcagtaattgataga

SEQ ID NO: 26143 - DNA, 201 bp, Homo sapiens
agatggatcagtgtagatatagaaatggtctcattgccaagtaagccccaaacaaatatgtgcaggatctgagtgctaaaaataatgaaatgctggcataracctaaatgaaagagacaattatatttatgaattggaagactcaacatagtaaagatgtcccttctccccaaaatgatggataggtttaatgcaattcct

SEQ ID NO: 26144 - DNA, 201 bp, Homo sapiens
tggtggatatttattcatgcttctgtgatgttctgccccgtgcaccatgtgccataatcatttggttggctttaagaaagaatgaaatttccaatgagaayagataaatggtctggcaaaataaaaagtgtcacacctcgtagctccctcgatagcaaattgagaatttgtttgctggaaaagaaaatgaggatcataaca

SEQ ID NO: 26145 - DNA, 201 bp, Homo sapiens
ccatgtgaaatattttcatccagtctgtagccagtctgttcattttcttcacataggcaatgtactactatgtaaaatatataaagaagtctcaaactcargagtaaaatacaaacagttctattagaatatggacaaaagacatgggcagatagtccaccaaagagactctacagatgataaataccagaaaagatgttc

SEQ ID NO: 26146 - DNA, 201 bp, Homo sapiens
tactatgaaaggggctaaggttgggaggccagaaaaataacagtgtggtttggtgagagcaagacagacaagtgagactgcagtgggcagagaatggaacrgggctccggtgagaagacagctccacgaatagagaggacacagcaaagagccttccttccatcaggagaaaggatgctttcttagagggagtcagcatag

SEQ ID NO: 26147 - DNA, 201 bp, Homo sapiens
ttccaaaagtaacacacacataaagagtcaaaatgtgtattcatgccaggcttcctccaaacaccacatcctcaatgtttcccaatactgtctctcaaagkatacattttcttttttcttttcttttttttttttttttgagagaaggtctcactttgtcacccaggctggagtgtagtggcacaatctcggctcactgca

SEQ ID NO: 26148 - DNA, 201 bp, Homo sapiens
aatctcatttcagattgtggcggaatacagataggtgacagtggagtgatcacaagccccaactatccaaatgcttatgacagcctgacccactgctcttsgctgttggaggccccacaagggcacaccatcactgtgagtgctaatgactgggtgaaatgcttctgagacaatagaaccacaatagcctgtcctgcatga

SEQ ID NO: 26149 - DNA, 201 bp, Homo sapiens
gataggcaaggcagaaatgaatattgaataactctttaccattgtcatcaccattatcatcattattattaaacttatgttcccaggccaaaaggtagagwtgtcgaatctataattaatgacttcagaaaagtataagcacttaagcattcttggattccttcattaaagaacttgaggctctttattaagttttagccc

SEQ ID NO: 26150 - DNA, 201 bp, Homo sapiens
tgagtaatttggtatcattccatgtgaagaaaatgttgaatagtcaagtaagattaatacacatccaactacatccttgtttgagatagttgtctgttgakagaaagggcatattgggtattgcagattgcgtagcaatagtcctggcccctacccactagatactacccatcacaccgagtgtgacaatagaaaaatgac

SEQ ID NO: 26151 - DNA, 201 bp, Homo sapiens
ccccggtagcaccaatgtaaaccaagcagaccagaattccaccacacagattctgaatattgaagagcaactggaactgtaacccacaaaatgtgcaaggcacgtggtaaacataaacagggtgacagcctgctaaaataaaagatttgaataggacccaaagttccctaacataataaatgacatgtcctgggtacaatc

SEQ ID NO: 26152 - DNA, 201 bp, Homo sapiens
ttatataatattttgaaatgatagtgttttagaaatggaaagcagagagccagaggttagagagaaggcaatgtaggagtaaattgtgtgtggttataaayaacaaaagcaacttagggattcctgtggtattggaatttcagtatcttgaatgcaattgtgtacaacttgtatataacttaatacacacacacacacaca

SEQ ID NO: 26153 - DNA, 201 bp, Homo sapiens
tgatgttgaataaatcccttttttgttgtttgtttcaaaaagctacagattataaactagaattaaggccccagaagtttttaggaaaatgctatttccaraattttgctaagtatatcaaatatgatatattacatttcaaaaatttccaaatcagaaggaaaacgttgaaagattctctgtaaaatacagcagtatgtt

SEQ ID NO: 26154 - DNA, 201 bp, Homo sapiens
tggtgtgtgcctgttggctgagttaaatcaagtgtagccactcatggcaaaccactgtttagggaaaagtttgaggaaaggaattagaggaagtaatacartagacaggtttttcagactgaatcagagagtgctggaaaggaagtactgaaagacaaccctagaccaaatcttaggtctgcaggtggtccactgtgtaag

SEQ ID NO: 26155 - DNA, 201 bp, Homo sapiens
aaagatatttctttctgtttcgaaaaccagggatgcatgtaagaatttgataagagttgggattaataaatccagctagttttaaaaagcaaccattgttktggctagattacaatggtaatgaaaatagcagttttctaataataagacattttaaaaacattaattgtgtaaagtactaatcagatacaaatcattttt

SEQ ID NO: 26156 - DNA, 201 bp, Homo sapiens
ttccctcccttcctcccctcttcttccccttcctctcctccccttccttttcctcatctctctttccctccccttccctttctttccacagggtctctctytgtcacccaggctggagtgcagtggtgcaatcacggctcactgaagcctcgacctcccaggctcaggcaatcctcccacctcagcctcctgagtagctgg

SEQ ID NO: 26157 - DNA, 201 bp, Homo sapiens
atcctcccacctcagcctcctgagtagctgggactataggtgcacccccacgcctggctattttttttcttttttagagatgggatctgctctgttgcccrggctggtctcaaactcctggcctcaagtgattctcctgtcttagcctcccaccatacctggccatttttgttcttaaatcaccacttctccaagaccttt

SEQ ID NO: 26158 - DNA, 201 bp, Homo sapiens
tccatgttgtcacaaatgacaggatttccttttctttttaaggataaataatatcccatttatgtctgtgtgtgtgtttttgtgtatttatatattgcacwttttctttatccatttacctgttgatgagcacttagattgattccatatcttggctatggtgaatgtatgaatgtattgtgaataatgctgcaatgaaca

SEQ ID NO: 26159 - DNA, 201 bp, Homo sapiens
gttagcaacaaccagtgtggctggcctgtggcaccttgaccacaaaatcccgtggggggcttgaaacacatgcagattcctgagcctcactccaggcccawctgaattcagaatttccatgacgaagtctttcctgttttttttttttttttttgacacggcgtctcactctgtcgccaggctggagtgcagtggtgcaat

SEQ ID NO: 26160 - DNA, 201 bp, Homo sapiens
tgaagattcagagaatttaagggaaaaagattgtcagtgaggttcatggttaaaaaatacatatacacattttttcttaaaaagaagaggacctttttcakgaactttggctagaactactctgaaaatcaaatgaagaattgacatttgttttgtaatttaatttaaataaatactactgctatttttttgtttttctta

SEQ ID NO: 26161 - DNA, 201 bp, Homo sapiens
caaagtgaacagcaaatgccatacccaagaagcagcaacacacctggtttggctcaagaagcggaatcgaacaaagtgaagacaataagaaattagattaraaaggtcaggggtgggagaggagagaaagccattgtgatgcctttggctgtttgattgagtggatgggaagcagttaggaggatttcagcagagcagtga

SEQ ID NO: 26162 - DNA, 201 bp, Homo sapiens
aattttttctttttcagttccaaacttagaaacaataccatgaacaaataatggaacccaggtagtaatctcatgcaagggtttaagaaatatacttagayattggtggaacttggagagttaagtctgttaggattaagagaggaagtgacatcaaagtggaaagaatttggttaattgtaggtgtagtaataaattgcc

SEQ ID NO: 26163 - DNA, 201 bp, Homo sapiens
acaaggtacatttcacaggttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagc

SEQ ID NO: 26164 - DNA, 201 bp, Homo sapiens
cacagcctttaacaaattgagcagttttccaacttgcctttctattatgggagcatgagtgccatctggtgggcattgcattaaattactattaagagttmcaaaaatcagccctgcgtcagaatcacctgtggagttacttacattagacttccagttcccaccgaaacccactgaatcgggatttcccagggaggagtc

SEQ ID NO: 26165 - DNA, 201 bp, Homo sapiens
caagagatattaaatatgcttggcttctatagcactgcttgtattatgggcagatgctcaataaacacttatgagtgaatgaaggaataaataaatggaaytgggaagctattttacctctttcaaattttagaaatacgaagacagttaagtttctaccgtaattaccagaattacaacgtgcaggtttgttacatatgt

SEQ ID NO: 26166 - DNA, 201 bp, Homo sapiens
gctctttttattaaagaaaaccttgtggattatttgctttaaatactaggaaaaaagacattgtgggtccatataactatactgtaatttttttaaagcawtactgaatgccccgaatctgtattaccattccagtttacagcgacaatttaagggtattagtatcctgttatttgcgaaggaattcacaaggaaacgtaa

SEQ ID NO: 26167 - DNA, 201 bp, Homo sapiens
cacacaagtacttacaggcacatagagaagagtgctccctgcaaggtgggctcagttgaggcaaaaacagtaaagaaataaagagcctgacatggcagccycaatttgttcctcatttctgaggatgtaaagtggaacgtgtccactgatagtgtataaaccatggaaatacttcaaaatgcgttaaccccattataattt

SEQ ID NO: 26168 - DNA, 201 bp, Homo sapiens
caggctttgaacatgagtttgactgtcccccaaactcctgattttcttagtaagccttcattgcctctgtggcaattgataaaaatacccagggatgtgakgtgtgtgtgtgtgtgtgtgtgtgtgtgtgtgtgtgagagagagagagagagacggagtctcactctgttgccaggctggagtgcaatggcgtgatctccg

SEQ ID NO: 26169 - DNA, 201 bp, Homo sapiens
agaagttgttgacacgtgccatgcatttcacacttccatggcctggcatttattactgtctggctgggatacccttcctgttttgtaggtctggaaggtctttttttttttttttttgggacagagtttcgctcttgtcgcccaggctggaatgcagtggtgcgatcttggctcactgcaacctctgcctcccgggttcaa

SEQ ID NO: 26170 - DNA, 201 bp, Homo sapiens
gcaattcatccatgtaacgaaaaaccacttgtatcccaattagattagatagatagatagatagatagatagatagaaaaaaaaatttcacctttgaaagytgaacactttattcccacccttttccatgccaccaccccccaattctacactcctcataatctcagcaaatggaaagtacatttttctcattatttaagt

SEQ ID NO: 26171 - DNA, 201 bp, Homo sapiens
tgtgtgtgtgtgtgtgtatatatatatatattttaaatatatagctttaaaatattttgttgtagtttataaaattatataattcattataattatataaygtactatatagttacattatttatgtaatattcttatataattttataacatatatagatatgtcccagatatatgtaatatattatgtagtatattata

SEQ ID NO: 26172 - DNA, 201 bp, Homo sapiens
actggaggtgagtgagaaaaggaggtttcctaaagtacttaagccgagccctcgttaaatttcatgaaatgcttgggaaaacgtatgaaggctacacactkataacttagtgacatcccaaagggcagcctactgagacctgacatatacccttccctaaaatacgtgataaagtttaacttcctaagggtcaccacatat

SEQ ID NO: 26173 - DNA, 201 bp, Homo sapiens
tgatcaaaaagtgaagatgtatttggcctgtagttattcagtaagaaactttgttattttggtttaaaaattgtacttgctaattactgatgcattctctsgtttgaattatataggcctcgaatggctacagagagaggaaatttggtgtttcttacggggtctgctcaaaacattgagtttagaaccggatccctggga

SEQ ID NO: 26174 - DNA, 201 bp, Homo sapiens
tactagaatcattaatagagctgctattcttattttgaaggtgaatggatgattaatattaaaaacttgctttttcccataatttaattctcatcccagcrtgtgcttcccaggatgcagatgcagagctgagtctaagacagatgaaatgacaaggctgaggtctccgagcctgttagggcttctgaccctgagtttgca

SEQ ID NO: 26175 - DNA, 201 bp, Homo sapiens
attctcccatcagggactggggctcggaaagcaagcatcctctctgacgctaagctcggaagtctaggtgtatcacaaaatagtccgaattttcttaaaaygacatttgctggtaattaaacttgaacagtttcttacagaaaacattgtataactgtactacatgcttgtagactgatctatgtaaacttaggcttctta

SEQ ID NO: 26176 - DNA, 201 bp, Homo sapiens
tatgaggattatctctagtccttacaaccaccctgtgagggaagtccgcttcatatcctcatcttaccagtgtggacactgaagcttagaaaggttagtgkcttgcccaaagttccacagctagaaaacgtcaaagcacatatgtgattccagactacgttatggccacacttcttcaactctatcataaccaaggtatct

SEQ ID NO: 26177 - DNA, 201 bp, Homo sapiens
acataaatttcaagcattgtctccagtcaaacctcggtcaaaacactgccatataagcatatttagtgaatatattacttatgggtgtttttaatgtcgawtcataggaaaccaaactattggcaacttaaaatataaggacatttattttttacctaaaaacaaatcaggaagtagataatctctaggttttttagcaag

SEQ ID NO: 26178 - DNA, 201 bp, Homo sapiens
caaaaagtttggttaaatccagggggttttatgtggtaaaaaataatcttttcaggagatacatgaaatctgcttttctattatgaagttaacattggtcrgagtgttctgatctcctcaggttgaacttcccattaaaagcctcttttgcactttctctaatggttttagcattctttaggttcagtatttagatgagtt

SEQ ID NO: 26179 - DNA, 201 bp, Homo sapiens
ttgagttcccaggttgtcctgtattttttatcaccataaatctcagccccttgcagcagtgtgaaaaagacaatacgcatttccaagtccattagagaggratagagtcaatgcaattattcataaaggatagaaggatgtggtgtcaaaaaggggctctgcaagtaaaagtcattagtaattcagcaataatggatttga

SEQ ID NO: 26180 - DNA, 201 bp, Homo sapiens
cagtacctctgaatggttcatcctctcaggctttgcagaacactagaactgaatttcagtgagcggttccatgaactcctctgaattcttctgaaaagttygcacaaaaaatcataaaactggctttggaagttttaatttcataaaccagaatggtggaatgttttgtagccagaaggggattaaagttagttcacctaa

SEQ ID NO: 26181 - DNA, 201 bp, Homo sapiens
ctacccacaaaactttcttcctttccgttataattccttgcttttgttcctcacccccacccacaggaaaccacaaatctactttctatctctgtagattygtttgcatatcatctaaatggaatcatactatacgtactgaatgtttttctgactttcctcaattagcataatttttgttgagcttcttggatccgaaga

SEQ ID NO: 26182 - DNA, 201 bp, Homo sapiens
tgcagacaaaaagattcaatttccccagaaggaaaggggtgtgtgtcattccacttctttctcctgtaggttgcgggggtaatctcaccacttcaagcggyacgttcatatctcccaactacccgatgccctattaccacagctctgaatgctactggtggttgaaatctagccacggcagcgcatttgaactggaattca

SEQ ID NO: 26183 - DNA, 201 bp, Homo sapiens
cttgaaacaaactgaaataagtgtaacgcattggtgtgagcaattgaacttcatcttagtttcttctgtgaatcgtttaactccatttgagggagaaataygtattaaatttaatctcatataactaaaacatctggcaaactatagaaacttagaagagtatttaatatgctgagagagttgcaattcagtgaaagatca

SEQ ID NO: 26184 - DNA, 201 bp, Homo sapiens
agctagttcgtatgtgtacccataaaatggtcagaaagttccatggagcctcttggatttctgcttagattgatttctttagagggttctccttttttgcmccccccaaaattattcctgattttgtagtgagaatttagtttttcagaatttgccaattttctagaatgttctttcctttttcaattgcgttttcatttg

SEQ ID NO: 26185 - DNA, 201 bp, Homo sapiens
cccaccacaccagtgtccccagctgtactctttccatgtattagcaagctcatagttttgggtaaagagagctttattcaatgctatgtcaaaatgtgacyataacgaggtcaaagattaaactgaggttcaatgaatgaagtaactctctctgaccacagtcatcattatcagtacagctctatcttctcttctgactta

SEQ ID NO: 26186 - DNA, 201 bp, Homo sapiens
aggtcaaagattaaactgaggttcaatgaatgaagtaactctctctgaccacagtcatcattatcagtacagctctatcttctcttctgacttattctgtmaagtgacttgtccacagaattctcctgctcagctcaggcatcactttctgcaggaaactttcccttccctttttaagcagagtgaggcatctcagggcct

SEQ ID NO: 26187 - DNA, 201 bp, Homo sapiens
aaaagaaaacttgagcctcagaatcatctggacctgcaaaaatgtagtcatggcatcaaagttcgctttggagtttggacctcattcagtttctttaactmtttgagctcttttacttggacggaaaaaggagtctttaactggattaataatttgccattgtaaagacctctgaaaaggtgcagatactcattcatggaa

SEQ ID NO: 26188 - DNA, 201 bp, Homo sapiens
tttgcattgctggctgacgattccaagttaacatcgttgatttgtaatttgaattatttttctcattgatattaagagacaggcactggccccaaagcgcrtgccctgacattgtgctcttgtgtaaccaacagttgtcactgcccacctgagacgtacggaccccagtgtgcatccaaatatgacgactgtgaagggggt

SEQ ID NO: 26189 - DNA, 201 bp, Homo sapiens
tggcatcaaagttcgctttggagtttggacctcattcagtttctttaactctttgagctcttttacttggacggaaaaaggagtctttaactggattaatmatttgccattgtaaagacctctgaaaaggtgcagatactcattcatggaaagtcctgtttcatacctgtttcataggtaaacttctggtggaaattcttt

SEQ ID NO: 26190 - DNA, 201 bp, Homo sapiens
acaatgattatagcacaagaaacatcattttctgtttccactgattcttttggcttgaggtctagacccagagcttcagacaactaacacaattacatttygccacttctccatgctgttactccctctttgttctgaagacgtgattcttgttgtttccctgctcactttgttttgttttgtttgtttttgtttgtttgt

SEQ ID NO: 26191 - DNA, 201 bp, Homo sapiens
attcttatataattttataacatatatagatatgtcccagatatatgtaatatattatgtagtatattatatacttacactataaattataataattaatmattacaataattaatatttattataacagattattatattatatattttaatgtaagtatataatacactacatattatgtaatatgttatatatagtta

SEQ ID NO: 26192 - DNA, 201 bp, Homo sapiens
aataaatggaaagacatttaatgttcatggattagaagacaatattgttaagatggcaatactccctaaagtgagctaaagattcaattcaatccccatamaaatcacagcgggctcttttaaaaaaatacataagctgatcgtaaaattcatatgaatatgcaagggaaccagaataaccaaaatgttcttgaaaaatta

SEQ ID NO: 26193 - DNA, 201 bp, Homo sapiens
tggaaggggagtggaagagctaataactgaagccagtcactgctcaacactccagtaaatcctgagaccatagatgggtgcagggtgcaaggggtcgataygaatagtatggacgttacaggaaactttaacaaaaactttaattataaaacaagttcttaccttgaaaagaaatggaattatcccctcagtgagagtcac

SEQ ID NO: 26194 - DNA, 201 bp, Homo sapiens
atagcagcatcttcaggagcatccctggtctctactccactctacagtgtgacagcaaaaatgccttcagatagtgctaggtgttcttggggaggcaacayggtccccagtttacagtcactgagttaaaggaaccgttatctaaagaaaggaaattctgaattgtttcaaggtggaaagtgtctactgtgaagtcctacc

SEQ ID NO: 26195 - DNA, 201 bp, Homo sapiens
atctgagcttgccatgcatggatggtgtgtgttgtacatttagggctcagatctagaaggctttccagaaaaacaaaaagttgagtttctctggttttccrgaaacatgatgattagtaaattttatttcacttatttccattcatatcactggtagattttacatcatgcagagtttaaacaatgaggataatctagttt

SEQ ID NO: 26196 - DNA, 201 bp, Homo sapiens
ggccatatcaagacaccttgaaaatatattttgcctgttaaccctgttatgtttaaaaggtacatgaggctgggcacggtggctcacacctgtaatcccarcattttgggaggccgaggtgggtggatcacctgatgtcaggagttcgagaccagccttgctaacatggtgaaaccctgtctctaccaaaaaatgcaatac

SEQ ID NO: 26197 - DNA, 201 bp, Homo sapiens
aaaaatgcaatacttagcttacgtgctggcacgcatctgtagtcccagctacttgagaggcagaggtgggaagatcgcttgaacctgggaggcagatgttkcagtgagccgagatcgcaccactgcactccgcctgggcacaagaccctgtctcaaaacaaaacgaaacaaaacaaaacaaaaaggtgcataaaaatgcag

SEQ ID NO: 26198 - DNA, 201 bp, Homo sapiens
aaacaaaacgaaacaaaacaaaacaaaaaggtgcataaaaatgcagcatcttcatataactctacttatcagaatgtaagaatataacatgcaggaacaayggtgcaggagtcgggtagacctaagtgtctatttatcttctgccaattattcattttgtggttttgggaaatgttagtctgtaaaatgggattaataata

SEQ ID NO: 26199 - DNA, 201 bp, Homo sapiens
gtccatgaaccagaatctcctctcaaatcttatgtcattttgcaatagttaagcacttagtgataaaataaagacaatcttcttagcacttgctacagggraatgcctgtagactgcaatatgaccataattcacagagattaccactattatttcataagaaattgaggcagagggagttagtacattgtctgggtaaac

SEQ ID NO: 26200 - DNA, 201 bp, Homo sapiens
aatcaattggtttcaccacatggtgaaaacccatctctactaaaaaaagaaataaaaaattagccgggtgtggtggcacgcacctgtagtcccagctactygggaggctgaagcaggagaattgcttgaacctgggaggcggaggttgcagtgagctgagatcatgccactgcagtccagcctgggtgacagagtgagact

SEQ ID NO: 26201 - DNA, 201 bp, Homo sapiens
gactccatctcaaaaaaaacaaaaacaaaaataaaaaagattcttaaacattgttgggaggtgttgggacaggtggcaaagtaaacttttagtaatgaagyctcctggatcaaatgctcaaatatgtgtatgaactgttttaaagttccataatcctcaagagtctaattaaattctctatacaaatattctatgtaaaga

SEQ ID NO: 26202 - DNA, 201 bp, Homo sapiens
tttaaagttccataatcctcaagagtctaattaaattctctatacaaatattctatgtaaagatgggaggacaaagaggaaagaaaacaatatgagaaggraagtagagagagatgcggggaatataaatgtctatgggggggatggataattcaatttctctttaattttaatcatttattgttattttcctatgacttt

SEQ ID NO: 26203 - DNA, 201 bp, Homo sapiens
agacatttaatgttcatggattagaagacaatattgttaagatggcaatactccctaaagtgagctaaagattcaattcaatccccataaaaatcacagcrggctcttttaaaaaaatacataagctgatcgtaaaattcatatgaatatgcaagggaaccagaataaccaaaatgttcttgaaaaattacaaagttgaag

SEQ ID NO: 26204 - DNA, 201 bp, Homo sapiens
acacacccataggatagctataataaaaagagtcagataatggtgtggacaaggatgtggagaaattggaacctttatacactcctggtggagatgtaaamtggtacagccaccttgaaaaacagttggcagttcctcaaaaagttaaacatagagatactatctgatccagcaattctacttttagatatattctcaagg

SEQ ID NO: 26205 - DNA, 201 bp, Homo sapiens
caggtatttctgaatccaaatgcaaatgttttttgatctacacgtggaacatttttcccctttgcaagtgaaggtgacttctgcatgtattttcagaaaaygcttcattcttaactgtataaaaagacaaagcttttccgaccaatgtcatcattcaaattgtctccattttaatgtatataccttagagaagaaagtgta

SEQ ID NO: 26206 - DNA, 201 bp, Homo sapiens
tggcaactgagcaagactccatctaaaaaaaaaaaaaatggagcagtaatacacagcctccatcctctttcacagaacccacagcagtagtctttatatcrccaaagcaccaatgtttttgatgcatgaattgttaatagatgcatagctgaataaatgaatttttgtcatctctgctcctgcaatgctcagtgctttggt

SEQ ID NO: 26207 - DNA, 201 bp, Homo sapiens
atacacagcctccatcctctttcacagaacccacagcagtagtctttatatcgccaaagcaccaatgtttttgatgcatgaattgttaatagatgcatagmtgaataaatgaatttttgtcatctctgctcctgcaatgctcagtgctttggtggaaaatctcagaggacaccatcgggaatgtgctgtactgagttcact

SEQ ID NO: 26208 - DNA, 201 bp, Homo sapiens
ctatgactttatcttagtgagccgttccaaaggcaactttggaatgctcagaaatgtcatatattaatgaatcagcttttatgtaaatatatactgatgtygtaaattgcatggaacatatttataccaaaaaatattcatttattggaaactcacatttatttgggcatgctgtatttttatttgctaagtctggcctcc

SEQ ID NO: 26209 - DNA, 201 bp, Homo sapiens
tttctggccacactcattgctctcctcttccttagaaactgccaaaaagctgccaccccagcaattggttctggggcccaccacaggcaagccgaatcctrtgcctggaggttggttcttgatgcctttcaaacagtcaaatgctaatttcccacaatgtcgttcatacattgtcatccatgaacattactaagctccttg

SEQ ID NO: 26210 - DNA, 201 bp, Homo sapiens
cactcattgctctcctcttccttagaaactgccaaaaagctgccaccccagcaattggttctggggcccaccacaggcaagccgaatcctgtgcctggagkttggttcttgatgcctttcaaacagtcaaatgctaatttcccacaatgtcgttcatacattgtcatccatgaacattactaagctccttgtacctcactg

SEQ ID NO: 26211 - DNA, 201 bp, Homo sapiens
ttttgttttcagtttaatcgtctcctgttgggtagtgaatttcaaaaatatgaaatatctttgtatcttatgaccactttgtattgccgtaaaatgatctyattcaaccttcagattttatttccaagttctaatatctgaaggactgaactgttttctttcagatcttgaaaataagaaaccaagtgtgttttcttttat

SEQ ID NO: 26212 - DNA, 201 bp, Homo sapiens
gccgaatcctgtgcctggaggttggttcttgatgcctttcaaacagtcaaatgctaatttcccacaatgtcgttcatacattgtcatccatgaacattackaagctccttgtacctcactgtgtcttgttaaaatagctcttttcctttgtagaatggcatgggagggaggcctggccacgcaggcacgccctgttccttg

SEQ ID NO: 26213 - DNA, 201 bp, Homo sapiens
aaaattgagtaggtgcattttttttcctgacatttttattgatcttaggcatttggcagaatatctgcacttttgttctcagtaggtccagcgccaggcasctcccttatctaataaatggctaatataatttgtcttcagtaggatgactaacagctggatacccagtgcttaaaaatcaattgaaacaatacggcttta

SEQ ID NO: 26214 - DNA, 201 bp, Homo sapiens
ttcaaaggcttttcttgctgattttcatgattgtctttattcacgctgttgtcatcctgccagcccaagtacagctgcgtctgtgatgctgggtggatgtyttcacccaacagccctgcctgcacgctggacagagacgagtgcagcttccagcccgggccttgctccacacttgtgcagtgtttcaacactcaaggctct

SEQ ID NO: 26215 - DNA, 201 bp, Homo sapiens
agacacactttgctgaacctcagccatgagttacatttggatgtgatggggaaacttccttgagcgatcacttttaaatgatagattttatgaagttaatwtccaaagtgacctagtttgttaaaaatctgaccactttgagcttaatgattcatccttttgttttagattcgagatggtcctttgtatcaggaccccctt

SEQ ID NO: 26216 - DNA, 201 bp, Homo sapiens
tgattgaacttgtgtgttcctaaggcacagggagtgcctttgaaaactcagctcaagtttatagtgcatccccacccagggaggctgagatttcaatctcyaataatcatagaacccaaggagccgggggtcaaaatgagccagagcaagggcctgtaattgcttaaaatattttttaaagtcttttttcctacatcccat

SEQ ID NO: 26217 - DNA, 201 bp, Homo sapiens
cgaattactacccaagaagttcagggagtactaagggataaactgaaaccttgtatgtttaaataacatggaactacagtactttgggcttctataataaytgacctctaagaacatcagagtcactgtaatataaaaatattaactttcttagtgtcagcactttctaagtctaccagtagttttatacatatttttttc

SEQ ID NO: 26218 - DNA, 201 bp, Homo sapiens
cctaagggtcaccacatatgtgaaagcaagaatgtaagtgtgtaagtccatggtgagagcagaactagggtgataggccagacccactctccaagggctcrtacctcttaaccagcctccatacctcatgccatagtacagacctttagattcttggcaaatatcaaacttgcaaacattaaatttgtgaatcccaaggaa

SEQ ID NO: 26219 - DNA, 201 bp, Homo sapiens
tgtcagttttcccaaagaattttatgggaattacattgaaactataattaactttggaagaaatgacatcttaaaaatattcagcctgccaatgcatgaamataaactatttttaaatttagttctcttttcatttatcctggcaatgttttatagctttcagtgtctaagtattccatatctttgttagatttatttaca

SEQ ID NO: 26220 - DNA, 201 bp, Homo sapiens
acatatgaatttaggggaacacaaacattccaaccatggtatacataccaactcatagaggtatgttatatattctctctctctttatctgtctatctatmtatatatatatgtatgtatacaatctaaatgtattttttcagttttcagcctggatcctggagctcaccataatgaaatttacatctgcatgtttatttt

SEQ ID NO: 26221 - DNA, 201 bp, Homo sapiens
cctgggaggcagaggttgcagtgagtggagatcacagcactgcactccagcctgggtgacagagtgaaactctatctcaaaaaaaaaaaaaaggcattcaytgggaaaatggacaatctatggagaaataaaacacatgcacaaagttacaggtgcatcccatttcaatggatgccagctaacctgaacattggtaatgct

SEQ ID NO: 26222 - DNA, 201 bp, Homo sapiens
tcaaaaaaaaaaaaaaggcattcattgggaaaatggacaatctatggagaaataaaacacatgcacaaagttacaggtgcatcccatttcaatggatgccrgctaacctgaacattggtaatgctttggggcataaggcagagaacaataggtgctgagagaggagagatatgcaaaggccaggcatggagggctctgtat

SEQ ID NO: 26223 - DNA, 201 bp, Homo sapiens
gtgctgcgtgggaatttttcagcctatgtttggaagtcattgtgttatttctgccatactcaatgggttaacttagtcacaagctgacccaaattcaaggygaggggacataggcccacttctaaatgggagaggtgtcagaatttataaagaattaaaaaaaaacccacaccttttgttcctagttaccaagaattttaa

SEQ ID NO: 26224 - DNA, 201 bp, Homo sapiens
gaggtggcatcttattgtggttttgatttgcatttccatgatgattagtgatgttgagcattttctcatatatttgttgaccatttatatgttttctattsagaaatgtctatttggatcctttgcccatttttaagattgggttagtttgttttgttgatattgagttgagttttttatatatttcagttgtgcttttgt

SEQ ID NO: 26225 - DNA, 201 bp, Homo sapiens
taccattcttttagttttatgattcctaaatattaccagactaaatacacattttaatttagattaagctgggtttcaaattaggataactaaagtgagtsaaattaagtgaagcaactaaaaacaaacaaaacaataaaaaacctcattacaaaaactactaacttttttcttgtaaaacataaatattatacctgaagt

SEQ ID NO: 26226 - DNA, 201 bp, Homo sapiens
gagttttttatatatttcagttgtgcttttgtggtcatatccaaaaaaatcactactcagactaatgtcatagggcttttcctgtatgttttcctggattrgttcttcagttttaggccttatgtttaagtctttaattttgagttgactttgtatgtggtgtgggataagggttcagtttcatttttctgcaaatggata

SEQ ID NO: 26227 - DNA, 201 bp, Homo sapiens
actgggtgtgtcatcgtctctagacctttcagtggacagaattagaaaaaacttttttgttgttttttaaagaaaaaataccctatatattcatagtgatyttacactatattggaatattgagattatagagttgctttttttttttttttttactttacatttctacctcttctctcatacagtaaaaatcctggttcc

SEQ ID NO: 26228 - DNA, 201 bp, Homo sapiens
ccctaagacattaaaacagttgtgggggttccttggaatcatcggcttttgctgactgtggatccccagatacaaggagatagccaggcccctctatactstaatcaaggagacccagagggcaaatactcatctagtagaatgggaaccaggggcagaaacagccttcaaaaccttaaagcagaccctagtaaaagctcc

SEQ ID NO: 26229 - DNA, 201 bp, Homo sapiens
cacatttgggttggttccaagtctttgccattgtgaatagtgctgcagtaaacatacgtgtgcatctgtctttatagtagaatgatttataatcctttggktatatacccagtaatgggattgctgagtcaaatggtatttctggttctagatccttgaggaattgccacattgtcttccacaatggttgaactaatttac

SEQ ID NO: 26230 - DNA, 201 bp, Homo sapiens
gaactgggttaggttcctggaataaagtaatcattattactgagaggagaggtatcagccgaagctccttctgcctacccattagtaaaagattaaaatayggaggaggagaaaaggctcttatattcaaatgccgtttgtacgtaggtgcatcaaaaagtgttgctcttcatttgtagactgacaagataatggagaaga

SEQ ID NO: 26231 - DNA, 201 bp, Homo sapiens
cttatttccttgagcagtggtttataattctccttgaagagatccttcacatcccttgtaagttgtattcctaggtattttattctctttgtagcaattgygaatggcagttcactcatgatttggctttctgtttggctattactggtgtataggaatgcttgtgatttttgcacattgattttgtgtcctgagactttg

SEQ ID NO: 26232 - DNA, 201 bp, Homo sapiens
ctcttatattcaaatgccgtttgtacgtaggtgcatcaaaaagtgttgctcttcatttgtagactgacaagataatggagaagattgagttcccaggttgycctgtattttttatcaccataaatctcagccccttgcagcagtgtgaaaaagacaatacgcatttccaagtccattagagagggatagagtcaatgcaat

SEQ ID NO: 26233 - DNA, 201 bp, Homo sapiens
ctttagattcttggcaaatatcaaacttgcaaacattaaatttgtgaatcccaaggaattactgtgtgttctatggtgactttctgcccaagattttaggyagtctaaataaattgcctgttgtatatttttaaactataacaaaaatctatggcacaaaatagtgtaacagatgttagcatatgcaactactagagatag

SEQ ID NO: 26234 - DNA, 201 bp, Homo sapiens
ggcaaaaagcatagatagtcaatccttttacaggaagggaagtgaataactatgtaaaataatgccatccatcccagttcatgagcataaaggaaagaggtttttttttttttttttggtgggggtgcaaatttatcaagtcctagattattgaacgcaatacatgcttcagaggtagctagggtcactttagaacatttg

SEQ ID NO: 26235 - DNA, 201 bp, Homo sapiens
atcaaacttgcaaacattaaatttgtgaatcccaaggaattactgtgtgttctatggtgactttctgcccaagattttaggtagtctaaataaattgcctrttgtatatttttaaactataacaaaaatctatggcacaaaatagtgtaacagatgttagcatatgcaactactagagatagccacatttgcagaatgctt

SEQ ID NO: 26236 - DNA, 201 bp, Homo sapiens
tttgtgaatcccaaggaattactgtgtgttctatggtgactttctgcccaagattttaggtagtctaaataaattgcctgttgtatatttttaaactatarcaaaaatctatggcacaaaatagtgtaacagatgttagcatatgcaactactagagatagccacatttgcagaatgcttactgtgtactaggcacttttc

SEQ ID NO: 26237 - DNA, 201 bp, Homo sapiens
atattaaccatccaaatgagtcttcagagtctaagttggctaagcatcatgcagactgaaagcgtagaacatccagctactctcctgacaaagaccatttygaaattttggatgacatttacaaacatctttctaaaagtagccagtggttcatgaggtagtgtgaagtttctgagtgaatatctgagagaggtgtgagtc

SEQ ID NO: 26238 - DNA, 201 bp, Homo sapiens
tataatttttcatgtgtaatagccgattaaataagagagttccctgacctccgttacaggacattcaacaggggtgtgtctcatctgttcaagtgctgcakgttcaaaccccttatgggcagggaaacatgcagacaggggtgcaggagccggggagagtgcttctggactccgggccccatggtagcatctaggggtggg

SEQ ID NO: 26239 - DNA, 201 bp, Homo sapiens
aaacacacacacaatgagaaaggtgtaatagttgactggaagcagagcaggcaacattgcccccgcccatctccaccttttaaaaattcactttacctacrttctccagaatgtttccccaaaagcaaaggctgcaggatcacagcacaaactacggtataaaaaagctgcctggtgttttaattgctgtaggttaacagg

SEQ ID NO: 26240 - DNA, 201 bp, Homo sapiens
tcatcttaccagtgtggacactgaagcttagaaaggttagtggcttgcccaaagttccacagctagaaaacgtcaaagcacatatgtgattccagactacsttatggccacacttcttcaactctatcataaccaaggtatctatataagagctctcccctaaagttaattatgtaggaatttaaataaacacacacacac

SEQ ID NO: 26241 - DNA, 201 bp, Homo sapiens
atcatgcagactgaaagcgtagaacatccagctactctcctgacaaagaccatttcgaaattttggatgacatttacaaacatctttctaaaagtagccartggttcatgaggtagtgtgaagtttctgagtgaatatctgagagaggtgtgagtccagtctttgggaccattttttcctgcagggcctttactgatccac

SEQ ID NO: 26242 - DNA, 201 bp, Homo sapiens
gaggggacaatataacaaaaatgagatgtaatatgagtaagagacaatagaaacaaatccactaatatgccagatagtaaagttacctggcacacttgctrtacaactgtgattactcaactcatggaaataaaagtcaaactgagaactttcagcaaggaactgcatactatagaaagtgacattgcaatatgaagaaga

SEQ ID NO: 26243 - DNA, 201 bp, Homo sapiens
gaggccacgaggggaggctgcaagggaaggatggggaaatggtgcacgcacatttgggaataaaaaatgagagtgttgtccctggagcgtgaagaaatgcyggggagcatgtggagaccaaggggctacagaagacatctgagctctcttctgctccagttaagaatttgaaattatcctataggtagtatggagtcagtg

SEQ ID NO: 26244 - DNA, 201 bp, Homo sapiens
acacaatgagaaaggtgtaatagttgactggaagcagagcaggcaacattgcccccgcccatctccaccttttaaaaattcactttacctacattctccaraatgtttccccaaaagcaaaggctgcaggatcacagcacaaactacggtataaaaaagctgcctggtgttttaattgctgtaggttaacaggtatttctg

SEQ ID NO: 26245 - DNA, 201 bp, Homo sapiens
ttttaagatggaatctcgctcttgtcacccaggctggagtgcagtggtgcgcgcaatctcaactcactgcaacctccgcctcctgggttcaagcaattctyctgcctcagcctcctgagtagctgggattacaggtgcctgccaccacactcagctaatttttgtacttttagtagaaacagggttttgccatgttgacca

SEQ ID NO: 26246 - DNA, 201 bp, Homo sapiens
agagaaacagtgaactggaagataagtcaagaatctactcagaaaaaagtatggataaaaaaaggatgaaaaatatataagagaggttaagacacatagarcacactcagaaaatatataacacacagttaattggagtctcacaaggaaaagagagatatatggaacagaagcaaactttgaagagctactgactaaaat

SEQ ID NO: 26247 - DNA, 201 bp, Homo sapiens
caagaatctactcagaaaaaagtatggataaaaaaaggatgaaaaatatataagagaggttaagacacatagaacacactcagaaaatatataacacacasttaattggagtctcacaaggaaaagagagatatatggaacagaagcaaactttgaagagctactgactaaaatttttccaaaactggtggaagtcatcat

SEQ ID NO: 26248 - DNA, 201 bp, Homo sapiens
gaggactagaagaagagacagcgcggaatactaggagcagaaatgcacttagaagtcagagtcagacatgcatgcccgtgttcatcgcggcactgtccacratagcaaaggcatggaatcaacctagatgcccatcaatggtggatgggatgaagaaaacgtgctacgtatacaccagggaatgtgacacagccacaagaa

SEQ ID NO: 26249 - DNA, 201 bp, Homo sapiens
tgaggtggaaggatcccctgaacccagaaggtataagctgcagtcagtcgtgattgcatcactgcacaccagcctgggcaacagagtgagatactttcgcmaaaaaaaaaaaaaaaaaaaaaaaaaaaaaaggctgggagagaccaaaatgactagagcagtcctaaagctgaattcaaaactgtttgagagctctcctgg

SEQ ID NO: 26250 - DNA, 201 bp, Homo sapiens
tgaggataatttctgtatattgggtggttattaaagttgtgggagtaggtatgatcacttttaggagtattttaccaagagaaaggggccaagccaactcytggggaaacactgccatgtaacgggtggatgaaagatcagaggagaggaggctgaggaggtgcgctgagtgcttggtggagaaccagaagagagtggtag

SEQ ID NO: 26251 - DNA, 201 bp, Homo sapiens
gatctacgagattctagaatgaatctttccccatcttggaagctggaacgttttcccttcagccccctggcagccctgctggttctccttgtctgggctcrcactcttggtggtggcaccgaaacacaatctgagccacatgaagaggacaggcgcatgtgacaggctggttactttgagaaggctcacacctccccacac

SEQ ID NO: 26252 - DNA, 201 bp, Homo sapiens
tgggagagaccaaaatgactagagcagtcctaaagctgaattcaaaactgtttgagagctctcctggctttacagaaaggtaataaggtttagagacggasagtatggggactctaacccaattttgctgtcagacaaatttcctaatctccccgattcctcatcatttcgtcaatttttctttaaatcacataatagtac

SEQ ID NO: 26253 - DNA, 201 bp, Homo sapiens
gcatgaaggagaaaaagaaaacttcagagatttcaagccctaactgtttctttccctctttctcatgatcatacaatatttttcctgacagagtatcactkataaaattgaaatttctcagctgggcatggtggctcacacctgtaatcccagcactttgggaggccaaggcgggtggatcacctaaggtcaggagttcga

SEQ ID NO: 26254 - DNA, 201 bp, Homo sapiens
agcattactgaatgccccgaatctgtattaccattccagtttacagcgacaatttaagggtattagtatcctgttatttgcgaaggaattcacaaggaaaygtaaaacaattggaaaagacaatggaaaaatgttacacagagttttatgtgaatcaactaagataaaaaaattgaatcagattggctgatgaacgaatgc

SEQ ID NO: 26255 - DNA, 201 bp, Homo sapiens
cataagccttcctcaaattttacctcttctgcaaagttttctcttcctctccatactgaaatctctgtctgaattcctgcaaacgatttgagagcctgtgyggtatagtaatgaagtattaagatacaaccagatcacctcagttagtatcctagcatcaattaaccttggaaaatccacaccacctctgtttgcactgat

SEQ ID NO: 26256 - DNA, 201 bp, Homo sapiens
actagaccagagaatggcggttggaccagagaaggacaaggaggagcttcatatctgaatccaggaatagaatcaagtttatgtggcaacgatagaagttstgggtttatgtattgaccccagacactgcgctctttgttacccattctgctaagtgagccatgctgggaatcccatgcacgttcactggaatggaatgca

SEQ ID NO: 26257 - DNA, 201 bp, Homo sapiens
agaaggacaaggaggagcttcatatctgaatccaggaatagaatcaagtttatgtggcaacgatagaagttgtgggtttatgtattgaccccagacactgygctctttgttacccattctgctaagtgagccatgctgggaatcccatgcacgttcactggaatggaatgcaggacagatgccaaccacttggaaagccac

SEQ ID NO: 26258 - DNA, 201 bp, Homo sapiens
ctagaccccaagagagggttcttggacctttcacaagaaagaatatggggtgagtccatacagtaaagtgaaagcaagtttattaagaaagtgaaggaatraagaatggctactccataggcagagcggcccattgttcaaatttatttgtgaaagaaatggattgtttgttctgtagatcatcccacatcttggattttg

SEQ ID NO: 26259 - DNA, 201 bp, Homo sapiens
catggtcaccatgcctggctaattttgtatttttagtagagacagggtttcaccgtgttggtcaggctggtcctgaactcctgacctcaggtgatcccccygcctcagcctcccaaagtgctgttattacaggcatgagccaccgcacccagccataatttggaatactttggacaactcacaagcctctctgattatttc

SEQ ID NO: 26260 - DNA, 201 bp, Homo sapiens
acctgagatctctcatctacacctctctaaaaagtgtggtgataatgcctggctgttttgcaaagttgaggaagacaaaatgagacattcaatgtgaaaaytacattagagttgtaaaggaccatgactttgccagatataaaatatgattctcaatatccaaggacaattttacaatagctactttgcttatttctatat

SEQ ID NO: 26261 - DNA, 201 bp, Homo sapiens
gctaccatgaacattgacttgcaggttttttgtggacgtattcattctcttgcgtaaaatacctaggagtagaacttctgggtctcatatggtaatgataygtttaactttataagaaagtgccaaattgttttccaaagtggttatgccattttatattcccacctatatgattgacaattctgaaataggagttggggc

SEQ ID NO: 26262 - DNA, 201 bp, Homo sapiens
gaacttctgggtctcatatggtaatgatatgtttaactttataagaaagtgccaaattgttttccaaagtggttatgccattttatattcccacctatatrattgacaattctgaaataggagttggggctccacaccagaccagatggaagactggctaaaacagggaagagacagaagcacctctgcataagacatgcc

SEQ ID NO: 26263 - DNA, 201 bp, Homo sapiens
accttcctgggtggagtcccaatatgggggcttgcctgccttgcagcagttcttttctccatctttcccaatccttaatattgccaatcttttcatttttrgccactggcagttgcatagcagtatctgatggttttattttgcatttccctgatgactaatagtgctgagtccttttcacatgctttttgacaattcatt

SEQ ID NO: 26264 - DNA, 201 bp, Homo sapiens
catcatttattctcataaattacttggttgaagtcagccatctgagggttggcaggaagagtttgttgctcttgaaatatgaatttgatgagtcaaaagcrggcaccatatatgggataccatcatgcacagtatgattgagacttttcaaacttgacatgtgaagtccagtaacagccttaaatccaaactaactgaaag

SEQ ID NO: 26265 - DNA, 201 bp, Homo sapiens
atctttttttttttttttttttttttgagacagtcttgcactgtcacccaggctggagtgtagtggcaccatctcagctcactgtaacctccacctcctarattcaagttattctcctgcctcagcctcccaagtatatgggattacaggggtgtaccaccacgcccggccgagttggggatatgtgagtaaagacctgaa

SEQ ID NO: 26266 - DNA, 201 bp, Homo sapiens
aggctctggatggctggctccccttacatcagtgctgagtcctcatccaaagcactggggccaagtcgtacaaaagtgtgctgccttcaggtctctggtgkggcatcttcgctccaaaggaggtgtgtccagggaatgcatgagagagagctttaaagcaatttttcagcctagctgagggctggaactagatagagcaca

SEQ ID NO: 26267 - DNA, 201 bp, Homo sapiens
ttgcataccttttggtgaatgatattgtaacattagtgtaggatctgaggtcaaagagccaactgtttttttttttcttttacctacttgaccttcagcartcagagtaactgaggtcagagtctctaatcgacagacatatcatcactgggtctccatcgcttcccaatcccaggtactctgattttgagttttagtgac

SEQ ID NO: 26268 - DNA, 201 bp, Homo sapiens
cctcatatacaaaatggggataaaaataaatgcccacctaatagtgtcactgtgaagataaaatcagatagtacatgtgaagcacttaaaggggtatatastaattgctcaataaatgtcagtcttgaataatcttggggcctcagtgtctatatctgtaaattgaagaggttggactagagaaagaattgccaagttgcc

SEQ ID NO: 26269 - DNA, 201 bp, Homo sapiens
ccaggcaaagtgaacagcaaatgccatacccaagaagcagcaacacacctggtttggctcaagaagcggaatcgaacaaagtgaagacaataagaaattarattagaaaggtcaggggtgggagaggagagaaagccattgtgatgcctttggctgtttgattgagtggatgggaagcagttaggaggatttcagcagagc

SEQ ID NO: 26270 - DNA, 201 bp, Homo sapiens
cttgcatacagcaaagtggcttgtaactcctgtaagattcagttcctcatatacaaaatggggataaaaataaatgcccacctaatagtgtcactgtgaasataaaatcagatagtacatgtgaagcacttaaaggggtatatagtaattgctcaataaatgtcagtcttgaataatcttggggcctcagtgtctatatct

SEQ ID NO: 26271 - DNA, 201 bp, Homo sapiens
taaagtcacttttataatgaagtcattcctgccgtcacctacaataacgcactccctcttggtttagtgctgaattttacttctaattttacttcactcayatcactggcgtcaactctgggcatgcaaagatctctacaccatcgaaagcacacagacaacaacttgattttctcccacagttactttatcaagtttgtt

SEQ ID NO: 26272 - DNA, 201 bp, Homo sapiens
tttttgtatttttagtagaggtggggtttcactgtgttaaccaggatggtcttgatctcctgacctcgtgatctgcccaccttggcctcccaaagtgctgkgattacaggtgtgagccaccacacctggcctatgactaaattttaaatcccacttcaattatttgttctttgcccagccagccttttgcttctgagtagc

SEQ ID NO: 26273 - DNA, 201 bp, Homo sapiens
taggtgaccagtagaagaaaagtgcctggtgccaatttttattccatagtataaaatagtctctcaggacagggtttttggtgagagaagcacaggatgtygctgggtgactgagaccgggtcaggaaatagggaggcagagggcaacagtttctctagaatttaaaatttggttgcttttggaagagaaagcaagagatt

SEQ ID NO: 26274 - DNA, 201 bp, Homo sapiens
attcctttttatgcactggcaatgtgagtagatgctcaataaggttccttccttcctcatttgtttaattatttattcaagaaatagttattgagtgcctrgtctgtgtcagttggtgagtattgtagtcatttacacattgttaatatatttttatgactaaatttgatgtttttttttttttgagacggagtctcactc

SEQ ID NO: 26275 - DNA, 201 bp, Homo sapiens
tttttgttccatcactaacttctcttggaagcagagagtctggggagcagtccttttttcctgtgtggctttgcacaggtcacaaagtggctccaaacccsttctacctgtgagatagacaaatacctccctcacaggctttttctgaggattaaggaaagtaataaatgaaatctttttagcaaaagtacaagcattttg

SEQ ID NO: 26276 - DNA, 201 bp, Homo sapiens
tctctgaaatatattgctacataaaagtgatggcaaaaataattgttaaaatcaactttttgagaactctggaaatagaccaaagccttatagcaatctgyggcatatttattcaagaaaaatcactgaatctaagtaagagtcatttttgtggcattctcttcctattcccatctctctctctcctcctagctttgtagt

SEQ ID NO: 26277 - DNA, 201 bp, Homo sapiens
tgctcatagttcattggccaaaactggtcaaatggcctctctcagccacttgcagaatgcagttctaccatgtgtttggaagtggagacaaaggaaatatytggcaaacagcactaatgacccacagtcattataaccatattttacaaattcaagataagaaatatttcacatagaggaaaaccttaaaatttgaagata

SEQ ID NO: 26278 - DNA, 201 bp, Homo sapiens
ccatggtagaatcttggagatggacatagaagaaatacaaaactgctattatgacaaattaagggtgagtttccacatgcaatcaatgttcataaatattrgtgaattgctattggtaaaaataaatccaaggtaacgtctattcaagcatttgcaaatcatgtgggatagtctgctctaaatcatgtttagagcagactg

SEQ ID NO: 26279 - DNA, 201 bp, Homo sapiens
catggagatccaaatatttatatgaagtgtaaagcagaaagaatgaggagagtgggatctggaggaaagatggaataatcccgttaggttggagtcacagygcaactaactcttaactcactccagcttgaatggaccattattgatcagagtcaacgtttgccatttgcctgatagatgctgggaagcaaagccttgctt

SEQ ID NO: 26280 - DNA, 201 bp, Homo sapiens
aaagaaagtttaaaaaagtgaacgggttaacctagcatgtgatccgggagaatcccaaagtctattctctcaatttaatccctttaaatatttttttcccmaaatcagatctttccagttggaagactctcaggactgcagcagagattttgtggagatccgtgaaggaaatgccacgggtcacttggtgggacgatactg

SEQ ID NO: 26281 - DNA, 201 bp, Homo sapiens
tggctgagccaggggctgaatccaggtagcctggctccagcatccacacttttctgtgctacaaaatagtggatattagtgcatttatttgtatgggtccractgggctggagatttttgctttaggtacatgtgtcccttggtcatctaagtttttcctctggtcctattgttcttgatcatgtttataaatcacctctc

SEQ ID NO: 26282 - DNA, 201 bp, Homo sapiens
cacttgcctaggatcacacaactagcaaatggctgagccaggggctgaatccaggtagcctggctccagcatccacacttttctgtgctacaaaatagtgratattagtgcatttatttgtatgggtccgactgggctggagatttttgctttaggtacatgtgtcccttggtcatctaagtttttcctctggtcctattg

SEQ ID NO: 26283 - DNA, 201 bp, Homo sapiens
agcgggtgatgctggggcccttctgaatcctgtttcagaggagccctgccctcctttgaggtttgcaggaaaatacagtttcaggcataatgtaggaaagkctttaagttcttcactctgcacagtaattaatcgcctgtgtgaaaatagggaagtcacttaagctaatcaggccatgaaaaagtaatctgcaaaatgaag

SEQ ID NO: 26284 - DNA, 201 bp, Homo sapiens
agtttttgacatgtgtgccttgagtatagctgatgttcaagacagttgctgagtgaacaaatgaagaagagtcacagactggagaatcagtgactcacggrccagaatgcaatgcgcgcacctatccatcaaagcaaacattcataaaacctgggctctcctgcaaggtactattccagcacaggcctagaagaaacattg

SEQ ID NO: 26285 - DNA, 201 bp, Homo sapiens
caccacttctccaagacctttttacccattgcctttcatctgctcgttctaagagatgaaccccttatcccatagtcagagatgacttgtattcagatgaytcagaacattcactacaaatacatttagtctgtgtagtcattatgtctatcttagtcaactcgcttatattctgtagtaaagagctctggatggggacag

SEQ ID NO: 26286 - DNA, 201 bp, Homo sapiens
atatcaagaaatctaatagtggctctgacagaggaagtcctgctgaaattcacgtcagcatccctagaaatgaccaaagacttgttacagctgtgagaaargacaataaagccagtttccctagatccagcaaacgtgtgattatccactagtatatcggcgtgcagacagttcgtggaatacaggccttctagatgtgaa

SEQ ID NO: 26287 - DNA, 201 bp, Homo sapiens
tttgccagaaaaaccccagagctcacggggtttgagctttgcaagctctgtcgaaaatgcattcatccttaggaaatatacttaggtggaacctaaaaacmaagagcataaagatgctgagttcctctgtgagtggagtttaaatctaaacctcatcctgaccgtctctaaactggctttgtaccacacaagagtcttcag

SEQ ID NO: 26288 - DNA, 201 bp, Homo sapiens
cacatagtaagcactaatgaatgggagttattattaatcatccaagcaaaggaactcatttcccccctgatttacacataagagtattcaaaaattcatcyagacactgagttccaagcaaattagtaagcttcaaattttacaaatcaatacagagatttcaggtatatgtgacatagattccatttcattacatgcctg

SEQ ID NO: 26289 - DNA, 201 bp, Homo sapiens
atcatacctgtggctaaagagaacatgcagaatcatacctgtgtgctaaacagaacactgattataatcatcaccagatttttaaagtcacttgcgagtamcttccttacattgaatctccgaactttctatttttttccccaagattttcttatgaaatataaatggcaatttgtttttaatgaaatggccatattttac

SEQ ID NO: 26290 - DNA, 201 bp, Homo sapiens
tagcaatagaaatgaacacaatcctgtcatttgtggcatcatggatgagcctgaaggactttatgttcatggaaataagccaggcacagaaagataaataytgcatgatgtcactcatttgtggagtgtaaaaatgctgatctcgcacaagtacagggtagaatagtggttaccagaggctggggacggtagcagggagga

SEQ ID NO: 26291 - DNA, 201 bp, Homo sapiens
agctcactgcaacctctgcctcctgggttgaagcaaatctcatgcctcagcctcctgagtagctgggattacaggtgcccaccaccatgcctggctaattkttttttgtatttttagtagagacatggttttgtcatgttggccaggctggtcttgagaaaaccttctatttttgatccattccttgtgaagtattacttc

SEQ ID NO: 26292 - DNA, 201 bp, Homo sapiens
gactttttaatgatcgcacataaaaagccttgatgaagaataagagaaggtaattggaagaatttaccaaccaataaagaatattaaaaaaaaaaaaaaamagaaaaagaggcccagaaatgttaagagcaaaaaatgttttgttaatcaccaaaaattgctgttggaaaacaagataatttcttttctaattgtgtctct

SEQ ID NO: 26293 - DNA, 201 bp, Homo sapiens
cttactagcctacattgaatgagacagtagtttaatagcttagcacttgcctccctgtctttatttttatagaaaatcacacaggttaggatgtttgtgayggagcttgtaaaattataacatgctcatcacatttggggtgtcattggtatataatttgaattccgggacacatgaaaaccttctttttattgagatgga

SEQ ID NO: 26294 - DNA, 201 bp, Homo sapiens
ccaccctccccagccccacacatacacacaggagataaacaggacccagaggagactgagaaacctgtctgtgaggcctcctggaggcctggcctaggctmtccttgcctgcaagatgccctccgtgagcccaaggagactctttccagaggactatgtcactggggtattggattccagtcagacagacagtttgggaga

SEQ ID NO: 26295 - DNA, 201 bp, Homo sapiens
gagccgagattgcaccactgcactccattctgggcgacagagcgagactctgtctcagaaaaaaaaaaaatgtagtaaagcataagggtccaggtgagaargaggccacactagaccagagaatggcggttggaccagagaaggacaaggaggagcttcatatctgaatccaggaatagaatcaagtttatgtggcaacga

SEQ ID NO: 26296 - DNA, 201 bp, Homo sapiens
aaaaaaaaaaaatgtagtaaagcataagggtccaggtgagaaagaggccacactagaccagagaatggcggttggaccagagaaggacaaggaggagcttyatatctgaatccaggaatagaatcaagtttatgtggcaacgatagaagttgtgggtttatgtattgaccccagacactgcgctctttgttacccattctg

SEQ ID NO: 26297 - DNA, 201 bp, Homo sapiens
ccctcaccacagcaatgtcctttcacctggtctcatctccttcagtctcgttcccttgcatgtaaaatgctggttctggatcaatttttagatcagacttrattagcaagtgcatcctgattctaccacttatttgattaaaaatctttcaactgaatcccattagccaaagaacacagtctgacagccaaactctgtata

SEQ ID NO: 26298 - DNA, 201 bp, Homo sapiens
tgatcagaaaagttcaaaggatgctcgagtattcgtctttaaaggagaagcctcctgtgtcatgcttcctgtaggcgtgtttgtgtgaacgagctgttgcrttgcacctgtgtgtgctgcttgagcaattcacttcactgctcagggtctcaattatctcaaaggtaaacgaagaagctggattacttttttctaaagttt

SEQ ID NO: 26299 - DNA, 201 bp, Homo sapiens
atggaaaataattcccgtccaatgatggggatggaagggttgaggaggtgggtaggaggaagaactttccaaagaaaaacaaacggaattgattttccaargtctgtgcctacatgggtgtttttccctctaaaaacatagcaggctgagttgattgactttaattatattgacttacagttcttgattgttgttactctt

SEQ ID NO: 26300 - DNA, 201 bp, Homo sapiens
tgcaatggtcattttcaaatctggagttgtaaacagaaactctagaatgagtttcacctatcagattgcaggtgaggccaggaacttcatcttttattcaraaaagctgccatcattaccattattcgtagaataattacaattatttctagaattgactcctgtgagtaaattaggatttgttaacaaaaaccacatccc

SEQ ID NO: 26301 - DNA, 201 bp, Homo sapiens
ccttctgaactgttagaaataaatttctgctctttataaatcacctggcctcaggtattctatggtatcacaaagaagcagactgaggtgtgtcatgagcwttttaaagagaagtaacatggtaaatctagaatttggagagagaagacgctgctactcactagtgatgtgaacttggatgacttactagcctacattgaa

SEQ ID NO: 26302 - DNA, 201 bp, Homo sapiens
cgggcgcggtggtgggcgcctgtagtcctagctactcaggaggctgaggcaggagaatggcgtgaacccgggaggcggaggttgcagtgagtcgagatcgygccactgcactccagcctgggccacagagcgagactccgtctcaaaaaaaaaaaaaaaaaaaaaaagggattgcttttccctctaaaaggaatcctgcca

SEQ ID NO: 26303 - DNA, 201 bp, Homo sapiens
gcctggtaccaaaaagcaaaagcaaaagcaatatgattagtaacttctgaagctttttgtggctatctaggagaaagaaagaaaagtgtctgatgtgatcyggaaaaaaaaaaaattccctgtgctcccacccaaagctgcaatgtctgttgttgttccattattcgacaataaaatgcagggtggaacagggcagatacc

SEQ ID NO: 26304 - DNA, 201 bp, Homo sapiens
ccatcggctgggcatggccttgtctggtcagcacgcaagtggcttcattacgtttcctttcacgaaggctgagtattaaagtgacctctggctgacagttwaattgcttaattagagcctttcttctaagtcttcgattcatgtagctctgcaagctcttattgatctcctagaaaggctgcttgtagctcagtgtgagag

SEQ ID NO: 26305 - DNA, 201 bp, Homo sapiens
gctgtgggacccatcggctgggcatggccttgtctggtcagcacgcaagtggcttcattacgtttcctttcacgaaggctgagtattaaagtgacctctgrctgacagtttaattgcttaattagagcctttcttctaagtcttcgattcatgtagctctgcaagctcttattgatctcctagaaaggctgcttgtagctc

SEQ ID NO: 26306 - DNA, 201 bp, Homo sapiens
atgcccagcaacagcattttcctgtctacctacctccaactcttcagtgctcctacctgcagccctcaccacagcaatgtcctttcacctggtctcatctycttcagtctcgttcccttgcatgtaaaatgctggttctggatcaatttttagatcagacttgattagcaagtgcatcctgattctaccacttatttgatt

SEQ ID NO: 26307 - DNA, 201 bp, Homo sapiens
gtaattaaccttgggctctcctcaatgacacatcaggagcatttcttgctaaggaagctgtgggacccatcggctgggcatggccttgtctggtcagcacrcaagtggcttcattacgtttcctttcacgaaggctgagtattaaagtgacctctggctgacagtttaattgcttaattagagcctttcttctaagtcttc

SEQ ID NO: 26308 - DNA, 201 bp, Homo sapiens
ctgaagaaatggctcttttgtgtgagagagatatttccaattcagggaagaaagagtgacgtttgttcttggacgcagggtgtgtcatcagagagtgactracacacctgattgatgaggcaggtgctgatggatgagagctgtctaggtggccccaaaatgtgtagtaatgaggaaatgatggattggtgatgctaaaca

SEQ ID NO: 26309 - DNA, 201 bp, Homo sapiens
ccttttaaaattattatttatacatcctgtgactcttgtttcagtagttaccttagagattacagtattcaaccttaatatgttagaatctaatttaaagktgatacttttatcatgttataatcaataatcaatccaaggaccttggaacattttaaacccacttacccacttcctgtcttttgtgctatctatgccaag

SEQ ID NO: 26310 - DNA, 201 bp, Homo sapiens
ggcaaaatataaaatgtaataatagtccaaacaagttgtcagaatcagataatgctgtatgaagtacagttgactcttgaacaatgctgggattagggtcrttggccccctgcttccctgtcgtgcagtgaaaaatctacatacaactttcaagtcccccaaaacttaactactaatacctatgacggacagaaggcttac

SEQ ID NO: 26311 - DNA, 201 bp, Homo sapiens
cccttttaaaattattatttatacatcctgtgactcttgtttcagtagttaccttagagattacagtattcaaccttaatatgttagaatctaatttaaarttgatacttttatcatgttataatcaataatcaatccaaggaccttggaacattttaaacccacttacccacttcctgtcttttgtgctatctatgccaa

SEQ ID NO: 26312 - DNA, 201 bp, Homo sapiens
atgccagcatggctaggattttccctcttgtggtcatgaggagggttttccacctacatgggacataaacacacagacaaggttttctatgaacactgccrtatttcagcatgcagctgggcttggcttaacaaagtgcagcaggaggaaacagcaggagtgaaacctcaaatgtgatcgggtcttaggcacggagatgga

SEQ ID NO: 26313 - DNA, 201 bp, Homo sapiens
tatctgataaaattactaacaatattagttttagatagacctttgtactatttgtgttttgtttgtcccacttctttttgttttcctttaactatcttttytttttaaaattaatcacttttttattactccccttttaaaattattatttatacatcctgtgactcttgtttcagtagttaccttagagattacagtatt

SEQ ID NO: 26314 - DNA, 201 bp, Homo sapiens
atctaatcctcagagctaccagatgagacaggaattaccccattttacaaaggaagaaagaaaaatttaagagattaagtaatttgtctgtggtccaaagrgtttgtaagaggtaaagccaggctttgaacatgagtttgactgtcccccaaactcctgattttcttagtaagccttcattgcctctgtggcaattgataa

SEQ ID NO: 26315 - DNA, 201 bp, Homo sapiens
gctcctggtgttcaagacagattcatttcagacagcaaaaggctggaagatgtctttccggcagacattgggtaagaattctggacttgtaaatctatttktcaggactgttacctttctgctttatttaatttccccaccccccccccacccccacctgattatgattgcttttccttgaagcttagaagaatatgccat

SEQ ID NO: 26316 - DNA, 201 bp, Homo sapiens
aggggaacacaaacattccaaccatggtatacataccaactcatagaggtatgttatatattctctctctctttatctgtctatctatctatatatatatrtatgtatacaatctaaatgtattttttcagttttcagcctggatcctggagctcaccataatgaaatttacatctgcatgtttattttattttacttatt

SEQ ID NO: 26317 - DNA, 201 bp, Homo sapiens
tgtaggattgattattgccttgttctgttcaggttgctttaacaaaatatcataaactgggtggcttataaacaacaaaaggctgcaaaagtccaaggtcraggcagattcgttgtctggtgagctcctgttttctggcttatagaaggtaccttcttgctgtgtcttcatgagctggaagggcctcttataaaacactaa

SEQ ID NO: 26318 - DNA, 201 bp, Homo sapiens
gtgtcaacgatggcgtgcacattatcagaggttacagcgtcatgtccaccccatttgctactgtgtgtggggatgagatgccagctcccctcaccatcgcygggccggttctgcttaacttctactccaacgagcaaatcacagacttcggattcaagttttcctataggataatctgtgagtagccataatgacagagtt

SEQ ID NO: 26319 - DNA, 201 bp, Homo sapiens
tgctcagctgatgttaacgaatgtgagatttactcaggaacacccttgagctgccagaatggaggcacatgtgttaatacaatgggaagttacaggtaactttttttttttttttttggtaaatatcaggtatatttttgaaggcctaaaacatcccatagttaagagcatcctaaattaactatctgtattccaccaaaa

SEQ ID NO: 26320 - DNA, 201 bp, Homo sapiens
atttaagttttggagagtattccgttgcacgagtgtggcctaatttatttaatgaagcccctctaagtggacatttaggtctcttgaactttttgcaactrcagacaacacttaataaactttttggtagtgatatctttatacatatagttacattacttggtgagaaatggtaatcacaggaccagcagacactgtatc

SEQ ID NO: 26321 - DNA, 201 bp, Homo sapiens
ggcagggaagacagaattgcaaagattgcctgagatgagacatgaataaaatgtctcctgtgttgctttttcctccctctccagtgccttgtggtggaacrtacaatgcaacttggaccccacaaaatatttcatcacccaattcatcagacccagatgtcccattttccatctgtacttgggtcattgattcccctccgc

SEQ ID NO: 26322 - DNA, 201 bp, Homo sapiens
cattatgcaaaagtaaaattaaccacttctgacttaaatttagtgttatgttattaaagagctttttgattccaggactctgtttctcatttaaatgaagmcttttttccctgcctttgttaggcttgggctggaagcaaaatgcagtctagtctctcatttccgtgaacccattatctcctgatttctgtttatgggcat

SEQ ID NO: 26323 - DNA, 201 bp, Homo sapiens
gttttcagcacgttattttttccccctgcaaaatgaaaaacaaaacaaaaacccttttactatttaccactctgcagcatgtcagaggttagagttctttwtccacacacacatatgacagaatgagagctaggaggaaaggaaccatttatttgttgaaagctgcatttctaaatgacagattcaactttgtaagaacag

SEQ ID NO: 26324 - DNA, 201 bp, Homo sapiens
gggtatgtgacctcccccaaccaccctcataattatcccccgcacgctgattgcatttggatcttagcggctccaccggaaacacgcatacagctgcaatktgaagatcgattcgatattgaagtaacacccaagtatgtcacttccattttcatttttttcctaccccaagttagtattttttaaccgtcatgtctcaaa

SEQ ID NO: 26325 - DNA, 201 bp, Homo sapiens
tgtgtgtgtgtgtgtgtgtgtgtgtgtgtgtgtgtgtgtctgctgagtctggggcttggagttcttatgggcaccagatgggcgcagggcaggccaaaagrcaacatttgggtgggaaaacagggatggttctcactttgagtggcagatccaggcttgagggtggagcactcaccagggacctcaacctcttctaccaag

SEQ ID NO: 26326 - DNA, 201 bp, Homo sapiens
agcattccatggctttgtgaaaacgtgatttcatttgcgtttccttttaattatttttaaaataaattttggcatctgtatttaaagtgtttgaagtattytcttagtatcatccatgtcatcccttcttattctgttgggataaatggcttaatgtggatatcaaattcttcagtgtttttagcatcgactaactgattc

SEQ ID NO: 26327 - DNA, 201 bp, Homo sapiens
ggtagatattaaattatttttaaatgcatgcactactagattatcacaattctggaaggaaacatattattcttccagtatgctatatttttagaggacartgaagaagcagcattccatggctttgtgaaaacgtgatttcatttgcgtttccttttaattatttttaaaataaattttggcatctgtatttaaagtgtt

SEQ ID NO: 26328 - DNA, 201 bp, Homo sapiens
taactgtactatatccgaatattaaatttttaaagggtagatattaaattatttttaaatgcatgcactactagattatcacaattctggaaggaaacatrttattcttccagtatgctatatttttagaggacaatgaagaagcagcattccatggctttgtgaaaacgtgatttcatttgcgtttccttttaattattt

SEQ ID NO: 26329 - DNA, 201 bp, Homo sapiens; identical to SEQ ID NO: 5659

SEQ ID NO: 26330 - DNA, 201 bp, Homo sapiens
agttttctattattggcttatattatcataaatccaagaaatggtgggtcatagagaagacattgaactaacaggtatttgataacatcaaaggaattttwaaaaacctaagtaactgtactatatccgaatattaaatttttaaagggtagatattaaattatttttaaatgcatgcactactagattatcacaattctg

SEQ ID NO: 26331 - DNA, 201 bp, Homo sapiens
ccttaattgtttgtgtaggttctgatcataatgcggttgttccatgccttttccagctcgttccgctgtgacgggaagctgtgtcaacgatggcgtgcacrttatcagaggttacagcgtcatgtccaccccatttgctactgtgtgtggggatgagatgccagctcccctcaccatcgctgggccggttctgcttaactt

SEQ ID NO: 26332 - DNA, 201 bp, Homo sapiens
ttatgggagggggagcatgcagattggcaggtgcaggaacccaggcaagatgctacccacagtacggtctagtggtgggtgcctgtgactctcaaagcccycatgggcaggctacagtattcttttagctctgccatccacagagggctcaagtgttaaccagctcagtgactcttggtacccgacttcctgtctggcatc

SEQ ID NO: 26333 - DNA, 201 bp, Homo sapiens
gtgtcatttcctattaatacaaattaggtatgatccaagttaatattttaacagtatgtgttcacctacaaaaatcactggatatgttgtagtggacacayatctttttaatttcttgtttattttgttttatatttttctttgggggatggtaggctggagcatatattcacattataattggcaaacaaaacaataata

SEQ ID NO: 26334 - DNA, 201 bp, Homo sapiens
taatcatcagagcaattaaaattaaatatcacaatgaagtttcgtttcgcatgcaccagaatggctaaaattaaaaagactgacaatgtcaaatgttggcrtccctgcagagcactggaagtcccacacatccctggtgagaatgtatactgatgtaactactatgagatatagtttggcagtttcttgtaaaattaaata

SEQ ID NO: 26335 - DNA, 201 bp, Homo sapiens
ataccacatcagtgtcttgtcacttccataatttttttggggagaggaacctcagcagtaattcttgttgttctcctgaagataatgtgtctttttctccmccctcactgcttttattgtgtgtttatatttaattttccacaacttgattatggcgtatctagatctggttttctctgtgtttgtcctgcttgagagtca

SEQ ID NO: 26336 - DNA, 201 bp, Homo sapiens
ggatcatgaggtcagggggtcgagaacatcctggctaacacggtgaatccttgtctctactaaacaaaatgcaaaaaattagccgggcgtggtggcgggcscctgtagtcccagctactcgggaagctgaagcaggagaatggcgtgaacccgggaggcggagcttgcagtgagccaagattgcgctactgccctccagcc

SEQ ID NO: 26337 - DNA, 201 bp, Homo sapiens
ttttggagtcttgtgggccaatagagcgacaagtatgggcaaactgtgatgagatccatagaccaagataaaggctgttgctgttttcagcacgttatttyttccccctgcaaaatgaaaaacaaaacaaaaacccttttactatttaccactctgcagcatgtcagaggttagagttctttatccacacacacatatgac

SEQ ID NO: 26338 - DNA, 201 bp, Homo sapiens
tagaaaggtcaggggtgggagaggagagaaagccattgtgatgcctttggctgtttgattgagtggatgggaagcagttaggaggatttcagcagagcagkgacatggtgtgacttacattttaacagtatcctctcgatgacattttgaggatacactaaagaggaacacgagcagaatcaggggcttcatgggaggctg

SEQ ID NO: 26339 - DNA, 201 bp, Homo sapiens
tattaaacagtccaaaattttgtgttctcattattcatgtggccaactagaagccctcaatctgctaaaaaaaaaaaaaattatagatccagttttcttayttcatagataaagcacttcttgaggcaaaatgaagcaagccagtgccttctaaaccttgattattctttcattaaaattagatagtaggccgggcatggt

SEQ ID NO: 26340 - DNA, 201 bp, Homo sapiens
tgaaagctgcatttctaaatgacagattcaactttgtaagaacagtacgaaattctctcttgcactcttttataaaggagagcaagaatacagaagaactratgatgtgtggatggctttggaaatgatcttgattcctagactctgcccttcatagatttgctggaggacattagagaacagagcatttaaatcagggtt

SEQ ID NO: 26341 - DNA, 201 bp, Homo sapiens
gaggtaaagatggctctgggagaacagttttgggagggctagtgggacagaggaatcaaagcacttgtttatttatttattagatatttattgagagcctstcacgtgcagacacttttctaaaaactgggaacatggcagtgagcagaaaagaaatctgtacattcatggaacttgtattgtcttcagagagaaagccaa

SEQ ID NO: 26342 - DNA, 201 bp, Homo sapiens
attttggaatctggtattattaaataactgcttattttattttcccaaatattaaacagtccaaaattttgtgttctcattattcatgtggccaactagawgccctcaatctgctaaaaaaaaaaaaaattatagatccagttttcttatttcatagataaagcacttcttgaggcaaaatgaagcaagccagtgccttct

SEQ ID NO: 26343 - DNA, 201 bp, Homo sapiens
caaaaggtgggattggcaaggaaaagatgtggtatcccaggctacaaaatactgtgaggaaacacacttgtccctatatggcgtctactaaacattgacamctgcttagggagggttttaccatgaagggaaaaatacagattgttgaaccacactcaactcttaggttacaaaggctcagtgacctactttccgcttacc

SEQ ID NO: 26344 - DNA, 201 bp, Homo sapiens
gaagtaatacagtagacaggtttttcagactgaatcagagagtgctggaaaggaagtactgaaagacaaccctagaccaaatcttaggtctgcaggtggtycactgtgtaagtgtgcacgtgtgtacttgtgtgtgttttaatgtcaatttaaaaggatagagatattttcgtgcttgatagatcagagagtgaagtggat

SEQ ID NO: 26345 - DNA, 201 bp, Homo sapiens
tctaacactgctacacaaagtcacataataaaatagattccttttatatgtagaatggtggtgaataaaaagtataaatgtaaacaaatacgggtgggttrtatttgcaacccgcatgccaatagcagcatcaccatctgcaagataagtttccagaatggtggaaaaactcaaaacaaacatttctaaaccaaacaaagt

SEQ ID NO: 26346 - DNA, 201 bp, Homo sapiens
gtatataatagtggttcttaacagtcatttctttttccagcatgtgagaatgtggtaatagtcaatcaaacctatggcatcttagagagtatagggtatcygaatccttattctgaaaatcagcattgcaactggaccatccgggcaacaacaggcaacactgtgaactacacatttttagcatttgacttggaacatcac

SEQ ID NO: 26347 - DNA, 201 bp, Homo sapiens
gtcagttgccaaggtttagttatacaaactcgcttacaagagggagaagttatattaaagtgaagagtaaaagggtagctgctcccagaacaacttggccrggctagagtggaccatgggaatggggtggagcatgtgaggatttgggtaatttagttgtttttcttcccctaagctaaggacccaggctggctggatgca

SEQ ID NO: 26348 - DNA, 201 bp, Homo sapiens
tgatccagtttcaaaggcttcccactaagtgacacaattcattctttctttaggttcaagtagcaataatatgtgggttggggcggaggggcgcattgctwggcaaaagacaagttcgaaatagctgatgttatttgcaatccttaaacacaatttctgctttattactcatttataaagtgctgttctggagctgctata

SEQ ID NO: 26349 - DNA, 201 bp, Homo sapiens
aacatcacagaagtgcgttttctagaattgcatgctgctataatgagaaaagggaaaaactggattttttgacttctgttgaaattgtgatggcatcgagsggagctaatcaggaagctggacttgaaggcaggtttcaacacatttggtaatatatttgcactttctgctcagtcaccttcaagtgtctggtgtaattaa

SEQ ID NO: 26350 - DNA, 201 bp, Homo sapiens
gcacacaccacctttaagagctgtaacactcactgtgaaggtctgcagcttgacacctgaagtcagcaagatcacgaacgcaccagaaggaagaaactccrgacacatctgaacatttgaaggagcaaactccggacacaccatctttaagaactgtaacactcactgttcaggtccgtggcttcattcttgaagtcagcg

SEQ ID NO: 26351 - DNA, 201 bp, Homo sapiens
ttatgaattgtggtcagcaaagattctagcgcaggttcacagggctgggctgtgaatcacactgtctggttctaatctcaggcgcagaccttctctccgtwggtaatggaattgctttcacagtgtcgcttcctgctaggctgtgatagacataatgtcacacagagagaaatggtaaagcacccatccatccgcctccaa

SEQ ID NO: 26352 - DNA, 201 bp, Homo sapiens
tatttagaaggtaggatgggcagatctgatggtggagtagatgtgtgtcaatctgggagacagaagaaggaatcatggatagctcccgttttcctgcggtrtatgatttggtgcatggtggtgccattattcatagataggaaatcccagataaagaccatgtttgggggaaaattgtgagcttctatttgaacatgctga

SEQ ID NO: 26353 - DNA, 201 bp, Homo sapiens
gtgagccacatgagcacttagataacatcacagaagtgcgttttctagaattgcatgctgctataatgagaaaagggaaaaactggattttttgacttctrttgaaattgtgatggcatcgagcggagctaatcaggaagctggacttgaaggcaggtttcaacacatttggtaatatatttgcactttctgctcagtcac

SEQ ID NO: 26354 - DNA, 201 bp, Homo sapiens
caggtggaccatgaggtcaggagtttgagactggcctggcccaccccatctctactaaaaattcaaaaattagccagctgtggtggtgcgtgcctgtaatmctagctactcaggaggctgaggcaggagaatagcttgaaactgggaggcagaggttgcagtgagccaagatggcaccactgcgctccagcctgggcaata

SEQ ID NO: 26355 - DNA, 201 bp, Homo sapiens
gcatgaattgttaatagatgcatagctgaataaatgaatttttgtcatctctgctcctgcaatgctcagtgctttggtggaaaatctcagaggacaccatygggaatgtgctgtactgagttcactccctggcattgttattgatatacaatcttcgtgttgtgagccacatgagcacttagataacatcacagaagtgcg

SEQ ID NO: 26356 - DNA, 201 bp, Homo sapiens
taagtgcattaaaatattgatgggaaacccttgagcattaaagttctgtgtatgtccgtgctaggtgtgggcaggaactgaggaggtggacaaagccctgmtagccactggctgtgggaacgtggctccgggtcccgttatcacaccaagtaacacattcactgccgtcttccagtctcaggaggcaccagctcagggctt

SEQ ID NO: 26357 - DNA, 201 bp, Homo sapiens
caggcagctttgacatttgaactgagttttaaagaatgggcaagaattgatcagacaaatatctgggagaggaaggcttttctaagtagaagcagcaaggygtgagggcacaaaagttttgcaaagagcaagtccttcagctagaccacacattctctgcattctccattggggcagtatcaactccaaggaggtaaaatt

SEQ ID NO: 26358 - DNA, 201 bp, Homo sapiens
aaatatgaaatggaaagtgtccttgctttgaagtcaggaggtcagggtttccttcattactttccccttcggtgccaaatatgtaccagacactgccaggygcttgtttctggacgtgtaccacccctcaccctcttcatggcttggggttcttagtttgcttatttagaaaatcaggtgcctggggaacagaagcagaaa

SEQ ID NO: 26359 - DNA, 201 bp, Homo sapiens
atttccattcactttgaagatttttacctagaaagtcaccaagactgtcaatttgatgtcctcgagtttcgagtgggtgagttctatctaagaatgcgttytcccatttatctacaatattctttttatcttttttgttgttgtcgctgctgttgttgttgttttgagacaggagcttgctctcttgcccggactggagtg

SEQ ID NO: 26360 - DNA, 201 bp, Homo sapiens
ggcttaagcagcagaagtgtgctgtctcctggaggctggaagtccaaggtcaaggtgtcggcagggttggtttctcctgaggcctctctccttggcttgcrgatgctgccttttccctgtgtcctcacatggtgttttctctgtgtgtgttcatcctgatagctctgtgtgtccaaatttgctccttataaggacaccagt

SEQ ID NO: 26361 - DNA, 201 bp, Homo sapiens
tcctactaccacacactctcaaagcatttctcagacagtttgcaagaaataacaaaatctgtccagtaaggatagtaactacaatcccaaatagactcttyggcagcagtgactctccaaaactgctgaggcctagaccctcctcactgctgagaaaggaggactttgcaccttctttgggaaagagtgttgcttttacac

SEQ ID NO: 26362 - DNA, 201 bp, Homo sapiens
caagccttgagaagtttcagaaattagaagagaacattttaaaaaccgtgtcaacatcttttatgactggctcggtttggatgtaagccagtgccttcttractacctgtgggcatgaggcactgtaccaaagggcttttaaaaaacatctttagagcactggcagaaaaccgccatgaggtcggcagtgtttctcttaaa

SEQ ID NO: 26363 - DNA, 201 bp, Homo sapiens
ttattaatagcaaagaaaaattaaaatcccaaacttacaaggttttctactaacgtagagtttgctaaaagttaacagtgtaacatgcattatcctactaycacacactctcaaagcatttctcagacagtttgcaagaaataacaaaatctgtccagtaaggatagtaactacaatcccaaatagactcttcggcagcag

SEQ ID NO: 26364 - DNA, 201 bp, Homo sapiens
taacatatcagaaggaaaataattagaaaggcttctccttgcacagccccgcaagggatgttctcagaatcaggtggagggctcaggacagccccgctaaygctggtcctggagttgctcttcgtgccctggccaggtcaagtggctttaaactcctagcctcttttcctcagaatcctatcaccttgcaatcccttcccc

SEQ ID NO: 26365 - DNA, 201 bp, Homo sapiens
acctctgaaccaaaacctaaaaaataagcaggagttaactaggcaagcaggataaggaaaaggattccaggtagaagaaagaccctgtgataggagggagyggggagagcccgagggacctgagaagtcaagaggatggaactgagtcgaagagaaacagcgctgccaaggtggctgcagagctaagcacataatgtggct

SEQ ID NO: 26366 - DNA, 201 bp, Homo sapiens
ctgaagtaggtctttagtttgagataacctgagaaggggagcccacagagagggcgagctcttccatgggagaggtcccgccatttttgatccattggagktaaatgcaagacgtaaatcatgatgtatcattcacgcatttgttcattccacagacactaaggatgtcttttgtgccaggtactgtgctgagacggggga

SEQ ID NO: 26367 - DNA, 201 bp, Homo sapiens
gcttcctacgaagtgaataagtattttggtaaaatataaaaattgcagttatgtacaggaaacggaatggcagactagaaaaatagagggagaaaataaayttagggtcaggctggagccactttgattttttttttttttttgagatggagtttcactcttgttgcccaggctggagtgcaaaggcgtgatctcagctca

SEQ ID NO: 26368 - DNA, 201 bp, Homo sapiens
gaaattaacagcaggatcagcactaaaacgaaagccttatgcttcctacgaagtgaataagtattttggtaaaatataaaaattgcagttatgtacaggawacggaatggcagactagaaaaatagagggagaaaataaacttagggtcaggctggagccactttgattttttttttttttttgagatggagtttcactct

SEQ ID NO: 26369 - DNA, 201 bp, Homo sapiens
ctacccagatgctcctgtgcacatgaaccctggggatcttgttggatagaggatggggtctggggcaaggcccgtgaatctgcatttctaacaagctcccrggtaatgctgctggtgctgctctatggaccgctctgaggaacaaggtgagagcaagtgttgagactggagaaatgagatggtagaaagacagtatcccta

SEQ ID NO: 26370 - DNA, 201 bp, Homo sapiens
atagacttcattcagaaaacaaaatgataatttttctctcctgggacataaatggataagaattgcgtactccttcttttgcaatgtaaaggagttgatgmaattttaatttgtctttccagctaagaaatggtcctgatatctattctccacccttgggaccccctggaggaaatggtcatttttgtggcagtcatgctt

SEQ ID NO: 26371 - DNA, 201 bp, Homo sapiens
tataccaggaaccaagcatagacatctaagctgtggccctgctgtcaaaatcagggctgagctctagctgagcacacatgaatgtgtgcagtggttgactmttaacattgttcacattctggtgcactcattataggaatgtcagagctacttataactgaatagccctattatacacttaggagtgctaggcgttctgag

SEQ ID NO: 26372 - DNA, 201 bp, Homo sapiens
attatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaataa

SEQ ID NO: 26373 - DNA, 201 bp, Homo sapiens
taacaataaagtacccttctccctcctctcatccatttttctttatagaatttatcaccatctcacatatcatgtatttgtttattgtatgtcttccccakctataaagaaatctttatgaaagcaggtaatttgtcttgtttacttacctctgtatcccagatctcaatgaccaccacaaactgagtagccaatagcatg

SEQ ID NO: 26374 - DNA, 201 bp, Homo sapiens
tttcacatatgattaactgtcataaacctatagatacatagaatgttaaggttggaagaagaaagcttagagttcgtttgctgttgtcacctaattttttwaaaaaagacattgaggtggaggtggggcagtgcaaaaaataaaaattaattaaaaaataaaaaagatactgagatccagaaatgtcagggtcaaggctaa

SEQ ID NO: 26375 - DNA, 201 bp, Homo sapiens
tgtcctgttcctgttgcttagacagagttattagcaaagagaaaaatattcagttgccagtgatgctgtcagataatgttggggttcaggagatttttaayagagttcaagtgtactctttaaataccagtgaaaattatgctggaatgggaccagccatcctgttttttcaaaacttctataacaatttgggttgttaga

SEQ ID NO: 26376 - DNA, 201 bp, Homo sapiens
ggaggccgagatggtcagatcatgaggtcaagagattgagaccatcctggccaacatggtgaaaccctgtctctactaaaaatacaacaaatagctgggcstggtggcaggtgcctgtagtcccagctacttgggaggctgaggcaggagaattgcttgaacctgggaggtggaggttgcagtcagctgagatcgcaccac

SEQ ID NO: 26377 - DNA, 201 bp, Homo sapiens
cttcaccgtcctgagacccaggctctagagcttgctgggggaaaagtaaaagatggttgaattatgcagtgacttccaaagcttctatgtggaaattggtktatcacttttgctcacactctgttgggcaaagcaagtcctatggctaagcccatagtcaatgggaagattatgtattaattctccgtatggcagtattgc

SEQ ID NO: 26378 - DNA, 201 bp, Homo sapiens
acacattttttttttgtaggatgcctactatgagcaaagcactgtgctgggtgcattggtaggcaattagccagacctcaggttcatctgcgctccagggrtgttcttagaaatggagccacaaagataatgtaataatagtagctggttttgttttgttttgttgttgttgttttgagacagagtctctccctgtcaccc

SEQ ID NO: 26379 - DNA, 201 bp, Homo sapiens
ttacttttgctcagtaagagagttccataagcactcattaaagaatagattttaactgcaaaagataagaatgatattgacccagtgtagcatatctttctttttttttaacacaaggaacacacattaacatgttaattcttagatttatatatctctcttaagtgaagtttctacttttaaagatatacattacccatg

SEQ ID NO: 26380 - DNA, 201 bp, Homo sapiens
taagaactgtaacactcactgtgagggtccgtggcttcattcttgaaatcagcgagaccaagaacccaccagaaggaataaattccagacacactactgtsttagagtgatctagccctggaacatgtagtgcttgtgggtctcatagcagtagttctcaaccatgatgctagagctcattggtgtatttcaatcaactgg

SEQ ID NO: 26381 - DNA, 201 bp, Homo sapiens
acccatagcattcctatcaaacatccttaacccagcaagtttcctaacaggggatctaaatcttaattaccatacaaaggtcccaccagacataggaggarctcccttcaggacaggatatagatggttcctcccaggtgattaaggaaaaagacacaatgggtattcaggaaactcttatggaagcagagttaggaaaat

SEQ ID NO: 26382 - DNA, 201 bp, Homo sapiens
aaactcaactccctggtaaaatctttaagatttaaaagaagagaaccaaaataattgggaaagcaggagagcagaagctgaggcaggaaggtctgtcctcygtctgaaccttttctttcaccaccttcccctgcatccttccctctacttctccctccccgctacactcctgcttcagcctaagcagccctcccgcatctc

SEQ ID NO: 26383 - DNA, 201 bp, Homo sapiens
cagccttgatactaattaggaatacttttgtttgtttgtttttgggttttttttgttgttgtttttgttgtttgttggtttgttttttgagatggagtttyactcttgttgcccaggctggagtgcaatggcaatatctcagctcactgcaacctctgcctcctaggttcaagtgattctcctgcctcagcctcccaagta

SEQ ID NO: 26384 - DNA, 201 bp, Homo sapiens
agccttcagtgtaagctcacacgcttattactgctgcacatgtccacagcttaattgcctgagtttatggcctgagtttataaatacctaaatataatttwtaaggttattttatttcatggctattcttttgtgatgtcatatatataacaaaaaatatatatttattatatataaagatatatttattttatatatatt

SEQ ID NO: 26385 - DNA, 201 bp, Homo sapiens
aaaaagaataaatgtgtatacagatagcaagtatgcttatctaatcctacatgcccgtgctgcaatatggaaagaaagggagttcctaacctctgggggawcccctattaaataccacaaggaaatcatggagttattgcactcagtgccaaaacccaaggaggtggcagtcttacactgctgaagccatcaaaaagggga

SEQ ID NO: 26386 - DNA, 201 bp, Homo sapiens
ccatactgaagtaagcctcttcccccagggaccagcaactagttagcagaactagtggcacttactcgagccttagaactgggaaagggaaaaagaataartgtgtatacagatagcaagtatgcttatctaatcctacatgcccgtgctgcaatatggaaagaaagggagttcctaacctctgggggatcccctattaaa

SEQ ID NO: 26387 - DNA, 201 bp, Homo sapiens
tgatgtaaatggcatactaggtgccaaaggaagtttatggctatcagacaaccgcctacttagataccaggtgctactccttgagggaccagtgcttcagmtacgtacatgcacggccctcaaccctgccacttttctcccagaggatggggaaccaattgagcatgactgccaacaaattatagtccagatttatgcagc

SEQ ID NO: 26388 - DNA, 201 bp, Homo sapiens
tgcttttctaggttctcctgtaagaatgatttctaatataaactccaggactctgttaccttctttaggcacctgggttcaccaatcagaaagacataatytttgcccaaagccccattgtagggggtactatctggaattttaggatccctcctcagacaagcaggcctatcaatagctattcctgaagctaggatatgg

SEQ ID NO: 26389 - DNA, 201 bp, Homo sapiens
aagacttgcccatctatcctatctatcctgacccttgcctcctgggtcctaatgcctgtcagacaaatttcctctcgcctctcttctctgaggctagtccygcttctaaaaaccactccctgtctctgttgcttttctaggttctcctgtaagaatgatttctaatataaactccaggactctgttaccttctttaggcac

SEQ ID NO: 26390 - DNA, 201 bp, Homo sapiens
cagactaaagacacgggtgtcaggctttctgggaaacggctctctaacaacccccaactcttcggagttgggagcgttggttggcctggaaccagcttccrcttttcctgtacttctgggctgagctgagggttgacagagaggaaagccattcagctctggggtcccaacaacaagttggttggccctgcagccatgagt

SEQ ID NO: 26391 - DNA, 201 bp, Homo sapiens
gttctctgggcaagaagtccccaaccagatgatccaacaacaggactgagggtgcccagggcaagtgccagctcatgttatgacccttattgagccccggktacatttaaccattgagggccaggaaattgacttcctcctggacactggcatggccttctcagtgttaatctcttgtcctggatgactgtcctcaaggtt

SEQ ID NO: 26392 - DNA, 201 bp, Homo sapiens
gcaagtgccagctcatgttatgacccttattgagccccggttacatttaaccattgagggccaggaaattgacttcctcctggacactggcatggccttckcagtgttaatctcttgtcctggatgactgtcctcaaggttttaccatccaaggaatcctgggacatcctgtaaccaggtatttctcctacctcctcagtt

SEQ ID NO: 26393 - DNA, 201 bp, Homo sapiens
ttgatgcctaaatagtcagcacttgatattaaatgggttatatagcaaaattatggtgaaaatggagaacacaatgcattttttttacatcaaagatcaaytgcggaaattgcagctttccgaatcagtgggttacatacgatattcattgatttctctgagaaattgtttcaattggttgcttcttttcagtagagggct

SEQ ID NO: 26394 - DNA, 201 bp, Homo sapiens
gcaggcgactctagatctcttgaaatttctagctaatcaagggtacaaggcatctaggtcgaagacccagctttgcctacagcaggccaaatatctaggcytaatcttagccagagggaccagggccctcagcaaggaacgaaagcagcctacactggattatgctcaccctaagacattaaaacagttgtgggggttcct

SEQ ID NO: 26395 - DNA, 201 bp, Homo sapiens
acgcccgcctaattggagcttactgtggtacccagactgaatctttcagctccactggaaattctttgacatttcatttttactccgactcttcaatctcrgggaagggattccttctggagtggtttgcagtggatgcacctgatggtgttttacctaccattgctccaggtgtgtttggtaataaatgaagttcttttt

SEQ ID NO: 26396 - DNA, 201 bp, Homo sapiens
tggaatcatcggcttttgctgactgtggatccccagatacaaggagatagccaggcccctctatactctaatcaaggagacccagagggcaaatactcatytagtagaatgggaaccaggggcagaaacagccttcaaaaccttaaagcagaccctagtaaaagctccagctttaagctttcccacaggacaaaacttttc

SEQ ID NO: 26397 - DNA, 201 bp, Homo sapiens
tttatgttagagtattaaaaattttaatgatcatataaaaataaatataaatataaaaatcatggtgatcattgctatccagacattggctaccatatcarttccagaaacacaatcggatgcttacaggctatgaccccaccttattcatcttggattcttggtcatgaatagatcccagtgcctgatgggtgcccaata

SEQ ID NO: 26398 - DNA, 201 bp, Homo sapiens
gaaacgtaccccaaagtccaacatcttacataatatctctgcagtctcagttcatataaagccaatccttcattttggagacattcaagttaatgtcctgktcctgttgcttagacagagttattagcaaagagaaaaatattcagttgccagtgatgctgtcagataatgttggggttcaggagatttttaatagagttc

SEQ ID NO: 26399 - DNA, 201 bp, Homo sapiens
tacactgctgaagccatcaaaaaggggaaggagagaggagaacagcagcataagtggctggcagaggcagggaaagaccagcagaaaggaaagaaagagayagaaagtcagacagagagacagagagaggaagagagagacaaagagggagtcagagagaaagagaaagaaagagaaggagacagagagatagaaagtcag

SEQ ID NO: 26400 - DNA, 201 bp, Homo sapiens
aaagagcagctgaatgtgagagccaggcgaacagtagagaaaatcatgttttcagcacagagacaccaagaagcgccagattggttctatgaatgttgtaytttttagaataagaaattgaaacccatggcttggcacaagatttttctgatttataaattcattatgttaaaaattgcataaattgtatacaaactaagt

SEQ ID NO: 26401 - DNA, 201 bp, Homo sapiens
aaaaaaaatggagaaatataagttgtgtgaagagggcaggtggaaaaagagcagctgaatgtgagagccaggcgaacagtagagaaaatcatgttttcagsacagagacaccaagaagcgccagattggttctatgaatgttgtattttttagaataagaaattgaaacccatggcttggcacaagatttttctgatttat

SEQ ID NO: 26402 - DNA, 201 bp, Homo sapiens
agtaatgacaataatatactctgtccctgatttttttctcctcctagttccacaggctactcaaatatagactattttgaccctgtgtaccaaaataatgmaattgaaggaatgcaggataaataatatagattttaccacctaaatgtaatcttaaatttgtctgaagatattatgataaaaataaactatcttgccatg

SEQ ID NO: 26403 - DNA, 201 bp, Homo sapiens
gcaatgataatattgtgggaactcatgggaaagtcgcctctcctttctggcctgaaaactacccacataactccaattaccaatggacagtaaatgtgaaygcatctcacgttgtccatggtagaatcttggagatggacatagaagaaatacaaaactgctattatgacaaattaagggtgagtttccacatgcaatcaa

SEQ ID NO: 26404 - DNA, 201 bp, Homo sapiens
gctaggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggag

SEQ ID NO: 26405 - DNA, 201 bp, Homo sapiens
gttctacatggctgaaggcatcttcaacagccctggctacccagacatttatccccctaatgtggaatgtgtctggaacatcgtcagttcccctggcaacyggctccagctgtcttttatgtaaatccttttttatggtgtattgtttcagtgctaatgaatctgtaggaaagaagttctggtgctaataggatgggcaac

SEQ ID NO: 26406 - DNA, 201 bp, Homo sapiens
tacacaatgtatatgtgtattgaaacatcacactatccctcatacatgtgttcaattattatgcatcacttaaaaccaaaataaaaaataaatataaactrtatatattcataaaattgaatcttaaacttttataaaaatgaaaaaatgctattctaaacaaataaatgaataaattatcttgagagaagtaaatagtct

SEQ ID NO: 26407 - DNA, 201 bp, Homo sapiens
atagtgctgtggaccgtgacactgcactcaagttttgtctcctggagggcttcattatattcgctcagccagtcctcctaccctcatccctcaggaggaaygttgaatgattttcaaatgtgaatgctttgtgcctttggatagggcaaatgctctctggccaccacagtccccaccactccctattgtcttcctcctgac

SEQ ID NO: 26408 - DNA, 201 bp, Homo sapiens
aaaaaaaaaaaaaaaatagctgggcatggtggcatgagcctgtactcacagctacttgggaggctgaagtgggaggatggcttgagccagggaggttgagrctgcagtgagctatgatcatgccactgtgctccagcccaggcaacagagtgggaccttgccagaaaaaaaaaaaaaaaaaaagaaagagagagagagaga

SEQ ID NO: 26409 - DNA, 201 bp, Homo sapiens
cataaacagtcaattaacagatattttatatgttttatatattacatactgtattctttcaacaaagtaagctagagaaaataaaatgctatcaagaaaaytgtaaagaagagaaaatatatttactatttattaagtggaagttgatcatcataaaggtcttcatcctcatcatcttcacattgagtgggttggggagga

SEQ ID NO: 26410 - DNA, 201 bp, Homo sapiens
cgtgatccaccagcctcggcctcccaaagtggtgggattacaggtgtgagccacctcgctcaccctggtgttctttttggcttgtttgttaaggcagcccyaacctggggaggagaggaacgaggagctacccaggactgggtttcttagcctcttagcccagagagtgctgttggtcactgccatcttccttgtttttag

SEQ ID NO: 26411 - DNA, 201 bp, Homo sapiens
ggacttgtggaatgcatgaggcacttgcttccctcaagtggacctgctgctcagagtctcatggctgcaattcacagactacacacctaaatgtcagaaamagaataaggcctggagcaagcaaacacaccacataggctgaatagtattgtgtttttcagttaagtacatattgaaattaattgtaggtcagaaaaatat

SEQ ID NO: 26412 - DNA, 201 bp, Homo sapiens
agtaatgccccatgattgctgtgataataattaacacaaaaccaaaaaggtactctcacacatttcccaaatgctagattgtggtccctgctgagaaccaytggttaggtaacaatgaagtatcctgcgcttccccaaaaaccgcagtcatcatacttttcaaaaatgttcctgcctattgtaagttccttgtgagcagtg

SEQ ID NO: 26413 - DNA, 201 bp, Homo sapiens
acgaatgcaggaaccggggtgaacgaaccctagaactggctggtccctcctctctggtggaagcaggctctgtgcacggcccacggcagcgtccaagcttsttacaatgctcttttagctctgccatctcggagagggtgtctgcgaccccaagagccccaaagggcatgtgttgcaatcagtgctcttttagcatttgcc

SEQ ID NO: 26414 - DNA, 201 bp, Homo sapiens
agatgggacaatcaccaagcggtgagtaccactggacccctttcgcttgctattctgtcctatttttccttagaatttgggggctatataccgggcacctsttggccagttaaaagtgactagcatggccgccagactaaagacacgggtgtcaggctttctgggaaacggctctctaacaacccccaactcttcggagtt

SEQ ID NO: 26415 - DNA, 201 bp, Homo sapiens
ggcttatttgcttggctgcctagctgaattcaggagggagcacacgaatagacgaatgcaggaaccggggtgaacgaaccctagaactggctggtccctcmtctctggtggaagcaggctctgtgcacggcccacggcagcgtccaagcttcttacaatgctcttttagctctgccatctcggagagggtgtctgcgaccc

SEQ ID NO: 26416 - DNA, 201 bp, Homo sapiens
atagaacaggttgggagatgggagtggaggagaaggaatatggctatgaattggtcagatgacaaaaagagtttctgctactgagatgggaaagtttcctkgactcctttacaggacttgcgaagggggtggcttatttgcttggctgcctagctgaattcaggagggagcacacgaatagacgaatgcaggaaccggggt

SEQ ID NO: 26417 - DNA, 201 bp, Homo sapiens
ggacttgctaggttgacataaaaccaaaagttactagttgggtttccaaatttattgggcttaggaatcagatccatctctaataccctctctatgcaatyatcaatttttaattcttatgttgagttctgtgtactcaacccacctcagcagatttacctctaacttttgaaccaaggaacagcttttgctacttgtgta

SEQ ID NO: 26418 - DNA, 201 bp, Homo sapiens
caaataggtatattacacatatatacaaatgaaaaaagtatcaagagaaatttttggatttaatgaaatattaacagtgtttgtctttagtcgaatcaatrtttgtattttcctttttcatatatttctaaaatgtctgattattttacaggtagcatttattttaaaaattacctcttgaagggatggctaccccatttt

SEQ ID NO: 26419 - DNA, 201 bp, Homo sapiens
aaaaaaaaatccttcaatgtcaaagtaattaaaataacacaagttaagacaattacaaaaaggcagtttttcactgtcagtactagtttaaaacatgatcrtcatcataattgacaaagctccactgaaagaaacacctctgttaactgcttgtgggaggataggttggtataaactttctggtaagaaatttaataatat

SEQ ID NO: 26420 - DNA, 201 bp, Homo sapiens
gaatgcctggggatgtgatcatttccacaaaagaagcacagatgaaaagcaagggctttcaaaggcagactaatttatgcctgactgcagggattaggggyggctccatggaggtgctttgtaacatttggtggtaaagttctccacactcaaatcaatatgtttcaaacaatatttcatgtcataacattttttttcaat

SEQ ID NO: 26421 - DNA, 201 bp, Homo sapiens
tcttctcttattctcccctattcattataggggaggcttctgataaatgtgtagaatattagaaacttgataataaatatacacattcaaagcagcagtamgaaaaacagaaaaaaaggaagctacagcagtaagcctgaaaaataaaactcatctttattcatttgcttaaaatgcttaggtttagtgctttggggtgaa

SEQ ID NO: 26422 - DNA, 201 bp, Homo sapiens
tctgttccgtttcgtttccctcttcattttctgttgctttattcttctcttattctcccctattcattataggggaggcttctgataaatgtgtagaataytagaaacttgataataaatatacacattcaaagcagcagtacgaaaaacagaaaaaaaggaagctacagcagtaagcctgaaaaataaaactcatcttta

SEQ ID NO: 26423 - DNA, 201 bp, Homo sapiens
gaaaaactctaaagctgagatgaatctcctgcagggaagcagggatttagaagcacaggctgcaaggttggcctctcgccctccggtttctccgcctgcakgagagggtgggactgaacgctaaggtgaaaagcttctgttccgtttcgtttccctcttcattttctgttgctttattcttctcttattctcccctattca

SEQ ID NO: 26424 - DNA, 201 bp, Homo sapiens
tctttaagtcacgtgaaaatgccacatttcttaatcttgcagagctgacaggcaaaaatgctatgctgttcatgaccttgtgcaggattgaaatataattycgcaacatgctgcgacctagtattccgtaagacacatcgagcttagggtgattatagttatggagaaatcttacctatgttttgttggataagggttatg

SEQ ID NO: 26425 - DNA, 201 bp, Homo sapiens
ctaggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggaga

SEQ ID NO: 26426 - DNA, 201 bp, Homo sapiens
gagagcagtgctgtgatctcggctcaatgcgacttccacctcctgggttcaagcaattctcctgcctcagtctcctgaatagttgagattacaggcgcatrccaccacgcccagctaatttttgcatttttagtagagacagggtttcaccatgttgggacaggctggtctcgaactcatgacctcaggtgatctgcccac

SEQ ID NO: 26427 - DNA, 201 bp, Homo sapiens
gtttccagcttcatccatgtccctaaaaaggatatgaactcatcattttttatggctgcatagtattccatggtgtatatgtgccacattttcttaatccrgtctatcattgttggacatttgggttggttccaagtctttgctcttgtgaatagtgcgggaataaacatacatgtgcatgtgtctttatagcagcatgat

SEQ ID NO: 26428 - DNA, 201 bp, Homo sapiens
aaaaaaaaaaaaaaaaaaagggattgcttttccctctaaaaggaatcctgccaccaacttttaaataatgcaacatgcttttaaataatgcttatttatargacaaaggtgtgtatgagaattaaaaagttccctttgcttggcttctttattttcccacattaccgttctttagaactatgatcacaggcctccagaact

SEQ ID NO: 26429 - DNA, 201 bp, Homo sapiens
catagtattccatggtgtatatgtgccacattttcttaatccggtctatcattgttggacatttgggttggttccaagtctttgctcttgtgaatagtgcsggaataaacatacatgtgcatgtgtctttatagcagcatgatttatattcctttgggtatatacccagtaatgggatggctgggtcaaatggtatttgta

SEQ ID NO: 26430 - DNA, 201 bp, Homo sapiens
agcttctgagcttttccccagagttacggaaatgagtggcataaggagaaaatgggcagtaaccaatgggttaaccaaaatcagtggagagttggtttttwaaaaaaaatggagaaatataagttgtgtgaagagggcaggtggaaaaagagcagctgaatgtgagagccaggcgaacagtagagaaaatcatgttttcag

SEQ ID NO: 26431 - DNA, 201 bp, Homo sapiens
tttttacctccatgttctcatttaaacattaaatcgttccatgaggtaagaggggaattttattcccattttacagtggtcaaaactaacgctcaaaaagrttaatgggcttttccatgaccacatggaaggggagtggaagagctaataactgaagccagtcactgctcaacactccagtaaatcctgagaccatagatg

SEQ ID NO: 26432 - DNA, 201 bp, Homo sapiens
acacagaggcatgaataccaggacgtggggctcactgagagctgggtcagaagttgcctaccaccccccacccctacaatctccagttggaaaattttcayttcttatctctcccactcctacctacccatatttctggacaacccccaccccaccccttggttctcttttcttttttgcctccatagctttctaattccc

SEQ ID NO: 26433 - DNA, 201 bp, Homo sapiens
ttaccccagtccttataggagcaacacagactgttcttgggtcattcgggttgacagaaatcatcgtgttctcttgaacttcactgactttgatcttgaaycacaagactcttgtattatggtaagtgacataaatttcaagcattgtctccagtcaaacctcggtcaaaacactgccatataagcatatttagtgaatat

SEQ ID NO: 26434 - DNA, 201 bp, Homo sapiens
acaagacagaaagtgctagcaagagggcaggaaccatcttttctcacctcattatggaggtgacagactatcacttccattgtattctgttaattagaacmaatcacgaggtctatcccatacgccagggaggagattacacagaggcatgaataccaggacgtggggctcactgagagctgggtcagaagttgcctacca

SEQ ID NO: 26435 - DNA, 201 bp, Homo sapiens
atcacaagactcttgtattatggtaagtgacataaatttcaagcattgtctccagtcaaacctcggtcaaaacactgccatataagcatatttagtgaatrtattacttatgggtgtttttaatgtcgaatcataggaaaccaaactattggcaacttaaaatataaggacatttattttttacctaaaaacaaatcagga

SEQ ID NO: 26436 - DNA, 201 bp, Homo sapiens
tcatgtgaatgtacacagggttcagttccttgcaggctgttggctgaggcctcccttgactccctgccacacaggcctcgccacggagtatctcagaacayggcaccttgctcaccagggcaagcaatagagaggacaagagagagtccaacaagacagaaagtgctagcaagagggcaggaaccatcttttctcacctca

SEQ ID NO: 26437 - DNA, 201 bp, Homo sapiens
aaaacaaatcaggaagtagataatctctaggttttttagcaagtcagtttctgcgctaccattattagcctgttggcttttcattttgttgttacttcatkgtcaaaaaatggctgcagtggtttttatctgaatgtcctacctgagtctacctctgaaaaaaggaagaagcaatagtgttaactatttctgttttgtttg

SEQ ID NO: 26438 - DNA, 201 bp, Homo sapiens
ttttgtttgtgtttcttttaataaggaaagcaaattttccaaaaaagcccctgatatatcattagccagaactgactacaaaagagatccagaaagtatcrtggaatagatttatcataaatgttttagatcaattattattattaagcatctgggattttcacaggattctgcttctcttgagacaaggatatcttgatt

SEQ ID NO: 26439 - DNA, 201 bp, Homo sapiens
cctgcgtgcttcctggctcactcatgtgaatgtacacagggttcagttccttgcaggctgttggctgaggcctcccttgactccctgccacacaggcctckccacggagtatctcagaacatggcaccttgctcaccagggcaagcaatagagaggacaagagagagtccaacaagacagaaagtgctagcaagagggcag

SEQ ID NO: 26440 - DNA, 201 bp, Homo sapiens
tggtcagatgacaaaaagagtttctgctactgagatgggaaagtttcctggactcctttacaggacttgcgaagggggtggcttatttgcttggctgcctmgctgaattcaggagggagcacacgaatagacgaatgcaggaaccggggtgaacgaaccctagaactggctggtccctcctctctggtggaagcaggctct

SEQ ID NO: 26441 - DNA, 201 bp, Homo sapiens
tcttcattccacacccgcagacttaccccagaacttaccagcttaagacaacaacatttacagtttccgtgggtcaggaagccaggtgccactcacctgcrtgcttcctggctcactcatgtgaatgtacacagggttcagttccttgcaggctgttggctgaggcctcccttgactccctgccacacaggcctcgccacg

SEQ ID NO: 26442 - DNA, 201 bp, Homo sapiens
tattttgcatattttaagactttatgtacatcatgtcacacgctacatatccttcttcaacttgctctattcactcattattctgtttttcacattttctrcattgtaatgcatacagatctaatgcattcttttagtcactacacattctattttatatatgcaccacaagtcatttgcccattctcctgttaatgaaca

SEQ ID NO: 26443 - DNA, 201 bp, Homo sapiens
atgttctgatagaacaggttgggagatgggagtggaggagaaggaatatggctatgaattggtcagatgacaaaaagagtttctgctactgagatgggaargtttcctggactcctttacaggacttgcgaagggggtggcttatttgcttggctgcctagctgaattcaggagggagcacacgaatagacgaatgcagga

SEQ ID NO: 26444 - DNA, 201 bp, Homo sapiens
catgttctgatagaacaggttgggagatgggagtggaggagaaggaatatggctatgaattggtcagatgacaaaaagagtttctgctactgagatgggaragtttcctggactcctttacaggacttgcgaagggggtggcttatttgcttggctgcctagctgaattcaggagggagcacacgaatagacgaatgcagg

SEQ ID NO: 26445 - DNA, 201 bp, Homo sapiens
taatggattattttcgagcatccatgattcctctcatgaaataattgtgttccccacttccaggttgtggtgggattttccaggctcccagtggagagatwcattctccaaattaccccagtccttataggagcaacacagactgttcttgggtcattcgggttgacagaaatcatcgtgttctcttgaacttcactgact

SEQ ID NO: 26446 - DNA, 201 bp, Homo sapiens
accactgaacagctgagatccaggggtctccttcaatgcgtaatcccatccagaaggaaggaaaaaaaagaaatctctttaagtcacgtgaaaatgccacrtttcttaatcttgcagagctgacaggcaaaaatgctatgctgttcatgaccttgtgcaggattgaaatataattccgcaacatgctgcgacctagtattc

SEQ ID NO: 26447 - DNA, 201 bp, Homo sapiens
taaagtaacctgaacttggataaagttccaagtttttccaggagatgtgagtgcaaacctcagcaacaacatttttaacaatcaccctaatgaggcctctscacagatcctgctgtggtggttgtttggggtggggaacatctgagcagatgccctgagaattccctaggtcccatccttctggatctccagtgattcagc

SEQ ID NO: 26448 - DNA, 201 bp, Homo sapiens
tatgataaaaggaagcattataggcaaaatatgattttaaattaatgctggagcagattaccttacatggtaacatttcagtggattaatttttacatatmaccttgagatacttaagaaaagattatggagatagacaatttaatatttttagtaggccaggtgtttatttgacagtctaaaagggtatgaaattctgag

SEQ ID NO: 26449 - DNA, 201 bp, Homo sapiens
ataattaatgattcatttctcaagacatttaattttcctcttgttttctgcctgcagcctgcatggttaatgcattttgacacttctcactaaggataaaygacaaatgataaaaccaacaatttttgtccacttattttactcaaagctccgttaagaaaaataatgaaaaaaattttaatttcagtgactaacaggagt

SEQ ID NO: 26450 - DNA, 201 bp, Homo sapiens
catctcagtaaggtatagagaaattcacaaatagagagccttcaattctttaggttgagatataattaatgattcatttctcaagacatttaattttcctyttgttttctgcctgcagcctgcatggttaatgcattttgacacttctcactaaggataaatgacaaatgataaaaccaacaatttttgtccacttatttt

SEQ ID NO: 26451 - DNA, 201 bp, Homo sapiens
caccttgaccactatcatcttccattaaatcatttccttattccttccccttttccactaaagtccatttcaagtcctcgtgatagtgtgggggacttcartcaaaggcatttccctccagtctttataacatgcatttcatctcttgccaaatccttgctgatgtcatcctgttcaccccagatgcttatatcacagttt

SEQ ID NO: 26452 - DNA, 201 bp, Homo sapiens
caccctccaccctcaggtaggccccagtgcctgctgtttccctgtcctgtgtccatgtgttctcagcacttagctcccacatataagtgagaacatgcagyacttggttttctgtttcctgcattagtttgctgaggaaaatggcctccagctccattcacattcttgcaaaggacctgatcttgctcttttttatggctg

SEQ ID NO: 26453 - DNA, 201 bp, Homo sapiens
ttggctgcctagctgaattcaggagggagcacacgaatagacgaatgcaggaaccggggtgaacgaaccctagaactggctggtccctcctctctggtggragcaggctctgtgcacggcccacggcagcgtccaagcttcttacaatgctcttttagctctgccatctcggagagggtgtctgcgaccccaagagcccca

SEQ ID NO: 26454 - DNA, 201 bp, Homo sapiens
ctggtggaagcaggctctgtgcacggcccacggcagcgtccaagcttcttacaatgctcttttagctctgccatctcggagagggtgtctgcgaccccaaragccccaaagggcatgtgttgcaatcagtgctcttttagcatttgccgtccatggacagctaagtgttaaccagctcagtggagggtcagggtgacagcc

SEQ ID NO: 26455 - DNA, 201 bp, Homo sapiens
gctggatagattgcaaaaattttctcctattctgtagattgcctgttcactctggtgatagtttcttttgctatgaagaagctctttagtttaattagatsccatttgttaattttggcttttgttaccattgctcttggtgtttaagtcatgaagtctttgcccatgcctatgtcctgaatggtattgcctgggttttct

SEQ ID NO: 26456 - DNA, 201 bp, Homo sapiens
atacttttatggccaattgatatatgaaaatgatgccaaaacatatcaatggagaaaaatcattttttcaacaaatggtgctcaatagccacatgcaaaaytatggtgctggaccccttccttatagcatacacaaaaattaactaaaaatggattatagacctaaatgtcagagctaaaaccatgaaactcttaggagaa

SEQ ID NO: 26457 - DNA, 201 bp, Homo sapiens
ccagactggccaaatcttcatattttgccacatttgcttcaagttcttttgttttctcccaaacagaaatgaactgttcaagacacaggtgaagtcccacrtgctcctatcattgatcccatgccctgttccccgtcccagaggaaactgctaatgagatttctggtttgtgattcccatgaaggtttttatagttttttc

SEQ ID NO: 26458 - DNA, 201 bp, Homo sapiens
cactctggtgatagtttcttttgctatgaagaagctctttagtttaattagatgccatttgttaattttggcttttgttaccattgctcttggtgtttaartcatgaagtctttgcccatgcctatgtcctgaatggtattgcctgggttttcttctagggtttttatgattttaggttttacatttaagtctttaatcca

SEQ ID NO: 26459 - DNA, 201 bp, Homo sapiens
gactgacatttcagtcaggtggtcacgagccatttaatcaccccagggttttgattacagcagagaggggcagccgctgaagtgctctgcatcacgtccaygtcaatcacgtggtctttagtgcttaggcaaagcatgcgtgattactggtctttatttcgtgcaatttaaaaatgtatgctcagctttactttagtatgt

SEQ ID NO: 26460 - DNA, 201 bp, Homo sapiens
ttccaacaatctcagggaatatattcctgtttttttttttttttttttagaaataaaaatacagatattactgaggaagctacaattcatttccccctcaktcatgaggggtgcaaacgatgactgacatttcagtcaggtggtcacgagccatttaatcaccccagggttttgattacagcagagaggggcagccgctga

SEQ ID NO: 26461 - DNA, 201 bp, Homo sapiens
ttttcttctagggtttttatgattttaggttttacatttaagtctttaatccatcttgagttaatttttgtataaggtgtaaggaaggggtccaatttcasttttctgcatatggctagccagttttcccaacaccatttattaaatagggaatcctttcctcattgcttgtttttgtcaggtttgttaaagatcagatgg

SEQ ID NO: 26462 - DNA, 201 bp, Homo sapiens
gttactgtaggcttgtagtatagtttgaagtcaggtaacgttatgtctccagctttgttctttttgcttaggattgtcttggctgtacaggctcttttttkgttccacatgaaatttagagttttttttctaattccgtgaagaaagtcaatggtagcttgatgggtatagcattgaatctataaattactttggacatta

SEQ ID NO: 26463 - DNA, 201 bp, Homo sapiens
aaatgtatttaaagtacctatcagtgtctggttcagataagtatttgctgctattcctaatttttctattacaatgactcctgcttctattactattaackctatgttaaagatcttaaggaatcttttaaaaaaattttctccctgagcaagatgaaacttagtaaacaagataaaaaatccagtagaaaaaaattcctc

SEQ ID NO: 26464 - DNA, 201 bp, Homo sapiens
gcttaggattgtcttggctgtacaggctcttttttggttccacatgaaatttagagttttttttctaattccgtgaagaaagtcaatggtagcttgatggrtatagcattgaatctataaattactttggacattatggccattttcatgatattaattcttcctatccatgagcgtggaatgtttttccatttgtttgtg

SEQ ID NO: 26465 - DNA, 201 bp, Homo sapiens
ccattctgctaagtgagccatgctgggaatcccatgcacgttcactggaatggaatgcaggacagatgccaaccacttggaaagccacaggagcccagtayaagactttctcaaatgctactgaggatgcttgattgcaggttcagatgcaaaggatgggggactcccaccctatttccagagctgctgtggttttctttc

SEQ ID NO: 26466 - DNA, 201 bp, Homo sapiens
ccgtgaagaaagtcaatggtagcttgatgggtatagcattgaatctataaattactttggacattatggccattttcatgatattaattcttcctatccaygagcgtggaatgtttttccatttgtttgtgtcctctcttatttccttgagcagtggtttataattctccttgaagagatccttcacatcccttgtaagtt

SEQ ID NO: 26467 - DNA, 201 bp, Homo sapiens
tacccattctgctaagtgagccatgctgggaatcccatgcacgttcactggaatggaatgcaggacagatgccaaccacttggaaagccacaggagcccartacaagactttctcaaatgctactgaggatgcttgattgcaggttcagatgcaaaggatgggggactcccaccctatttccagagctgctgtggttttct

SEQ ID NO: 26468 - DNA, 201 bp, Homo sapiens
tgtgcatatatatagacacatatataatatatatgtatgtgtgtgcatacatatatatgaaatgtaatcaacagtttgcccctattttaactttttaaaarcagagaattaggttgggtacggtggctcacgcctgtaatcccagcactttaggaggccgaggcaggtggatcatgtgaggtcgggagtttgagatcagcc

SEQ ID NO: 26469 - DNA, 201 bp, Homo sapiens
attcaacttggacctgtgtacctcccccaccatggagatccaaatatttatatgaagtgtaaagcagaaagaatgaggagagtgggatctggaggaaagawggaataatcccgttaggttggagtcacagtgcaactaactcttaactcactccagcttgaatggaccattattgatcagagtcaacgtttgccatttgcc

SEQ ID NO: 26470 - DNA, 201 bp, Homo sapiens
aaattagccaggcgtagtgggacattcctgtagtcccagctactgaggaggctgaggcatgagaatcgcttcaacccaagaggtggaggttgcagtgagcygagatcataccactgcactccagcctgggtgacagaccgaggctccatctcaaaaacaaacaaacaaacaaaacaacgataccaaccaaaacccagacaa

SEQ ID NO: 26471 - DNA, 201 bp, Homo sapiens
ctcatcttaccagtgtggacactgaagcttagaaaggttagtggcttgcccaaagttccacagctagaaaacgtcaaagcacatatgtgattccagactaygttatggccacacttcttcaactctatcataaccaaggtatctatataagagctctcccctaaagttaattatgtaggaatttaaataaacacacacaca

SEQ ID NO: 26472 - DNA, 201 bp, Homo sapiens
aaaccctgtctctactaaaaataaaacaaataaaaaaaaattagccaggtgtagtggcacattcctgtaatcccagctactcgggaggctgaggcaggagaattgcttgaatccaggaggcggagtttgtagtgagcagagacagtgccactgtactccagcctggccaacagagtaagactccatctcacaaaaaaaaaa

SEQ ID NO: 26473 - DNA, 201 bp, Homo sapiens
gatggctaacacctcacacttgcagtctgagaaagctcccccagaaagagcattcgtgtggcggagcatagagactgggcactgccaacaagcacagggayggcctaccagggctgccgctgctcttcaaggggccgccagggccatctgccgcagagcgcttttgtaaaaaaatggccacctaggtagcatgaggcattt

SEQ ID NO: 26474 - DNA, 201 bp, Homo sapiens
ataaaatggtatgtctgaatagataaaattttcccttgaaatcctattaactttttccagcaaactattacagagggcattgtacaagggtcaaaaaacatttttttttcctttgaggagggaggactatttgcgacctggtaacctcacactaaaataaactccaaaataaatttcccagtgggtatgctatgtgaattt

SEQ ID NO: 26475 - DNA, 201 bp, Homo sapiens
taattataactttattgtaacttaacggttttctcctaaattaagcattgtatatttttgatggcctttcggtgagttgaatttggaattattttccacgkgctgttgcccactttgaactgactgaacctttctgttttaacaggttgtggtggagagctgtctggggccacaggctccttcagcagccccgggttcccc

SEQ ID NO: 26476 - DNA, 201 bp, Homo sapiens
aaggcaaagatacattgtgagttttagaaaagtctagttttgtgatttttgtaatggtccacagaaggcatttgtatgttttttcatttctttctttacattttttttttttgaggttggtcagagagaaaaatatgtgagttttgccaacagttgtctttgatcctcagagatgtgcttttccattgctagttcagttga

SEQ ID NO: 26477 - DNA, 201 bp, Homo sapiens
aaataattcagggcaccaggtccctcgtggtgtttgatgtttagttgtgagagaggtttgtgcatgcgagcagtgcagtctctctggattttatcctcggrtcaagtccagctgcacaggggctggggctggcttccagcatcacagtgtcccagactctagagcttcacttccagccaaatactattagctgttaggacc

SEQ ID NO: 26478 - DNA, 201 bp, Homo sapiens
aactccacaccgatgctctcagccataacaccacataccccgggagcactctcacagtgtcctgtcaccctcacagggatcatggggaagtgttcctgctkcccccaagtctaccattctattgacactgccgcaaagagaaatcaatgttttgcatgactccatagataagcaggtgccatttattataatcacctcttt

SEQ ID NO: 26479 - DNA, 201 bp, Homo sapiens
tttctttcgactcatttgaggatgaaatggcaacaaaaaggtgtttaaaaactcaaattaaaaaatgcttgttccagcaactgcagagtagctcattagasccccttatggatgacgtgtctgtcatgttatggtcatgccatttctcttgtgcaacattgacggtgaaagagcaaaaatacaaaatgagaaccagaagtt

SEQ ID NO: 26480 - DNA, 201 bp, Homo sapiens
tcctacaaattggagcacaaaccaaaataggactcatgatcttgccgagcgttgcacgtataacagtgtgctgggcaccataatcgtgatttggtaaagcrtaatggagaaagctacagaaaggaggatgcttttgaattgggctttaaaggaggctttggcagaaagagggggggaggaaagagatgaaacatttccagg

SEQ ID NO: 26481 - DNA, 201 bp, Homo sapiens
atgtaagttcatttcagtatatttttatttttgtaaaattgaagtttcaattgttataatcatgaccactagtaacatttattcaactgtctgtatgcaayttcaggcaataaatcttgcttaaatattaggcaaccttgaatataaggtaatatgttatttttgcaataagaaattttaacttaaaaagctttttgataa

SEQ ID NO: 26482 - DNA, 201 bp, Homo sapiens
caggcacctcccttatctaataaatggctaatataatttgtcttcagtaggatgactaacagctggatacccagtgcttaaaaatcaattgaaacaatacrgctttaaagagctgagaattattaaaccaatgctatgaatcagtgctatttcacatctcttgctatggactgatttcccaatagaaatgtttttaatgac

SEQ ID NO: 26483 - DNA, 201 bp, Homo sapiens
atggtatttgaacaggtatatttcatatttaatgtattaaattgtgaatacagagaactatctatgtttttaggtttcagtgtaacttctggactcattgrcctcatattacttaacttacatggaaggagagtaataacctctattttttgttggttgtttttatgtttgttctctgtgtataagagatcagaaaatgtt

SEQ ID NO: 26484 - DNA, 201 bp, Homo sapiens
tgaatcagtgctatttcacatctcttgctatggactgatttcccaatagaaatgtttttaatgacttgatgttttattgctgtgggtgaggaatatccttsagaagagatgtgtttggaatgagtaatttggtatcattccatgtgaagaaaatgttgaatagtcaagtaagattaatacacatccaactacatccttgtt

SEQ ID NO: 26485 - DNA, 201 bp, Homo sapiens
gaagaaaatgttgaatagtcaagtaagattaatacacatccaactacatccttgtttgagatagttgtctgttgagagaaagggcatattgggtattgcasattgcgtagcaatagtcctggcccctacccactagatactacccatcacaccgagtgtgacaatagaaaaatgactacaaaccttgccagaggtcccaaa

SEQ ID NO: 26486 - DNA, 201 bp, Homo sapiens
aagggtgaagattaaacatattctctcagtttgtgattggttatataaaacaccataccagctatgaatgatggttattctttgttaagtcattcaaataygatttttaaaaatttaaaagtgaaaatcgtgttttttagagtaagtgtagtgtttgagagaaattacttcatccaataaactgctaatgtttgcaatccc

SEQ ID NO: 26487 - DNA, 201 bp, Homo sapiens
ctctgtgtgtgggtcaatgagtctgtctgttctgtcaactcagggatactgggtcattgctttcatttgatgtcctttttttagcttagtaagtttcattrctgggtctgaaatattaatagaccaatgctatactcctccccgctctctttatccctcttttctgcctttcctgttgtctcccttctgtctgtcttattc

SEQ ID NO: 26488 - DNA, 201 bp, Homo sapiens
ctgcactctgactcccagtttctctttgcctttgaggataccacagaccacacgtcccaacttacatggatagttgtgccccaagggtttagggatagccytcatctgtttgctcaggcactggcccaagatctaggtaacttctcaagtccaggcactctggtccttcaatatgtggatgatttacttttggctacctgt

SEQ ID NO: 26489 - DNA, 201 bp, Homo sapiens
attggtttgctgttctggacctcaaggatgccttcttctgtattctcctgcactctgactcccagtttctctttgcctttgaggataccacagaccacacrtcccaacttacatggatagttgtgccccaagggtttagggatagccttcatctgtttgctcaggcactggcccaagatctaggtaacttctcaagtccag

SEQ ID NO: 26490 - DNA, 201 bp, Homo sapiens
gggaggctgaggcaggagaatcgcttgaacctgggaggtgaaggttgtggtgagccaagattgtgcccagcctgaggaacaagagcaaaaaaatccatctaaaaaaaaaaaaaaaaaagaaagaaaaaaagacatatggccagatggaaagagctgattgatgcatgatatcattgcttggtgatacggctttagaaaagc

SEQ ID NO: 26491 - DNA, 201 bp, Homo sapiens
tgacttcgatgtggagtatcattcaaggtgcaactttgatgtcttggaggtaggaagtgagatggttttttcagcacattccaaagtttggggtagaacargaaatcactctgccaagattccgaattctttccagtagtcagcagtgttctattcttagacattttaatgagcatcagcccttcggtgatcatttggtag

SEQ ID NO: 26492 - DNA, 201 bp, Homo sapiens
acaggttcgtctgaaacctagtagaatgtttttacatgaatacactgctttggagcaattgtgtatctgcagctttataaattacagtaaggctgattccaaaaaaggataatgcatttctagccctgcatccctgggtggtagaaaggaagctgtctaggtgtgctcgaatttccctaaggcaccagctttaaatgtctt

SEQ ID NO: 26493 - DNA, 201 bp, Homo sapiens
gggaggcaaagatagagggagggagggaaagatagagggagggagggaaagatggagggagggatggaaagatggagggagggaaagatagagtgaggaakggaaagatggagggagggagggaaagatagagggagggatggaaagatggagggagggaaagatagagtgaggaagggaaagatagagggagggagggag

SEQ ID NO: 26494 - DNA, 201 bp, Homo sapiens
gagaaacagtgaactggaagataagtcaagaatctactcagaaaaaagtatggataaaaaaaggatgaaaaatatataagagaggttaagacacatagaasacactcagaaaatatataacacacagttaattggagtctcacaaggaaaagagagatatatggaacagaagcaaactttgaagagctactgactaaaatt

SEQ ID NO: 26495 - DNA, 201 bp, Homo sapiens
tgatggagggagggaaagatggagggagggaaagatagagggagggagggaaagatagagtgagggaggcaaagatagagggagggagggaaagatagagkgagggagggaaagattgagggagggaaagatggagggagggaaagatagagggagggagggaaagatagagtcagggagggaaagatggagggagggaaa

SEQ ID NO: 26496 - DNA, 201 bp, Homo sapiens
gtaccccaaagtccaacatcttacataatatctctgcagtctcagttcatataaagccaatccttcattttggagacattcaagttaatgtcctgttcctrttgcttagacagagttattagcaaagagaaaaatattcagttgccagtgatgctgtcagataatgttggggttcaggagatttttaatagagttcaagtg

SEQ ID NO: 26497 - DNA, 201 bp, Homo sapiens
agatggagggagggaaagatagagggagggagggaaagatagagtgagggaggcaaagatagagggagggagggaaagatagagggagggagggaaagatkgagggagggaaagatggagggagggaaagatagagggagggagggaaagatagagtcagggagggaaagatggagggagggaaagatagagggagagagg

SEQ ID NO: 26498 - DNA, 201 bp, Homo sapiens
ggaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccc

SEQ ID NO: 26499 - DNA, 201 bp, Homo sapiens
aagaggtggaggttgcagtgagccgagatcataccactgcactccagcctgggtgacagaccgaggctccatctcaaaaacaaacaaacaaacaaaacaaygataccaaccaaaacccagacaattggactatgagtgaaattcataaagtggccatcattgcataatcaagtgttccctctaaagaagttttctctggct

SEQ ID NO: 26500 - DNA, 201 bp, Homo sapiens
agatagagtgagggaggcaaagatagagggagggagggaaagatagagggagggagggaaagattgagggagggaaagatggagggagggaaagatagagkgagggagggaaagatagagtcagggagggaaagatggagggagggaaagatagagggagagagggaaagagagtgagggagggaaagacagagtgaggga

SEQ ID NO: 26501 - DNA, 201 bp, Homo sapiens
gaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccct

SEQ ID NO: 26502 - DNA, 201 bp, Homo sapiens
gatagagggagggagggaaagatagagggagggagggaaagattgagggagggaaagatggagggagggaaagatagagggagggagggaaagatagagtsagggagggaaagatggagggagggaaagatagagggagagagggaaagagagtgagggagggaaagacagagtgagggagggaaatatagagggagggag

SEQ ID NO: 26503 - DNA, 201 bp, Homo sapiens
gctctttgttacccattctgctaagtgagccatgctgggaatcccatgcacgttcactggaatggaatgcaggacagatgccaaccacttggaaagccacrggagcccagtacaagactttctcaaatgctactgaggatgcttgattgcaggttcagatgcaaaggatgggggactcccaccctatttccagagctgctg

SEQ ID NO: 26504 - DNA, 201 bp, Homo sapiens
aaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctc

SEQ ID NO: 26505 - DNA, 201 bp, Homo sapiens
atcatttggtagacatgggattaatgtgtggtttgggttttcctgaagcaatgcctgagggccttgcagcagctgagttaggaggtaatgccaggaagccrgagcccaggacgagtgagtgaaggaaaggaggagggggaaccagcagagggagcccctgggggcaacttgggctccatccgctgggaccttctgaaggac

SEQ ID NO: 26506 - DNA, 201 bp, Homo sapiens
gaggctgaggcgggcggatcacgaggtcaggagatcgagaccatcctggctaacacggtgaaaccccgtctctactaaaaatacaaaaaattagctgggcrtggtggcgggcgcctgtagtcccagctacttaggaggctgaggcaggagaatggcatggacccgggaggcagagcctgcagtgagcggagatcgcgccac

SEQ ID NO: 26507 - DNA, 201 bp, Homo sapiens
aagtatggaaccagcagagagaggtcctcatcctaacattgcccagtttttcctcaaccccatccgtgccccttttctttttctttttctttttcttttcttttttttttttttgagacagagtttctatcttgtcacccaggctcgagtgcaatggtgtgatattggcttactgcaacctctgcctcccgaattcaagtg

SEQ ID NO: 26508 - DNA, 201 bp, Homo sapiens
atgtttcctctattttggagaagttcgtattccaaagtgggaattccattagcagctataccgccatattataacatgtgaaaatacctcatggactctcratcctcaaaatcactttgcacctccatgtgaattatctctcctgtgccctaaatgtcttattcttcaccacatttttgcaccctgctaagatcaaaggca

SEQ ID NO: 26509 - DNA, 201 bp, Homo sapiens
aacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctct

SEQ ID NO: 26510 - DNA, 201 bp, Homo sapiens
ggcggatcacgaggtcaggagatcgagaccatcctggctaacacggtgaaaccccgtctctactaaaaatacaaaaaattagctgggcgtggtggcgggcrcctgtagtcccagctacttaggaggctgaggcaggagaatggcatggacccgggaggcagagcctgcagtgagcggagatcgcgccactgcactccagcc

SEQ ID NO: 26511 - DNA, 201 bp, Homo sapiens
agtatggaaccagcagagagaggtcctcatcctaacattgcccagtttttcctcaaccccatccgtgccccttttctttttctttttctttttcttttcttttttttttttttgagacagagtttctatcttgtcacccaggctcgagtgcaatggtgtgatattggcttactgcaacctctgcctcccgaattcaagtga

SEQ ID NO: 26512 - DNA, 201 bp, Homo sapiens
cccaattcctgatgtgcttaagaacaagcatttcctaatctgatagggaagtcatttctacagttgcttctaaatttaaaaacaatttcttttttttcatktcaaggcctagcaaaggttaaaaaacacacacacgcacaacaacacaacacacctacaaccttgctgtattaacaggcgtatgcaggcgtatgagattgg

SEQ ID NO: 26513 - DNA, 201 bp, Homo sapiens
aacagcttgtataatttcctgagggatttccctccctatcacttaatgtttcctctattttggagaagttcgtattccaaagtgggaattccattagcagstataccgccatattataacatgtgaaaatacctcatggactctcaatcctcaaaatcactttgcacctccatgtgaattatctctcctgtgccctaaatg

SEQ ID NO: 26514 - DNA, 201 bp, Homo sapiens
acggtgaaaccccgtctctactaaaaatacaaaaaattagctgggcgtggtggcgggcgcctgtagtcccagctacttaggaggctgaggcaggagaatgkcatggacccgggaggcagagcctgcagtgagcggagatcgcgccactgcactccagcctgggcgacagagcaagactccgtctcaaaaaaaagaaaaaaa

SEQ ID NO: 26515 - DNA, 201 bp, Homo sapiens
aaggggtcttatgtcttgaagatctggaaagggctttacatgtccttgtatgcctgggatctagcacagaggcctggcatacaggtcccagaataaaaatscttgctaatataaatgtgatcataaagacagcaatgattatcatgaaattttaacttgtttaccagaaaaagtgcatgacctaaaacttggcaaatgtgc

SEQ ID NO: 26516 - DNA, 201 bp, Homo sapiens
ctgccatgttgtcattcattctccttgtcattatcttcattatttaggccgttactgtggcaccgacatgccccatcctatcacatccttcagcagcgccytgacgctgagattcgtctctgattctagcatcagtgctgggggtttccacaccacggtcaccgcatcagtgtcgggtaagaaaccctagcacctgactct

SEQ ID NO: 26517 - DNA, 201 bp, Homo sapiens
aaattagctgggcgtggtggcgggcgcctgtagtcccagctacttaggaggctgaggcaggagaatggcatggacccgggaggcagagcctgcagtgagcrgagatcgcgccactgcactccagcctgggcgacagagcaagactccgtctcaaaaaaaagaaaaaaaaatcaaaaagaaaagaaaaaagaaaaaagaaaa

SEQ ID NO: 26518 - DNA, 201 bp, Homo sapiens
ttgcagaaattccttctaatccaccacactgcatggcccttggtcttcagtttgcagaattgttcccttattttatatgacatgaatgttttaaaatgtgwgatggaaatactatctattcttttacattgataatggctctagcgttctttctcctttattttatagtgtctgatgcagtctttgctctgatactcactt

SEQ ID NO: 26519 - DNA, 201 bp, Homo sapiens
gctgggcgtggtggcgggcgcctgtagtcccagctacttaggaggctgaggcaggagaatggcatggacccgggaggcagagcctgcagtgagcggagatygcgccactgcactccagcctgggcgacagagcaagactccgtctcaaaaaaaagaaaaaaaaatcaaaaagaaaagaaaaaagaaaaaagaaaaaaaaga

SEQ ID NO: 26520 - DNA, 201 bp, Homo sapiens
ttgttcccttattttatatgacatgaatgttttaaaatgtgagatggaaatactatctattcttttacattgataatggctctagcgttctttctcctttrttttatagtgtctgatgcagtctttgctctgatactcactttatttctattttcttccagcttgtggtggaacgttctacatggctgaaggcatcttcaa

SEQ ID NO: 26521 - DNA, 201 bp, Homo sapiens
cacatttatgactgtaacagcttgtataatttcctgagggatttccctccctatcacttaatgtttcctctattttggagaagttcgtattccaaagtggsaattccattagcagctataccgccatattataacatgtgaaaatacctcatggactctcaatcctcaaaatcactttgcacctccatgtgaattatctct

SEQ ID NO: 26522 - DNA, 201 bp, Homo sapiens
ttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctc

SEQ ID NO: 26523 - DNA, 201 bp, Homo sapiens
tccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcc

SEQ ID NO: 26524 - DNA, 201 bp, Homo sapiens
ggttgtgaattgaacttagtattgaatttccaaggagcgtaactggaaaaaaatcactgacaaaggaaactgatgcttcctccttcctcagccccaagaaragatgctataatgagtaatattttcatttccttccgcattcacatttatgactgtaacagcttgtataatttcctgagggatttccctccctatcactta

SEQ ID NO: 26525 - DNA, 201 bp, Homo sapiens
ccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcct

SEQ ID NO: 26526 - DNA, 201 bp, Homo sapiens
ggtccacactaccttaatgagctgtagcactcactgcgaaggtctgcggcttcattcctgaagtcagcgagaccatgaacccaccggaaggaaaaaactgyggacgcatctgaacatctgaacaaacaaaatccggacacaccatctttaagaactataacactcaccacgagggtccgcagcttcattcttgaagtcagc

SEQ ID NO: 26527 - DNA, 201 bp, Homo sapiens
caacatttccaggaatctttgagtcagtgctcgcaacaactgcaaatttttagagtttatagtctcttgtaagatgtgaagactgagtgggagagtgtagmacaaagaaataggggtgaacgcatcgtgatatgagatgtggggttgtgaattgaacttagtattgaatttccaaggagcgtaactggaaaaaaatcactg

SEQ ID NO: 26528 - DNA, 201 bp, Homo sapiens
catgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctg

SEQ ID NO: 26529 - DNA, 201 bp, Homo sapiens
cataattataactttattgtaacttaacggttttctcctaaattaagcattgtatatttttgatggcctttcggtgagttgaatttggaattattttccaygggctgttgcccactttgaactgactgaacctttctgttttaacaggttgtggtggagagctgtctggggccacaggctccttcagcagccccgggttcc

SEQ ID NO: 26530 - DNA, 201 bp, Homo sapiens
ccgtccaggccttgcttgtctacatcccgcctactccgcccacacctgagcgtgtcggtctgggctggcgtcagaatcttagcccctctggaatcaacatmcctggcgggcagtgatgaacgtctgtgtgtttgataacaggccacaggttattcagggaattagggtgtacattcttgtgaatggtaatattagccagtt

SEQ ID NO: 26531 - DNA, 201 bp, Homo sapiens
agctgatgtctaatgatgtattctgttagattttgcctcaaagtcaattaaaagatttttgctttgtttacgttttccaggttgctatggtgattgtcttyagtggagggacaggacagtaatgagggcagcattcaacattgttagttccgtgcctttgagctgaagttctcggcaaggcatgggggagagagaacacag

SEQ ID NO: 26532 - DNA, 201 bp, Homo sapiens
aatgtcattaattcaggttcctccacctgagacctaatcacacttaacattctcccacagacaagttgcattagagatatgcaagacaattgtatttcccytccaggagtacagtgagtaagcaagaacaagtgacgacagataatttcctctaaatatttgatttactggccaaagctctctgtgtgtgggtcaatgagt

SEQ ID NO: 26533 - DNA, 201 bp, Homo sapiens
agtacagtgagtaagcaagaacaagtgacgacagataatttcctctaaatatttgatttactggccaaagctctctgtgtgtgggtcaatgagtctgtctrttctgtcaactcagggatactgggtcattgctttcatttgatgtcctttttttagcttagtaagtttcattactgggtctgaaatattaatagaccaatg

SEQ ID NO: 26534 - DNA, 201 bp, Homo sapiens
ggtggcgggttaggtaaagggtaaagcatttcagacaaagtgaatggtgtaaatatcattggaacacatcaagaactgtagtttacttttgtgccagcaayagaaaagaagcttggtgagtaaatcaaaatttcagtacagattaacagactcccaccagttgttccagaataatcacattcatgtaagcaagataaaggg

SEQ ID NO: 26535 - DNA, 201 bp, Homo sapiens
aacaaaagcattcaaaccagattttctttgtaaaatatttcagatttggagggcataggagattgagtgggtggtaataaacacagaatcgactgaatagrtaacgttaaaactgttaaactagaaaagtttttaaagaagatatttatttaggacttcaaaattgtccaggtactatgctaaatgttttataaatgacct

SEQ ID NO: 26536 - DNA, 201 bp, Homo sapiens
aaaattttattatgctaaataaattaattctgcttggttgggaaaggtttcagccaaccttaaatgatgggtaagagtgtatatgttaaactgtgtattgkcaggggttgttgggtggcgggttaggtaaagggtaaagcatttcagacaaagtgaatggtgtaaatatcattggaacacatcaagaactgtagtttactt

SEQ ID NO: 26537 - DNA, 201 bp, Homo sapiens
tatacagattttctggaaatcaggtcagcacttttatttatttcattataatcttttcattatttattctcattaataatctttcctaggaagattaaggaaaaaaatatggaaattctctgcaaagctccctgctgtgcactttcttgcaagaaataaagtttgtcatttggagcctgacttaggagaaatacaggaatt

SEQ ID NO: 26538 - DNA, 201 bp, Homo sapiens
agacatacctttgtaaaacaattctattaccatcctagcttgtaaggcaatattttgtgcagaaagaacccagagcagttaaaataattgggcagggaggwtattagattttaattctaaaagttttcagaaagataagatacacgtaaaataaaaatgagtcaggaaaagagatagaagcaaactggacaggaaaggaaa

SEQ ID NO: 26539 - DNA, 201 bp, Homo sapiens
atacaggcagggcctcctgaaaatgtggaaatctttgtaatgatatgcaaagtaagacatacctttgtaaaacaattctattaccatcctagcttgtaagrcaatattttgtgcagaaagaacccagagcagttaaaataattgggcagggaggatattagattttaattctaaaagttttcagaaagataagatacacgt

SEQ ID NO: 26540 - DNA, 201 bp, Homo sapiens
tttatctgttttatttctttatctgcatgaaccatattctatcattgctcgtttatcctttcttaatatcttaatattaagggatttgcagtagatttgtsgtaatattacgaggactcagtccataaaactctgcagcattttctaaaaatgtataatattcttattaagcacatatgtatgtttttaaatcagagcttt

SEQ ID NO: 26541 - DNA, 201 bp, Homo sapiens
tgaagttttcagacggtaaagaaatataatgtctccaaagtactctgaattggctgagataataagtgtgaatatttgtgtgtctgtgcatgtgtgtgtgkgggggggggagagagagagagaaatgataaagtaatgggagcagaatacaaatacataataaatctgggtaaaaagaattcaggagctcattcttgcatc

SEQ ID NO: 26542 - DNA, 201 bp, Homo sapiens
ggcaactaagaaacatttttccttttaatctttgaagaggttattatcagagccttttaatttgaaatccaggtagcttggttacttgctgcagtaattawaatttttatttcaacagcatgtggagaaattcttacagaatcaacagggaccattcaaagtcctggccatccaaatgtctacccccacggtatcaactgt

SEQ ID NO: 26543 - DNA, 201 bp, Homo sapiens
cctcttgggcttgtatcagaataagtgaatgatagaaataaattatatgaaaatcatctgtactgtgaaaaattttaaagtacactcaaagacaaagaatrtatattttctaatcaacatttatatcaaaagttaattgttacttattaataagagaaaaatcaggttatcttaagtggcaactaagaaacatttttcctt

SEQ ID NO: 26544 - DNA, 201 bp, Homo sapiens
gtgtgcatgtgtctttatagcagcatgatttataatcctttgggtatatacccagtaatgggatggctggatcaaatggtatttctagttctagatccctraggaatcaccacactgacttccacaatggttgaactagtttacagttccaccaacagtgtcaaagcgttcctatttctccacatcctctccagcacctgt

SEQ ID NO: 26545 - DNA, 201 bp, Homo sapiens
actgggactaagtatgacacttgactcagatcaggtttgctatcaagcagggagcaatggccagccccttccctcacagtatatgaatgatctggacagcrccttggtgccagtgatccccggaggggcctgtcagctcagtgagggccctgtcgtcatggaactcatcttttatatcctggaaaacatcgcataaacaga

SEQ ID NO: 26546 - DNA, 201 bp, Homo sapiens
ccagtgggtggatgacgacaagaactttagcaaatgtgtcataagtcctataaatgagaagtccatggagactataacaaatgtgaagctattccatggaycagaatgtaaagcaaatggaaaagttatcagatggacagaggtgtttttcctagaaaacacctaaatgatcctacaaaatgatcattttagcaaatgatc

SEQ ID NO: 26547 - DNA, 201 bp, Homo sapiens
caaggctttttgccttgctctctgtcctcacctgaagcttctgaaggaagatggaatgaccaaactgggactaagtatgacacttgactcagatcaggttygctatcaagcagggagcaatggccagccccttccctcacagtatatgaatgatctggacagcgccttggtgccagtgatccccggaggggcctgtcagct

SEQ ID NO: 26548 - DNA, 201 bp, Homo sapiens
cccctgaaactttgacatgacacctgaattccaacattcaaaagtcatcacttttagagtattgaagtttttggaatttctgagattctcaatatagttcygaaaatacgtatacactcctaggctaaatctattagcacaagtaaacagaaaagtttaatgatgattgaagcagcattggatgttagctaacaccatgga

SEQ ID NO: 26549 - DNA, 201 bp, Homo sapiens
aatgtgaaacaaacccaaatgcccatcagttgatgagtggataaagaaactgtggtccagatcactgcagagaacatggattccttgaggcaggcaatgcsagagataaaggacttcaccatcacctgtgggaagacggacgtggaggatccccaggagcacatccacatccagtgggtggatgacgacaagaactttagc

SEQ ID NO: 26550 - DNA, 201 bp, Homo sapiens
aaaggagccttcccaggcaaggccttacatacagtgtgcaggactttagtcttcgtggtgtaagtaacaggaagctagggagctttctaaatggggtgggrgctgggcaacacaaggatgacaatatgatttgccttctggaaagatctgtcttgttgcagtgtggagaatggagtgaaggagacatgaaagcctttggag

SEQ ID NO: 26551 - DNA, 201 bp, Homo sapiens
taaaacccacagtatttagcttgatattcaaggctgacctcaaactacctttctagacacaagtcccctcacaattgccctgaagttgtgtcaaacacaayacactctacagaatagtcaaactggtgatagccccaagtctttgcccgtgtggtccctttctccaacagagatcctacatattatttttgcctgtcaata

SEQ ID NO: 26552 - DNA, 201 bp, Homo sapiens
agagaacatggattccttgaggcaggcaatgcgagagataaaggacttcaccatcacctgtgggaagacggacgtggaggatccccaggagcacatccacrtccagtgggtggatgacgacaagaactttagcaaatgtgtcataagtcctataaatgagaagtccatggagactataacaaatgtgaagctattccatgg

SEQ ID NO: 26553 - DNA, 201 bp, Homo sapiens
tatttgtatgggagaaagttaggatatgattttatatactttcacaggaatatctaattttgttgagacaatattattttgcctagttgattcataatggmatttgtcataactacattttctcaataagtggtctatttctaaatttcctattccatcagtttatttgtctatgcttttgccagtttctcagtctaaatt

SEQ ID NO: 26554 - DNA, 201 bp, Homo sapiens
agttaggatatgattttatatactttcacaggaatatctaattttgttgagacaatattattttgcctagttgattcataatggcatttgtcataactacwttttctcaataagtggtctatttctaaatttcctattccatcagtttatttgtctatgcttttgccagtttctcagtctaaattagagctctacaacact

SEQ ID NO: 26555 - DNA, 201 bp, Homo sapiens
gtaagcgcagacacagagctatgactcccgttctccctgtgtcagcccctgcgcagtgcgagtgggaggtgagccactgttgcgtgccctctgccagacayaggcctgcaggtcagactcacaggggccaagcagagcatctgggaggattttgtttctggctccaaaaatgaaataccaaggaaagtaggcaagctcatg

SEQ ID NO: 26556 - DNA, 201 bp, Homo sapiens
ctagaggtgcttgagtggttggtgcaagggggcttgtggggaaccagagcgtcctggtgtttagagcagcaaggaagaggctgggtaaggacaaaggacaytgggacagacagaaagcctgactctagaaagaaggggccaaggtcactggagaggagagagaggaaggattaaggacgattgagtgggtcataggggttg

SEQ ID NO: 26557 - DNA, 201 bp, Homo sapiens
cgtcacacggcttataagtaaggcagccaggatgtgaacccagtaggactatctggctgcaaagtccccaccctccctcgccatctgtatcctccaatcaycttcagtgctttgctgatagaaggtacggaaatacgatgccacagactgtccaggaagacagaaactaggcagatgggctggccatggtctccaagccag

SEQ ID NO: 26558 - DNA, 201 bp, Homo sapiens
tctccacccccactacccctctgcctcggcctggggtatgaggtcttggttttgacaatcagacaatgttagcacactgctgtgtcttccacctgcaatgragcactgtaggacgattttaaaaagcaaagtggcaggccaggtgcggtgactcaagcctgtaatcccagcactttgggaggctgaggcgggcggattacc

SEQ ID NO: 26559 - DNA, 201 bp, Homo sapiens
gaatgaggacatcatgaccaccatgcaaaggccattgctcttaaggtttgatgtaagctccccactctccacccccactacccctctgcctcggcctgggktatgaggtcttggttttgacaatcagacaatgttagcacactgctgtgtcttccacctgcaatggagcactgtaggacgattttaaaaagcaaagtggca

SEQ ID NO: 26560 - DNA, 201 bp, Homo sapiens
tgcatgcctctcaggatggggagttcactgcatccccctctttaaagacattacggttgtacaaaggtctccagaatcatctattacatcccctcattctyccaatgaggaaattaaagctcagagatgccgaggcatttacccaagggcacacctggtcctgggcctacgacccttagacaatattccttccacctcttt

SEQ ID NO: 26561 - DNA, 201 bp, Homo sapiens
tctgaaataagagtccttagcttttagagaagaatagtgaaatatttacagatgaaatgacagacatgcaggatttactgcaaatattacaggaggggtarggtaggtttgggcatagagaaaaagattggctgcgagttggtaattactgaagctgggtgaagtatgtggagtttcattatgctagtctatctacttgtg

SEQ ID NO: 26562 - DNA, 201 bp, Homo sapiens
tatgagagggatgcaactgaggctacctggagtgcgtggacacagccatggcctcaggtcatcatctcccccacgaagcctcccacacctcctgtccccawcttgggcacacttcccaccacctgggagacccctgagggcaggcaccatctgtccttcaccactatatccccctataaagagagataatgcagtgaggtg

SEQ ID NO: 26563 - DNA, 201 bp, Homo sapiens
ccagtagactgtcagctcctagccattgtatccctagcaccgctgtgtgggagcacttcacaaacgtccattgagtcagggactcagcagtctccatttcycctccctgctggagaatgcgtgtattttgcaatccccagcccctgtgccatctaaccatcttttcttctctgttcagcccaggtgtggcctcactcacat

SEQ ID NO: 26564 - DNA, 201 bp, Homo sapiens
ccaggttgcaagacccctcctaccaactgagctacaaatcacagttcctggagggtgggcctttatataacagggaacagaactcttctgtacctcccacytccccgcaagaagtaggccaggcatggtagctcatgcctgtaaatgaagcattttggtagaccaaggtaggagggtcacttgaggccaggagttcgagac

SEQ ID NO: 26565 - DNA, 201 bp, Homo sapiens
gtgagttagctcatgaaagatgacagactctccaagccaggggtatgcaggaaatgggttttctgtagctacagaaatggggttgagggttggaccaaggsgactacccaggggaagtcttaccttcagaggactctggaaaggaggctgcaagttttcatgggtcaagaattcagagcccagtagagacagcttatctct

SEQ ID NO: 26566 - DNA, 201 bp, Homo sapiens
cacaaacgtccattgagtcagggactcagcagtctccatttctcctccctgctggagaatgcgtgtattttgcaatccccagcccctgtgccatctaaccrtcttttcttctctgttcagcccaggtgtggcctcactcacatcccactctgagtccaaatgttctctccctggaagatatcaatgtttctgtctgttcgt

SEQ ID NO: 26567 - DNA, 201 bp, Homo sapiens
gttgttaaccatttaccagcaccccactacctctgtctcctctgtcagcccagggaagcgcacccttgtccagaagtccccaagggcatagggcagagcarcaggagcccaagtaccaggtcccagcccccacccctcccctgagagttgtgtggtcctgggcaagtcagaggaaatgccgggggtatttattttaaaaag

SEQ ID NO: 26568 - DNA, 201 bp, Homo sapiens
catgtcccctcactccctgccctccagtccccgccagtcctcatgttttccatgaggatgagtacagccgcagggactttccctgcaagtggtctgggccrtatcttccgggagtctgtttggactgtggtgtctgtggctgagggggtggaggtgagggcacccaggcccatcacttgacagaacaatctgtggatttgg

SEQ ID NO: 26569 - DNA, 201 bp, Homo sapiens
atctagtgtcactttccagaacataccaacagcttccccagttctgtgcctctgctcaggctgttccccctgcctggtccacttgtcctccttcttgtccsgtcaaaatgcttcttatccttcaagacccagctctagagtcacctccaaccccttacccaccagccccctctccaagtctgtgtcccacaacccccctgc

SEQ ID NO: 26570 - DNA, 201 bp, Homo sapiens
ctttctatgagcccaggagggcctctcagagaggaaagctcctaggtcttcctttccctctgcaaactccctgccttgaaggatcagaaggactgtgctgstcgttgcatcctttgcaagttccaaaccctgatcccagctgtgcttaggggttcctgcaaaccttttccaggtgttaattacctcccacttcatttcctg

SEQ ID NO: 26571 - DNA, 201 bp, Homo sapiens
aaagacaaccagcgccagtaataatttggtattttgccttctcaacttttgaactttgttgtatgtacaatttggttacccagctttttgttcccctaacrtgttatcagaaacattctctcatttttggtgaactcttagaagcatccttttttcatgtctgcttgacatttgttgaatggatataagatcatgtattta

SEQ ID NO: 26572 - DNA, 201 bp, Homo sapiens
gccccctctccaagtctgtgtcccacaacccccctgctccctccagggcaccctccaccctctgggccacagttgtcaggagtcaggcagggcaggggccrggtggtgtcttctttgtgttcttgcactcagggcagagctcagcacagagcagacgctcaaaaaacatttaaaggatagaagcattgatttgtgggtccc

SEQ ID NO: 26573 - DNA, 201 bp, Homo sapiens
caggcttttctgcagcagcgaatgcatcagagctgccaggggggcagctgtagacctaagagagttcctttaagcacaaattggctgattatcttttttasgtaaataaacccataattcattccaaacacttggcttatttaaatatttttattgccaaaggaatatatgttcttcacagaaaacttggataccatgaca

SEQ ID NO: 26574 - DNA, 201 bp, Homo sapiens
acaagcggggacctgggctctgacaggaggccacacacttacagtccctcccttagtgaccggcagagctgggatttgaacacccctggtgagactccctygtccagaccccttcgttgtacagcaggtttgcctcacatgccagagtcggggtggcctcagggcacagccaggagatgtccccaaatcccgaaatgtggt

SEQ ID NO: 26575 - DNA, 201 bp, Homo sapiens; identical to SEQ ID NO: 5683

SEQ ID NO: 26576 - DNA, 201 bp, Homo sapiens
aaaggactgtcgtgcaaacccaccatggcatgagctgtcgagtgcagtgcccgctgccactaaggaatgagtgccactctgggattgtggaaagtgcagasgggcagggttgagatgctcgtgcatgactttggacaggtcacctccctctcagaggtttagtttccttacttgttaagcttggactaaaaatatctaaat

SEQ ID NO: 26577 - DNA, 201 bp, Homo sapiens
atgttgcaacagccatgaaaaaagaaatgcaaagcgattcaggatgagagcaataccctactccaaagaaggcaaaatagaagctcagagaggtcaagcawtttgcccaagaccacacagctaggagtggaactcatggctgtccaagccccacgcctctgctgaaggtagagatgaattacagcaacaagtctagaaagg

SEQ ID NO: 26578 - DNA, 201 bp, Homo sapiens
aatgtcaagggagttaggagctccgtgtcaggaactggtgtcaaagaccaaatatgtatttcctaatatatcacgatatcacaggttgtgagaagaatgcmatcaatggtcaaactccagagctgcacactctccaatatggcagtgaccagccacatgcagtcaccaagcacttgaaaggtggctgcttcaaactggtat

SEQ ID NO: 26579 - DNA, 201 bp, Homo sapiens
gggaggctctctggggttctcccggagcctcggagattgcaccttgtgcatgcgctgctgcacctggggtacatcacccccactctggagcccactggccrgttagcaaagtgagaggtgagagaaggacctcttggtcttctttgaacagaaagatccagaaagcaatggctagaacacaagaacaggtcaggggaggca

SEQ ID NO: 26580 - DNA, 201 bp, Homo sapiens
gaagcatgcaagcaagtgggtgctggggccggggcaagcgcttttgggctctggccctacagtaccgtctagggttgtgttacaattaatgctcttttagmagttgccattcactgatggctaagtgttaaccaactcagtggagagtgagggtgacagccttttacaccttgccctcttggtacctgggtccttgtctgg

SEQ ID NO: 26581 - DNA, 201 bp, Homo sapiens
gacagaaaccctccccgatccaagttattagcaaactgcccatctccacaaaaatttaaatggacagattgttaaatgcacacagctcacagccagctccyttcaaggtagatttgggcccaaacatttcgggaagcatcaggctgtgccccgccatccctaccaaacaggaatcctctcgagggaaaagactgggccttt

SEQ ID NO: 26582 - DNA, 201 bp, Homo sapiens
gccactgtcgcccttgggagccgtacgtggcatacaaagaaatcccaggactccgcctgcccacctggccaccctctgtttacaccttccgcgtaaacgcscactgtttacatccaaaactcagacacaaaataaccacctcaagaagataaataatgataagaaataaatgttacgcgaggcaaatttattcacatgggg

SEQ ID NO: 26583 - DNA, 201 bp, Homo sapiens
gctcaatctgttaacaggcttctggcatgtagatcagtggtctccaagcttttgtgattgtatattcctataggaaaaaaagaattgattatgcatacccrgtatgtatacttattaatctgtatgaagatgtacattctaaaatataatcaaccagtagaaatttaagaaagaagatgtaaaaaaaaaaaatattaacag

SEQ ID NO: 26584 - DNA, 201 bp, Homo sapiens
atacccacacatgcacacacacacacacacctgcactcacacacttgcacatgcatagaccacagctttccacacccttcctagacaggggtcacttggtrtcctggagagagtgtgaagtctggaagggaaagaggggggattaagccccacctctagccatgggactgagacaagtcacccccacccatctgcgccttg

SEQ ID NO: 26585 - DNA, 201 bp, Homo sapiens
tccctcactcaacctcttgctacttcccacctctcctgtccaacatctagtgtcactttccagaacataccaacagcttccccagttctgtgcctctgctmaggctgttccccctgcctggtccacttgtcctccttcttgtcccgtcaaaatgcttcttatccttcaagacccagctctagagtcacctccaacccctta

SEQ ID NO: 26586 - DNA, 201 bp, Homo sapiens
ccctcagtgttctcatcaataatccactcgccctcacaggcgcgtttgggaccccatgttctatgctctcacaggaccttttgcttgatttttcactgtaytcaggtcagtttgcagttattaagtgactgagcaatgtctggcttctccagtagactgtcagctcctagccattgtatccctagcaccgctgtgtgggag

SEQ ID NO: 26587 - DNA, 201 bp, Homo sapiens
ccacccatctgcgccttgtttcctcctctgtgaggcaagcacagagcccatgcctccctccctggatgggagtgatgtgaaacttgaagaggggtagagayaagggtcgtcaatggaagccccttgggcaaaaaggccctttcaactaggggcacagaggaggccctgggctgagaacttgacagcaccttgtattggtaa

SEQ ID NO: 26588 - DNA, 201 bp, Homo sapiens
gcttcggtgctgtctctgggggcaccaccagctcagcacctccctgcgttcaccaactcggaagctctcccaatcctgtcttttagggattttgatggagrcttcatcatataggcatgatggataataaattcaatctccagcccctcttcccttcctggaggatgtggggtgaaagttccaagctttgtatcatggtct

SEQ ID NO: 26589 - DNA, 201 bp, Homo sapiens
catgcatgtcagaatcctcaatctcagctcaggaagtaggaattttccacctttgttagcagcagagatgacaaaccccagggccccacatatagcctgtrccttagtcactgcctcgggccaggttgcaagacccctcctaccaactgagctacaaatcacagttcctggagggtgggcctttatataacagggaacaga

SEQ ID NO: 26590 - DNA, 201 bp, Homo sapiens
tcccgttctccctgtgtcagcccctgcgcagtgcgagtgggaggtgagccactgttgcgtgccctctgccagacacaggcctgcaggtcagactcacaggrgccaagcagagcatctgggaggattttgtttctggctccaaaaatgaaataccaaggaaagtaggcaagctcatgcatgtcagaatcctcaatctcagct

SEQ ID NO: 26591 - DNA, 201 bp, Homo sapiens
ggttctgaaggatgagtaggagttggaaggagttggaagagctcctgccctttgtggagcaggagagggaggtggtccagggacctttctggccgaccaascctagagccaattgcagtgagccattgtgacattggacttgaaactggtcactgcgagagtatttataccatagaaatttgcaaatgctacggttagggc

SEQ ID NO: 26592 - DNA, 201 bp, Homo sapiens
ggaagcccaaggacatgagagctttctgagctgcatcccaggccctgctctgccactgactcgctgaggctgggtttccccatctgcaaaataaggacatraaaacccatctagagctgggcatggtggctcatgcctgtaatcccagcactttgggagtccagggcaggcagatcacttgaggtcaagagttcgagacca

SEQ ID NO: 26593 - DNA, 201 bp, Homo sapiens
tcccagaccttgttgtcacctcctcactctcccagtagcgccagccagagcacctgtcttgggagccccgaggcagggacaggctatgcatccaggaagcycccaggctctaaggaggcggccctataactgctggatgaccaaaaatcaggcagcgatccctaagtcccttctgagccccaggctccaggctcctccaac

SEQ ID NO: 26594 - DNA, 201 bp, Homo sapiens
cgggccaggttgcaagacccctcctaccaactgagctacaaatcacagttcctggagggtgggcctttatataacagggaacagaactcttctgtacctcscacctccccgcaagaagtaggccaggcatggtagctcatgcctgtaaatgaagcattttggtagaccaaggtaggagggtcacttgaggccaggagttcg

SEQ ID NO: 26595 - DNA, 201 bp, Homo sapiens
gagactcccttgtccagaccccttcgttgtacagcaggtttgcctcacatgccagagtcggggtggcctcagggcacagccaggagatgtccccaaatccmgaaatgtggtttgagtcccagtccctcatctctccagcctccaagccctcacctatgcaatggtgccttgcccggctcacaggttatgaaaaggggtgag

SEQ ID NO: 26596 - DNA, 201 bp, Homo sapiens
tgacagttgaggaaatggtccctagaggggagacagagctagctagagactgggctggccctggagcctggcctgggtcttcccatcgcatcctgcctccstacataagcaaaggtcgagaggtgggaactcccaaagatgctcaggcagggccaggggagaccagtggggcagggaggggacaggaggggaaggaggagc

SEQ ID NO: 26597 - DNA, 201 bp, Homo sapiens; identical to SEQ ID NO: 5678

SEQ ID NO: 26598 - DNA, 201 bp, Homo sapiens
ggctattgaaaagcaaggtgggtcgacagattgttaaatgcaaagaggtgaggacacagccggcggtgcatttagggtgcttctgcaggcgtccttatacrtggatatgtgcacatctgctcctgaaagctcagaagatgtctggaaagcaacaggagacaccagtgagcctggctgtctcttgaggcaacaggcagggac

SEQ ID NO: 26599 - DNA, 201 bp, Homo sapiens
ggaggctgatgacatcactacccagcccttgaaagatgagctgttcccgccgccactccagctctggcttctgggctccgaggaggggtggggacggtggkgacggtggggacatcaggctgccccgcagtaccagggagcgactgaagtgcccatgccgcttgctccggagaaggtgggtgccgggcaggggctgctcca

SEQ ID NO: 26600 - DNA, 201 bp, Homo sapiens
gcaggagagggtctgcacacctgctacaggtgtgctcacacgtgggccagggcctgcagatgagggatctgtgctgatcatttgtgatagccaaaagtagwgaaaacctggggggactcctcaaatgaactgtagcacattggggagatggactctgtgaagatgattcctctctccacccacttcccttctccctcctcc

SEQ ID NO: 26601 - DNA, 201 bp, Homo sapiens
gggtaatttatcaaaaaacagacatttattgctctcggtgctggaggctgggaagcccgagatcaaggcactggcagattgggtgtctggtgaggacctaktcgtcatagatggcaccttctatgcatcctcatatggtggaagggtgaacacgctctcccaggcctcctttaaagaccaccaatcccattcacaaggagg

SEQ ID NO: 26602 - DNA, 201 bp, Homo sapiens
gcggagagcgaaggtggccgcagccttcccggccccacagccagcctggctccagctgggcaggagtgcagagctcagctggaggcggagggggaagtgcycaggaggctgatgacatcactacccagcccttgaaagatgagctgttcccgccgccactccagctctggcttctgggctccgaggaggggtggggacggt

SEQ ID NO: 26603 - DNA, 201 bp, Homo sapiens
cgctggctccatgccagcccctgggctaggcgtctggtggcactacctcatttcactgccataacaactgggtcccccatcttgcagatgaggaagcccargttcagagaggtgaagtggggggctgggggtctatcccagaccttgttgtcacctcctcactctcccagtagcgccagccagagcacctgtcttgggagc

SEQ ID NO: 26604 - DNA, 201 bp, Homo sapiens; identical to SEQ ID NO: 5685

SEQ ID NO: 26605 - DNA, 201 bp, Homo sapiens; identical to SEQ ID NO: 5687

SEQ ID NO: 26606 - DNA, 201 bp, Homo sapiens; identical to SEQ ID NO: 5688

SEQ ID NO: 26607 - DNA, 201 bp, Homo sapiens; identical to SEQ ID NO: 5689

SEQ ID NO: 26608 - DNA, 201 bp, Homo sapiens
caaactccctgccttgaaggatcagaaggactgtgctgctcgttgcatcctttgcaagttccaaaccctgatcccagctgtgcttaggggttcctgcaaaycttttccaggtgttaattacctcccacttcatttcctgtttaccaactcagctttttgttttagtgtgtttgaattccctgaactgaccgttgtctgatc

SEQ ID NO: 26609 - DNA, 201 bp, Homo sapiens
ccaacaaacggtggtgttggagtttaccactggttattttaatgggtttgcaagaattgttaattactaatgtttattgagcctagtgcagtgcttggggyattttgcacattgtctctgatccctatcacaaccctgagaggtagtttttttaactcccattttacaggtgaggtcattgtggttcaaggacgttaagta

SEQ ID NO: 26610 - DNA, 201 bp, Homo sapiens
tgcaacagccatgaaaaaagaaatgcaaagcgattcaggatgagagcaataccctactccaaagaaggcaaaatagaagctcagagaggtcaagcaatttkcccaagaccacacagctaggagtggaactcatggctgtccaagccccacgcctctgctgaaggtagagatgaattacagcaacaagtctagaaaggtgcc

SEQ ID NO: 26611 - DNA, 201 bp, Homo sapiens
tccaggaagcccccaggctctaaggaggcggccctataactgctggatgaccaaaaatcaggcagcgatccctaagtcccttctgagccccaggctccagrctcctccaaccaggtctgccttacgcttttgaccacaatcaacccggctctttctcggttcttttcatctctctggtggttttgtatgcagagtcaccca

SEQ ID NO: 26612 - DNA, 201 bp, Homo sapiens
tgcttgatttttcactgtactcaggtcagtttgcagttattaagtgactgagcaatgtctggcttctccagtagactgtcagctcctagccattgtatccytagcaccgctgtgtgggagcacttcacaaacgtccattgagtcagggactcagcagtctccatttctcctccctgctggagaatgcgtgtattttgcaat

SEQ ID NO: 26613 - DNA, 201 bp, Homo sapiens
ccatcttttcttctctgttcagcccaggtgtggcctcactcacatcccactctgagtccaaatgttctctccctggaagatatcaatgtttctgtctgttygtgaggactccgtgcccaccacggcctctttcaggtgagtcaaagggattcctcagttcactagttaggggaggtgggcagacaccctggagaactccct

SEQ ID NO: 26614 - DNA, 201 bp, Homo sapiens
cacctgcactcacacacttgcacatgcatagaccacagctttccacacccttcctagacaggggtcacttggtgtcctggagagagtgtgaagtctggaakggaaagaggggggattaagccccacctctagccatgggactgagacaagtcacccccacccatctgcgccttgtttcctcctctgtgaggcaagcacaga

SEQ ID NO: 26615 - DNA, 201 bp, Homo sapiens; identical to SEQ ID NO: 5675

SEQ ID NO: 26616 - DNA, 201 bp, Homo sapiens
atccaaggatcagagggggctctgtaagacccaggggagtcaggtgcactggagcgcgggctgcagaaaacagcctgagctccacctcggcttctccttgycctggctggttgtccttaacccctgtctccttctggaccagtttttgtccttcccttgtgaccctgaggggtaacagcctcttttccactttctttcagc

SEQ ID NO: 26617 - DNA, 201 bp, Homo sapiens
catttttctcttttaataaattaactcacccaccacacggctttgagaggctcaaaggtgaccaactcccttgggagggccccggttgataaggaaggaaygtgaatcctcccatcacggaagcttcaaggaggtcaagggtccaacacttgagattgttagtgctgttggtggatactggccaaggaaatatcccagtgg

SEQ ID NO: 26618 - DNA, 201 bp, Homo sapiens
tctctcacccacagcacagggcactgggaaaatgcccaatgagtcctgccctctgggttgtgctttggacttttcagtgtgtcttcgcatccactcttcarcttgaatgttgcaacagccatgaaaaaagaaatgcaaagcgattcaggatgagagcaataccctactccaaagaaggcaaaatagaagctcagagaggtc

SEQ ID NO: 26619 - DNA, 201 bp, Homo sapiens
tggtctccaagccagactggaatctccaggtctggaatgatatcatttttctcttttaataaattaactcacccaccacacggctttgagaggctcaaagktgaccaactcccttgggagggccccggttgataaggaaggaatgtgaatcctcccatcacggaagcttcaaggaggtcaagggtccaacacttgagattg

SEQ ID NO: 26620 - DNA, 201 bp, Homo sapiens
cactaagtgaatgaagctactctgaaaaggcatatgctgtatgatttcaactatatgtgacattctggaaaaaggcaaaactatgaagacagtaaaaaataaaaaaatcagtggttgccaggaattaggggagggaggagagaatgggaggagcccagagacttttagggcagtgaaacttctgtatgacactgtaatggt

SEQ ID NO: 26621 - DNA, 201 bp, Homo sapiens
cttatccttcaagacccagctctagagtcacctccaaccccttacccaccagccccctctccaagtctgtgtcccacaacccccctgctccctccagggcmccctccaccctctgggccacagttgtcaggagtcaggcagggcaggggccgggtggtgtcttctttgtgttcttgcactcagggcagagctcagcacaga

SEQ ID NO: 26622 - DNA, 201 bp, Homo sapiens
ggtaccagacggactgtctatggaggcaggagtgagggcctggggcggtcacagaggttgcatttgctttgcagtaaggccatggccgcttaagggtgtcyagaaaaaagccctgtccgacatgcacacactcctgtgtccaggcaatgagcctgtgggcactgacagcaagagtccttctcacgcttctcttcagggctc

SEQ ID NO: 26623 - DNA, 201 bp, Homo sapiens
tctagtgtcactttccagaacataccaacagcttccccagttctgtgcctctgctcaggctgttccccctgcctggtccacttgtcctccttcttgtcccktcaaaatgcttcttatccttcaagacccagctctagagtcacctccaaccccttacccaccagccccctctccaagtctgtgtcccacaacccccctgct

SEQ ID NO: 26624 - DNA, 201 bp, Homo sapiens
ggaggcagaggttgcagggagctgagatcacaccactgcactccaggctgggtgacagagcaagactctatctcaaaataataataataataataataatmataatcatcatcatcatcatagcatataggaagctgtcagctatgcactcgtctcaggtgagcagagggatgactttgggttctatcctttgttccatac

SEQ ID NO: 26625 - DNA, 201 bp, Homo sapiens
ggcagaggttgcagggagctgagatcacaccactgcactccaggctgggtgacagagcaagactctatctcaaaataataataataataataataataatmatcatcatcatcatcatagcatataggaagctgtcagctatgcactcgtctcaggtgagcagagggatgactttgggttctatcctttgttccatacctg

SEQ ID NO: 26626 - DNA, 201 bp, Homo sapiens
gggaatgttctgcggaactagaggaagaggggctcagggagaagaagggcacattcctggttgtcatatgtgatctatcccagatgaacttggaagtgaarggaagagagttaaacattaaagtaaatacccagtggatcagacagcaatgtgccagattgccttggagacaaaatatctccaacacatggctgacatttg

SEQ ID NO: 26627 - DNA, 201 bp, Homo sapiens
cagccttcccggccccacagccagcctggctccagctgggcaggagtgcagagctcagctggaggcggagggggaagtgcccaggaggctgatgacatcaytacccagcccttgaaagatgagctgttcccgccgccactccagctctggcttctgggctccgaggaggggtggggacggtggggacggtggggacatcag

SEQ ID NO: 26628 - DNA, 201 bp, Homo sapiens
tccctggaagatatcaatgtttctgtctgttcgtgaggactccgtgcccaccacggcctctttcaggtgagtcaaagggattcctcagttcactagttagrggaggtgggcagacaccctggagaactccctggaaagctcaactctcatgccccggacaacagttgaaggaaccagtgatgttaagcccaaagacaaaac

SEQ ID NO: 26629 - DNA, 201 bp, Homo sapiens
catttaggttgtttcctgtgacccttcttctgcatgatgaggaacatctctgtgcataaagcttttcctgtccttttgattattttcaaaaatgccaaacaaaaaaaaaaagggagggggttgaaggttctgggttttcttcactgaattatccaaatattaaatgatctagagacaggtttgggagccactaaaccctct

SEQ ID NO: 26630 - DNA, 201 bp, Homo sapiens; identical to SEQ ID NO: 5677

SEQ ID NO: 26631 - DNA, 201 bp, Homo sapiens; identical to SEQ ID NO: 5679

SEQ ID NO: 26632 - DNA, 201 bp, Homo sapiens
tttctcactttgatatttaaaagatgttcaatacactgtttgaatgtgctggtaactgctttgcttcttgagtagagccaccaccaccatagcccagccakatgagtgctctgtggacccacagcctcagctgagtgtgaccctaggaggcacaatgtgctctgtatccagaacacacttggcagatggaggaagcatctg

SEQ ID NO: 26633 - DNA, 201 bp, Homo sapiens
ggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcg

SEQ ID NO: 26634 - DNA, 201 bp, Homo sapiens
caaacacacacatgtgtgcacaaacacatgcatgcacacacaaacacatgcatgcacacacaaacacacacacatatatacacacaccaacacaaacacamatgtgcacaaacacacgtgtgcacacaaacacacacatgcacacacacacacaaatgcacacacatgcgtgcacactgtggctactcctctgtagcctgc

SEQ ID NO: 26635 - DNA, 201 bp, Homo sapiens; identical to SEQ ID NO: 5681

SEQ ID NO: 26636 - DNA, 201 bp, Homo sapiens; identical to SEQ ID NO: 5682

SEQ ID NO: 26637 - DNA, 201 bp, Homo sapiens
aatggctgaaagtttaatcgtttgttcatgagagttttattctggttttagttttttattttgttttgctggctgaggcaaaatagtcccaggtcaaaggraccccatcaaaatacttcacgctcacaaccactctgggagtttgcatgatcactggttcatggtatggaaactggggcccagagagggaagtaactttcc

SEQ ID NO: 26638 - DNA, 201 bp, Homo sapiens; identical to SEQ ID NO: 5684

SEQ ID NO: 26639 - DNA, 201 bp, Homo sapiens
tcacggaagcttcaaggaggtcaagggtccaacacttgagattgttagtgctgttggtggatactggccaaggaaatatcccagtggagcctcgagatgargaacatgaggcccccgtttagatccaaggatcagagggggctctgtaagacccaggggagtcaggtgcactggagcgcgggctgcagaaaacagcctgag

SEQ ID NO: 26640 - DNA, 201 bp, Homo sapiens
ctggctgcaaagtccccaccctccctcgccatctgtatcctccaatcatcttcagtgctttgctgatagaaggtacggaaatacgatgccacagactgtcsaggaagacagaaactaggcagatgggctggccatggtctccaagccagactggaatctccaggtctggaatgatatcatttttctcttttaataaattaa

SEQ ID NO: 26641 - DNA, 201 bp, Homo sapiens
gggcgagttattttgtcctgtctcctgagctataaagaagacctggaagttcctctttatgcaaagatagaggtaggctcttgcctgtgaagcaccacgtrtgtcataggcactaaataaatggcagccgtgattcgagttgctgagagtaggtcgtttccgcagcctgggtggaggtgaacagcaggtgttgctgttcca

SEQ ID NO: 26642 - DNA, 201 bp, Homo sapiens
cagataaggaaactgagactcagagaggttaagggcactgcagtaagcgcagacacagagctatgactcccgttctccctgtgtcagcccctgcgcagtgygagtgggaggtgagccactgttgcgtgccctctgccagacacaggcctgcaggtcagactcacaggggccaagcagagcatctgggaggattttgtttct

SEQ ID NO: 26643 - DNA, 201 bp, Homo sapiens; identical to SEQ ID NO: 5673

SEQ ID NO: 26644 - DNA, 201 bp, Homo sapiens
ccctaacattgattcggcatctactaataatcaatcccttcttacagataaggaaactgagtagcaataatctatcccatcttacagataaggaaactgasactcagagaggttaagggcactgcagtaagcgcagacacagagctatgactcccgttctccctgtgtcagcccctgcgcagtgcgagtgggaggtgagcc

SEQ ID NO: 26645 - DNA, 201 bp, Homo sapiens
tcttgtcccgtcaaaatgcttcttatccttcaagacccagctctagagtcacctccaaccccttacccaccagccccctctccaagtctgtgtcccacaasccccctgctccctccagggcaccctccaccctctgggccacagttgtcaggagtcaggcagggcaggggccgggtggtgtcttctttgtgttcttgcact

SEQ ID NO: 26646 - DNA, 201 bp, Homo sapiens
ccctgcctggtccacttgtcctccttcttgtcccgtcaaaatgcttcttatccttcaagacccagctctagagtcacctccaaccccttacccaccagccycctctccaagtctgtgtcccacaacccccctgctccctccagggcaccctccaccctctgggccacagttgtcaggagtcaggcagggcaggggccgggt

SEQ ID NO: 26647 - DNA, 201 bp, Homo sapiens
tagccattgtatccctagcaccgctgtgtgggagcacttcacaaacgtccattgagtcagggactcagcagtctccatttctcctccctgctggagaatgmgtgtattttgcaatccccagcccctgtgccatctaaccatcttttcttctctgttcagcccaggtgtggcctcactcacatcccactctgagtccaaatg

SEQ ID NO: 26648 - DNA, 201 bp, Homo sapiens
gcaggcaaaaaaagaaaaaaaaaatgctgggagagcctccccagcgaggcaacaggagcagcccctcaactcctgaccctctctggctccagcaagctggygcaatgagaagaagtccaggtgggctcaggagaccaggcaaggggcctagctcctgagtcttccctggccacagaggggtgagaataggatgcagagatg

SEQ ID NO: 26649 - DNA, 201 bp, Homo sapiens
attccgcactcagcaggcatctttctgatgatccgatggcttctcagagccagggatgggccaggatccatccccttggctactgtcttgctgagaaattwataagcagcatctggtgctatactttggtctctagtgagttagctcatgaaagatgacagactctccaagccaggggtatgcaggaaatgggttttctgt

SEQ ID NO: 26650 - DNA, 201 bp, Homo sapiens
atgcatgcacacacaaacacatgcatgcacacacaaacacacacacatatatacacacaccaacacaaacacaaatgtgcacaaacacacgtgtgcacacaaacacacacatgcacacacacacacaaatgcacacacatgcgtgcacactgtggctactcctctgtagcctgctggccacactcggctcaagccccaaat

SEQ ID NO: 26651 - DNA, 201 bp, Homo sapiens
gcagagatcagtgggtggcggctcgcttgggtggtaaagagtagcctgcagccaaagttgggcacagcagtgcagtcttcactgggggaatgcctgggaarcaagatttgcctgggtaggagtttccatcagcacccccagaaaggtctcctttctaccctggcccccagttctttgatgggttttgctgatgctcctgtg

SEQ ID NO: 26652 - DNA, 201 bp, Homo sapiens
ccagctgcctcttccacattcagacacttcttctcttctctccttctctgccatgctgctctgctcctctgccagtggagtttggggtttttatgggtatrggatggggggcatggtgggccagggtggttttggcaaaagcaacactcaggtgggaaaacaggaatgtgaagttctcatttagggccgtgggcccaggct

SEQ ID NO: 26653 - DNA, 201 bp, Homo sapiens
catgcacacacaaacacatgcatgcacacacaaacacacacacatatatacacacaccaacacaaacacaaatgtgcacaaacacacgtgtgcacacaaacacacacatgcacacacacacacaaatgcacacacatgcgtgcacactgtggctactcctctgtagcctgctggccacactcggctcaagccccaaatcaa

SEQ ID NO: 26654 - DNA, 201 bp, Homo sapiens
gtagttccttaagactcaggggcaaagcctcacttccttagcacccagtgaagaccacgcttactccctcactcaacctcttgctacttcccacctctccygtccaacatctagtgtcactttccagaacataccaacagcttccccagttctgtgcctctgctcaggctgttccccctgcctggtccacttgtcctcctt

SEQ ID NO: 26655 - DNA, 201 bp, Homo sapiens
tacaaagcgcttttgcacttgagacccctaagtgctaattctaccacatccccatccacttcatagtgggatgaccttagccaaggctcttcacctaaacytccataagcccctcgctggaatttgagcctgttttgcttttttaaagtgagggcaatgctactggccccacccatcttacaggacaagggaagcccaagg

SEQ ID NO: 26656 - DNA, 201 bp, Homo sapiens
agggttgtgttacaattaatgctcttttagcagttgccattcactgatggctaagtgttaaccaactcagtggagagtgagggtgacagccttttacaccytgccctcttggtacctgggtccttgtctggcatccaggaagaatcaggtcacacggacttgaaggatggtgaatgcagaggttttattgagtgatggagg

SEQ ID NO: 26657 - DNA, 201 bp, Homo sapiens
ctggccacactcggctcaagccccaaatcaaaggtgactagcaagattgcgagacagatttctggagatgggaaactgcgtcatcaaattgtctcagggayggaacacccatcagagccctgggggagagaagagacacggggtggctgccaattttgctgacctatgctgctgactttccagcagcccccgactcctgtg

SEQ ID NO: 26658 - DNA, 201 bp, Homo sapiens; identical to SEQ ID NO: 5676

SEQ ID NO: 26659 - DNA, 201 bp, Homo sapiens
gcaatgcaaaaggccaagaaagatgctgcaaagcatgttatgacctagcctcagaaatcacacaccatccctgccaccattagtaagaagtccagcccacrtccaggagaagaggaagcagattcctccttttgaaatgaagaatatcaagtaattcggggggcatatgaaagccaccacacaccacagggatctttttag

SEQ ID NO: 26660 - DNA, 201 bp, Homo sapiens
tctgtagcatgagggattctgatgaaataatttccaagagcccttcccacactaatactccaggattctgtaaggttaatttggcaagaattccaacggcrgaagaaagatggagggaggaatatgtccagtctaataaccctatgctcaagtcagaaagcccctcgggcagtgtccgagagggctacagccctggcccca

SEQ ID NO: 26661 - DNA, 201 bp, Homo sapiens
gcttatctctgttccaagatgtctggggccttggttggaagattcaaaggctaggaaaccaggagccaccaaaagcgtaactggggccagaggatccactytcaaggtggcaagttggttccccccatgtggctgcttgagtatcctcacatggcggctcacatccttccaagtaagcaatgcaaaaggccaagaaagatg

SEQ ID NO: 26662 - DNA, 201 bp, Homo sapiens
tgtctctgatccctatcacaaccctgagaggtagtttttttaactcccattttacaggtgaggtcattgtggttcaaggacgttaagtaacttccccagcrtcacacggcttataagtaaggcagccaggatgtgaacccagtaggactatctggctgcaaagtccccaccctccctcgccatctgtatcctccaatcatc

SEQ ID NO: 26663 - DNA, 201 bp, Homo sapiens
cctccagcatcaggagccatgtggcaggatctccactcttcttcttcctgggcctctgtctggaccgacccaaacacacacacacacacacacacacacaygtgtacacacacaagttgcttctttgctgcctgcatgtcctcacaccagcttatgacacacctacaatgtttgatgtgtcattgtgggcaggtttcaagt

SEQ ID NO: 26664 - DNA, 201 bp, Homo sapiens
ctcagtgttctcatcaataatccactcgccctcacaggcgcgtttgggaccccatgttctatgctctcacaggaccttttgcttgatttttcactgtactyaggtcagtttgcagttattaagtgactgagcaatgtctggcttctccagtagactgtcagctcctagccattgtatccctagcaccgctgtgtgggagca

SEQ ID NO: 26665 - DNA, 201 bp, Homo sapiens
ggccaggatccatccccttggctactgtcttgctgagaaattaataagcagcatctggtgctatactttggtctctagtgagttagctcatgaaagatgayagactctccaagccaggggtatgcaggaaatgggttttctgtagctacagaaatggggttgagggttggaccaaggggactacccaggggaagtcttacc

SEQ ID NO: 26666 - DNA, 201 bp, Homo sapiens
tactgtcttgctgagaaattaataagcagcatctggtgctatactttggtctctagtgagttagctcatgaaagatgacagactctccaagccaggggtaygcaggaaatgggttttctgtagctacagaaatggggttgagggttggaccaaggggactacccaggggaagtcttaccttcagaggactctggaaaggag

SEQ ID NO: 26667 - DNA, 201 bp, Homo sapiens
cctgggctgagaacttgacagcaccttgtattggtaaccagccggagggactggaaatactcagatgtgtctgtctcccttattaggttcaaagtccctcragaccctgtctccatcacagtgctccagtccagacccctcctctgagctccagaccctgctggacccaacagccatccccatccccacctgcctggaatt

SEQ ID NO: 26668 - DNA, 201 bp, Homo sapiens
ttcacagtatttacacatgtccttgaagtggagaaagcatgtaggaagaggaggttaggcagaaggaggcctgatctcatcttgcctttgtcttgcttttrtgctgtacctggggagatcagcaccatcagcgtgactctaacagacttgagtgtgaggagctaggcttggattgcagacctcaagttacaattgatgtgt

SEQ ID NO: 26669 - DNA, 201 bp, Homo sapiens
gcaaaatgtgagggaagtaaatagttatccatttagacacaaaacgggaggcgggttgcatgacccagctcccagctagacttttccctttggcttagtgmgtttggggtctggggattttaattttatttttctttcacagtatttacacatgtccttgaagtggagaaagcatgtaggaagaggaggttaggcagaagg

SEQ ID NO: 26670 - DNA, 201 bp, Homo sapiens
tgaacacgctctcccaggcctcctttaaagaccaccaatcccattcacaaggagggggacctcatgatctaatctccccccagaagtctcaccttttaatrtcaccagcttggagattaagtctcaacaggtgaattttggagggacacaggcatttggatcatagcaccgggggactctggttttcagaatgaaagtagg

SEQ ID NO: 26671 - DNA, 201 bp, Homo sapiens
gtgcctcactgagtcacaggccgcctgtggctccccagcctacaggaagtgggagccctggcctgggtgtggggtgatgggggcctccctggccaaccccrcccctaattccatttctgagttggagaagggcttaggtggtgggggaacaggtaagcaaccccagaggacattgcaaagaggccctgcccgaggttctct

SEQ ID NO: 26672 - DNA, 201 bp, Homo sapiens
ctctgctcaggctgttccccctgcctggtccacttgtcctccttcttgtcccgtcaaaatgcttcttatccttcaagacccagctctagagtcacctccarccccttacccaccagccccctctccaagtctgtgtcccacaacccccctgctccctccagggcaccctccaccctctgggccacagttgtcaggagtcag

SEQ ID NO: 26673 - DNA, 201 bp, Homo sapiens; identical to SEQ ID NO: 5709

SEQ ID NO: 26674 - DNA, 201 bp, Homo sapiens; identical to SEQ ID NO: 5710

SEQ ID NO: 26675 - DNA, 201 bp, Homo sapiens; identical to SEQ ID NO: 5711

SEQ ID NO: 26676 - DNA, 201 bp, Homo sapiens; identical to SEQ ID NO: 5712

SEQ ID NO: 26677 - DNA, 201 bp, Homo sapiens; identical to SEQ ID NO: 5713

SEQ ID NO: 26678 - DNA, 201 bp, Homo sapiens; identical to SEQ ID NO: 5714

SEQ ID NO: 26679 - DNA, 201 bp, Homo sapiens; identical to SEQ ID NO: 5715

SEQ ID NO: 26680 - DNA, 201 bp, Homo sapiens; identical to SEQ ID NO: 5716

SEQ ID NO: 26681 - DNA, 201 bp, Homo sapiens
ctcaccactgtagactgagcagtgatcaccaccaaggaactctctgtgcaagaatccattacatgaatggatttgcttacgatgagggcaaaagtaacacrgtgactaagagggtgtgcttagagtcagcctgccttgatttcagtcctgactcagccactcaccagctatgggcaacttacatcacctctcttgactcag

SEQ ID NO: 26682 - DNA, 201 bp, Homo sapiens
gaacccgggaggcggagcttgcagtgagccgagatcgcgccactgcactccagcctgggcgacagagcgagactccatctcaaaaaaaaaaaaaaaaaaaaaatgtttttttttaattagccaggcatagtagcacatgcctgtagttccactactccttgatcttggtcttcctagctccagaactataaaaaataagtt

SEQ ID NO: 26683 - DNA, 201 bp, Homo sapiens
taaaatgggaatattattcacctcttaggtttgttgtgaggatttaatgagttaacccatgtggaacagtatttagcaaatagtaaacatttgataaatgycagcactttattactttactcagcattgtccaagtctttctcattgcacttatttgtatacaggctaaaacttgaccctaacagactgaaattagggagg

SEQ ID NO: 26684 - DNA, 201 bp, Homo sapiens
tgaacccgggaggcggagcttgcagtgagccgagatcgcgccactgcactccagcctgggcgacagagcgagactccatctcaaaaaaaaaaaaaaaaaaaaaatgtttttttttaattagccaggcatagtagcacatgcctgtagttccactactccttgatcttggtcttcctagctccagaactataaaaaataagt

SEQ ID NO: 26685 - DNA, 201 bp, Homo sapiens
aacagagacaagatgctttaaaattttttttacaaatgatctcatagcacgtggaaggatgctatggccacttgtttttccttcactacagaccaatagcycgcatctgtgaagaatcaaatagcatgcccctgagtgcagccactgccatcgtgtgtgttaaatcctgtgccctctgccttgtttttctaactagctgga

SEQ ID NO: 26686 - DNA, 201 bp, Homo sapiens
aggcaggaggataatatgaggccagtagttccagattagcctgaacatcatggcaagactccatcttaaaaaaaaaatgttggccgggcacggtggctcaygcctgtaatcccagcactttgggaggccgaggcgggcggatcacgaggtcaggagatcgagagcatcctggctaacacggtgaaaccccgtctctactaa

SEQ ID NO: 26687 - DNA, 201 bp, Homo sapiens
gatggagtccacgtttccacagcagaaggtaaatattcctttccttggccatgttacaggccaagatttaagattgtcttgaaacagtttcccttttttttagcaattaaatttcatccttctttcgtttacctttcttttattattatcataaaacacttgtaagaaattattttcacgtggtatagtagattcagaata

SEQ ID NO: 26688 - DNA, 201 bp, Homo sapiens
actcagccctggggcctgtgctcgctcccgctgcatttatgaatactcttctggaaaagtttagctgaatgctttttttaaggttggccaagagaaatttyttcaatgctgcctcttagtctttagtactgagattgagcattgaccatcctgatccacatccccttctcccagtctcagaatgttaggtagcaggcagag

SEQ ID NO: 26689 - DNA, 201 bp, Homo sapiens
tggatggagccagaggctattatccttagcaagctaacacaggaacaggaaaccaaataccgcatgttgtcacttataagtgggagctaaattatgacaawacctggacacatagagaggaacaaaagatactggggcctattggagggtgaagggtgggaaaagggagaggatcaagaaaaataactaacaggtactggg

SEQ ID NO: 26690 - DNA, 201 bp, Homo sapiens
acgttagcaaagacattggaatcaacctaaacgcccatcaatcatagactggctaaagaaaatgtgatacctatacaccatggaaaactatgcagccgtawaaaagagcaagatcatgtcctttgcaggaacttggatggagccagaggctattatccttagcaagctaacacaggaacaggaaaccaaataccgcatgtt

SEQ ID NO: 26691 - DNA, 201 bp, Homo sapiens
aaaaacagaactacaatcaactcagcaatcccattactgggtatatacccaaagaaatataaattgttccatcataaagacacatgcacacatatgttcaytgcagcactattcacgttagcaaagacattggaatcaacctaaacgcccatcaatcatagactggctaaagaaaatgtgatacctatacaccatggaaaa

SEQ ID NO: 26692 - DNA, 201 bp, Homo sapiens
tcaggatacaaaaatcaatgtacaaaagtcactagcactcccacacaccaccagtagccaagctgagagccaaatcagaaatgcaatcccatttacaagtkccacacacacatacaaataaaatacctaggaatccagctaaccagggagttgaaagatctctataaggagaactacaaaacactcctcaaagaagtcaga

SEQ ID NO: 26693 - DNA, 201 bp, Homo sapiens
aataagcttgggaccagacagattcacagctgaattctaccagatatacaaagaagagctggtaccattcctgctgaagctattccaaaaaattgaggagragagactcctccctaactcattctataaggccaccatcatcctgataccaaaatctggcagagacacaacataaaaagaaaacttcaaggcaatatcctt

SEQ ID NO: 26694 - DNA, 201 bp, Homo sapiens
gcttgagcccgagaggtggaggttgcagtgagccgatatcgcaccactgcactccagcctgggcaattgagtgggactctgtccccccacccaaaaaaaarataaaaaaattaaaaaactcagtaaaattttaagtgacagcaagatcagtaacagtgtcttactgagtcatagtggaacgtaaggcaaaaggaataatta

SEQ ID NO: 26695 - DNA, 201 bp, Homo sapiens
tgaaattcctccacagaggcaacaaggaactgtgcaggaatatgtctaactacctgtctctggctgcaattaccaaggcagatctcctggctgatcacacrgaagttatagtaaagagcatactccaaggtatggtgcgaaagttgagcttggggacatgttttgggagatatttaaaagtattttcatcaagcatttatg

SEQ ID NO: 26696 - DNA, 201 bp, Homo sapiens
tacatcatttattggtggtatacatttatcaggcctgttaatagtttcacactccagaggaagtaactttttgtcccaatattattattatttcttttccktgtcagtgaatggtaacacaacttctttaactttccctttgtttgaactctaggtcaaaaagtttggctttccacactatgctcacaaagggtgtgggtt

SEQ ID NO: 26697 - DNA, 201 bp, Homo sapiens
aggaaggtatccatggggaagtcaccgcattcagtggcagtcagccaggaaaaggctgtgagtcttctagaaaccatgaagcatttcaagtgcttggagcmtaggatgaataatggaggggagggggagagatgcggctggacagtgggctggggtcagattatgaaaattccatattgattagcagatagttcctgtttt

SEQ ID NO: 26698 - DNA, 201 bp, Homo sapiens
tgtacaatcaggtgactggaaaagtgatggcaaatgtcactcttcagattcacctccttcataattaatatgacagttttatttttaagtttggacattgkaagaataaggaaataattattttaaaatatatgaccattccttacaagttgaacacagaattgccatgccacccaacaattccactcttaggaatatact

SEQ ID NO: 26699 - DNA, 201 bp, Homo sapiens
atttgggaatttttaaaaatacttgcttacatgtcttaaaacatacttgaaatatgtgcctagagtgatcctattaaccacaggcacacagtgcacataargcaatcctatgttttgtatctgtgcacaaatagctttaggacagaatttaaatgtgccaaaacccaaagttcttccagatgtatgctttcactgatttct

SEQ ID NO: 26700 - DNA, 201 bp, Homo sapiens; identical to SEQ ID NO: 5719

SEQ ID NO: 26701 - DNA, 201 bp, Homo sapiens
gtttgattgcatcttctttttcttatggattggaagagtgtgtatatatattatatatatataaataatacttttatatttataatatatattatatatayaaaatacatttatccaaaggtttaccagtacccagaacatattatagatatcttctttcactctttggattatcttttcactttttaaatgatatctctt

SEQ ID NO: 26702 - DNA, 201 bp, Homo sapiens
gggatccctgtctaagggtgatagtagaacctgctccattttagcatgtttgtgtatctgcctcttccacaagattaggatctccaaggaaggaagcctttattgtattaggctttacaccctcaccccttagcacacagcctggtgcacccattttctaaatgactgagttagtattttgtcctttgaaggataactttc

SEQ ID NO: 26703 - DNA, 201 bp, Homo sapiens
taatgaaacgtagagatatatttgcagccaaatgtcaaatattcacttaatacccttaatagaaaaatatattgtaccaaagaaggattaaaaaaaaaaaagatgaggtcacctaaagaaaaatatatataaggtaccgtgggtagttcccaaaggagaaaatacaaacagccaataaacacagaaccattcaacctcact

SEQ ID NO: 26704 - DNA, 201 bp, Homo sapiens
ctggacatggtggctcacacttataatcccagcactttgggaagccaaggtggggaggatcacttgagcctaggagttcaagactagccagggaaaaatarcgagactccatctctacaaaaaaaaaaaaaaaaattaaaaaaattagctgggaatggtggcatgcacctgtaatcccagctactcaggaggctgggatag

SEQ ID NO: 26705 - DNA, 201 bp, Homo sapiens
gcagaggttgaagtgatgtgctttaaagatggaggaagggaccatgagccaaggaatgcaggtggcctctagaagctagaacagattaaaaaaaaaaaaaatgccctcagagcctccagagggcaccagccctgctgacaccttgactttagtccagtgagactgatttttgacttctgacctgcagaactttaatttctc

SEQ ID NO: 26706 - DNA, 201 bp, Homo sapiens
tcgctgcagttatgaacaatgtgaagtaatttatctttatggacagctgcttaacttttctagttagaaatcataggatatttgccttatgttcaacaatgtcactgacacgatcctgtacacaatggcttcattcgaaaggcccctttcaaaattctctgataattcattactttcttagcatggagactgagttctagt

SEQ ID NO: 26707 - DNA, 201 bp, Homo sapiens
cactggaaatgcaataaagatatctattagaaagaaagagagagagagagacagaaagaaagaaaggaaagaaagaaaaaggaaagaaagaaagaaaaaaagaatgaaagaaagagaaaagaaagaaaaagaaagaaagagagaaagtgaaaagaaaaagaaagaaagaatttgtaactcactgtaggttataaacccaaa

SEQ ID NO: 26708 - DNA, 201 bp, Homo sapiens
ttatcttggtttcatttgtaatgggagtaaacatttagaatcttctggctataagatgtcaaagcctcccatctatttgactgtagccaatatcatatatrtgtcagaaagaaaaacattttcaagcctagcctctattcccacatactgattcttgcaatctaccaatgtatattttatttatgcatggtatgagtagat

SEQ ID NO: 26709 - DNA, 201 bp, Homo sapiens
aaggaatataatatattcagacacttttatccatccaaaaaaatgaagaacactggaaatgcaataaagatatctattagaaagaaagagagagagagagrcagaaagaaagaaaggaaagaaagaaaaaggaaagaaagaaagaaaaaaagaatgaaagaaagagaaaagaaagaaaaagaaagaaagagagaaagtgaa

SEQ ID NO: 26710 - DNA, 201 bp, Homo sapiens
agcctgggcaacatagcgagaactctgaacagacgatctgaaaaagctgagggtcttgagaacaagtagtcaacatactatattgatgaattaagacaaayatcattgttcaattattaacactttattctaaaaacttgttaaataaaatgaatttttgtaatacccatagatatgcagatatatagagatagatatata

SEQ ID NO: 26711 - DNA, 201 bp, Homo sapiens
tttagttactatagacttgtaacatagtttgaagtcaggtaatgtgatgtctccaactttgttctttttgcttaggattgtttttttttttttttttttttgtgtgtgtgtgtgtgtgtgtgtgtgtgtgtgtttggttccatatgaattttagaatagttttctctaattctgtgaaaaatgatgttggtaatttgatag

SEQ ID NO: 26712 - DNA, 201 bp, Homo sapiens
gagcttgtgtaaaaatgtagatggcgtgcagtggctcaggacttctaatcacagcactctgggaggctgaggtggaaagattgtttgagcccaagcatctragactagcctgggcaacatagcgagaactctgaacagacgatctgaaaaagctgagggtcttgagaacaagtagtcaacatactatattgatgaattaag

SEQ ID NO: 26713 - DNA, 201 bp, Homo sapiens
ctgttgcccagactgcagtgcagtggtgagatctcagctcactgcaacctctgcctcccacattcaaacaattcttgtgcctcagcctcccaagtagctaygatgataggtgcctgccaccacgcccagctaatttttgtatttttagtagaaacgaggtttcaccgggctggccaggctggtctccaactcctgacctca

SEQ ID NO: 26714 - DNA, 201 bp, Homo sapiens
atcacttgaacctgggaggcagaggttacggtgagttgggatcccatcactgcactccagcctgggcgacagagtgagactctgtcttaaaatgaacaaamaaaaaacctaccaacatcatttttcacaatattaggaaaacctattctaaaattcatatataaccaaaaaagagtcaaaatacctgaagcaatcctaagc

SEQ ID NO: 26715 - DNA, 201 bp, Homo sapiens
actgaaatgcactatgagtccttccacatcagtgccctgctgcctctgcttagagtctgctcccccatggcctacctccctctccacccactccagccttytgccaagtttcaaattgggcccaatgagttcaattttcacacctgatctcttcttgccgtattgcacaatttggaataataacatctctgatgtttaaaa

SEQ ID NO: 26716 - DNA, 201 bp, Homo sapiens
aagcaccttggctccaactaaataacctacatggttaggagcatggttttcctgctatctgatttcaaaaggaaggaaaaaaagcctctccaaattagctstttaacatcagcattctctgtagtatagtaccacaaatagatttaacaagtagtactaaatatttgttgaatgtaggtggcagtaatcaattagaaaaaa

SEQ ID NO: 26717 - DNA, 201 bp, Homo sapiens
cctaatcttggctcactgcaacgtctgcctcccaggttcaagcgattctccagcctcagcctcctgggtagctgggacgacaggcctgtgccatcacatcsagctaatttttaaatatttagtagagatggggtttcaccatgttggccaggctggtctccaactcctgagctcaagtgatccgcctgcctcagcctccca

SEQ ID NO: 26718 - DNA, 201 bp, Homo sapiens
ggatgtgttaactggtggaccatctataggaataatagtactcttaaggatatgattgctggcactttttctgtggttgccatatgccaggctctgtgttraatgttttatatcatctccttaaacctcccaacaacccatatcacaatcctcaggagcaaaggaggaattccaggctcagggagtctaattaacctgccc

SEQ ID NO: 26719 - DNA, 201 bp, Homo sapiens
cgtttaaattttgtttatcatcaggaattctttattggaactgtttccttctcaagggtgtggtctgattactgtcaaagttcctctatccccatggtgcrttacttagcaaaatttttcattagttaatggtgctgattatatcataaaatatttccttttgtggaatcggattaaatcacattttaatctcagaataag

SEQ ID NO: 26720 - DNA, 201 bp, Homo sapiens
ctcaggcacctagcattagtgtttcttaaagaagtcattcatttcagaaagatttacatacatttatctagctgagagacaaaaaacactatattttacayacataaaaaggagcttcttattttgcttgatttgaattatcatcatcactgcttttttttgagatggggtctcactatgttgcccaggctggtctcaaaa

SEQ ID NO: 26721 - DNA, 201 bp, Homo sapiens
ttttctccatcggagtgtcagtagattaagcaggataaaccttttgcctgagtgttgctgcaatatttaaaagtacaaatccaatatttctggtccacgtrgatttctatgaatagcttcccagcaaataacgaaaaaaagagagtacgtatgttgtgaagtttgttctgtttattagcaacttcccgcatacttcaactt

SEQ ID NO: 26722 - DNA, 201 bp, Homo sapiens
agaaaatagcagtaaacacttcgcagggatgtcgtgagattcaaaagacataatacatgtaaagtccatggagcagtgattgccatatagtaagagctcartaaacagtagctggtactattttattgcacctcctctgcaagacccctccaaacaaaatgaatgactccctcagccatattcccataatctttcacaaat

SEQ ID NO: 26723 - DNA, 201 bp, Homo sapiens
cacaggccacaggactatgacattcataagggtagggagtttctcagaacatgaggtagaatttgatctggctttgaccttccctgctattgcaaaaagamcagcaggagaagccagacacctgagcaaaatattaatgagagctgctgaaaaataaataatgtgccttgccagtccttatttaggaagggatgtgcagca

SEQ ID NO: 26724 - DNA, 201 bp, Homo sapiens
agagaggttgagattgatgaaacaggcccaggaaaaaacaaaacaaaacaaaaaaaggttatttcctgagtgaagaaaatgatggatttgtgctgagtttmtctttataagaaccctctgcttctcctcatagccccaatacacactctactcttcgccttcaaaaaacagaacaagtacacccaccaagcaactggccaa

SEQ ID NO: 26725 - DNA, 201 bp, Homo sapiens
ttttaaaatttgatttgctatttttaaagtagttttagaactatgcttatatatgagattggtctttaattgtcctttttccactgtctttacctagcttygacatcaagttatatacagtagtttcataaaatgagttgagaaatgttaccacattttgttatctgcaagagttttgtaatattgtgacctaatcctcaa

SEQ ID NO: 26726 - DNA, 201 bp, Homo sapiens
catgatacatgtatatgtacacgtgcacacaggccacaggactatgacattcataagggtagggagtttctcagaacatgaggtagaatttgatctggctytgaccttccctgctattgcaaaaagaacagcaggagaagccagacacctgagcaaaatattaatgagagctgctgaaaaataaataatgtgccttgccag

SEQ ID NO: 26727 - DNA, 201 bp, Homo sapiens
ttggctagcattttttcagtaaaaggatatgtcccctttctttctctttgctaatactggaaaaattagaattattttttaccagtttggcaagaaaaatytgcatatcagtcaatgggtttctttgctgtccctctccttctgcatcagaattattttcaattatagaattgttatttcactgatgtttttataaagaaa

SEQ ID NO: 26728 - DNA, 201 bp, Homo sapiens
attctcacaaaaatattatttaggggctatttttatgtccttgaaatgacactgagaggagagggagccaatccagggaaaagcagacctgcagagcagcmtaacagcatcagtaaacaagagcagggtgtgtgtgggaggctgaataatgaaagaaggcaggatgacacctcctgccacgcaggtaatatgagacaagga

SEQ ID NO: 26729 - DNA, 201 bp, Homo sapiens
gctgaataatgaaagaaggcaggatgacacctcctgccacgcaggtaatatgagacaaggacaacgatcgctttgctgccagaagtgacagttgcccaggrcttaataaggctgattctgtttacttctgtattgtctctatttttatctttcccttgcttctttttctacccacctgcatccctactccctggacctgcc

SEQ ID NO: 26730 - DNA, 201 bp, Homo sapiens
ggtcactagtggccagttatttattttgtttgcatcattaattgctttgtttcacagacatcaaattcagaattttaggactggtgactcagttctattayataactccactggttagccattaaggctggcaggtcccttgtcattaggatcatcgtccattcattaagctgtccaaatagcatctcactctaccaggag

SEQ ID NO: 26731 - DNA, 201 bp, Homo sapiens
cacatgtttccaagtttcttttttctctctctctccgctggacactgagttcacattctgagcttatgccattctgccagtggctacattgtgtcatttgyttcccttgcagagagtgtcaatgaagacctcaaagtctggagaaaaatgacctttcatggaataagaagtatacctccttctacatgtttttgtcttact

SEQ ID NO: 26732 - DNA, 201 bp, Homo sapiens
atagaatctgatatatttaaaacaattactaggaaatgaattattcactaaatggtagtaggaagattaggttagctatttagaagaaaatgtacatttcwacttatttccataaataccagatagatttaagagctaagcaaatggttaaaagatgaatttctaaagtaataaatggtgagtgttttgtgaagttctttt

SEQ ID NO: 26733 - DNA, 201 bp, Homo sapiens
cctcaggagcagaaagctgtgcttctagattcatatcatgtgcatttttgttttactccgtaataatctagtctcatttctattttatacttttgtttacytcaatcaacattttgcaaccagcaaagaaactggctctgcctacggattttcaaagaaaattaaatattatagcatcattacagtcagtgggttgaacag

SEQ ID NO: 26734 - DNA, 201 bp, Homo sapiens
taggaataatagtactcttaaggatatgattgctggcactttttctgtggttgccatatgccaggctctgtgttaaatgttttatatcatctccttaaacstcccaacaacccatatcacaatcctcaggagcaaaggaggaattccaggctcagggagtctaattaacctgcccacatttacactgcaggtaatggcata

SEQ ID NO: 26735 - DNA, 201 bp, Homo sapiens
tatttcctgccactcttgggactagtgggttgaagattatatattctatttctattattttaatatagttgcctttaacattttagcaaacatactgatgrtatttcatcaattctaagatagacattttcccatattaaaatctctgaaataaatatgtgttttataattgatgacaatcttccaattgctgttggccag

SEQ ID NO: 26736 - DNA, 201 bp, Homo sapiens
ttccagtttattcaacaaatatttattagttgtctactatgtttcagacactgtactggatgctaggatagaagggtaatcaaaaaagacaaaaaaaaaaagccctctgacatcatccatttaattgggtaagacagaaaataaacaaataaataaggaagatatgtagtgtattagaagattataagtaagtgctatgta

SEQ ID NO: 26737 - DNA, 201 bp, Homo sapiens
tgtgccacgttttgcgccatcatttctgtttttgtggtttctgtttctccctacagaaagctgattcgccagcaaatacctgccaaaaaaaaaaaaaaaaactaaataatgagaaggtgggcctcagattagaaccccttaaagattagggaaggaaattatgaaggaagcaaattaaaggctgtaagaattttataagcc

SEQ ID NO: 26738 - DNA, 201 bp, Homo sapiens
gacctcaaatgatccacccacctcggcctcccaaagtgttgggattacaagcataagccaccgtgcctggcagtgctttctttctttctttttctttcttktttttttaaggatgtttttcctctcactctcattcaggtattatgccaggttcactttggcccttagggaaaaataatgtttgaaaaagccaagattttt

SEQ ID NO: 26739 - DNA, 201 bp, Homo sapiens
aaaaaattagttaccagcccttctgcattgctttttcctaaaaagtagtgttttttgttgttgttgttgtttgtttttgttgttgttgttgttgttgtttttgagacagtttcactcttgtcacccaggctggagtgcaatggcgcgatctctgctcactgcaacctctgcctcccaggttcaattgattctcccgcctca

SEQ ID NO: 26740 - DNA, 201 bp, Homo sapiens
ttgtttgtttcattctggatcagcttttggtctgctcccactttaaagataagaaactcaaggacagagaggaaaagaaacacaatctacccataaaactmtgtccgaatcctcagccaatgctctttctattgaattatacttctttttgaggtacttctattacctctgttttatctgagccattcactcatgtactag

SEQ ID NO: 26741 - DNA, 201 bp, Homo sapiens
tgaaaaaattagttaccagcccttctgcattgctttttcctaaaaagtagtgttttttgttgttgttgttgtttgtttttgttgttgttgttgttgttgtttttgagacagtttcactcttgtcacccaggctggagtgcaatggcgcgatctctgctcactgcaacctctgcctcccaggttcaattgattctcccgcct

SEQ ID NO: 26742 - DNA, 201 bp, Homo sapiens
ctgaaaaaattagttaccagcccttctgcattgctttttcctaaaaagtagtgttttttgttgttgttgttgtttgtttttgttgttgttgttgttgttgtttttgagacagtttcactcttgtcacccaggctggagtgcaatggcgcgatctctgctcactgcaacctctgcctcccaggttcaattgattctcccgcc

SEQ ID NO: 26743 - DNA, 201 bp, Homo sapiens
taaagaagaattaaatggaaaatgaaggaaattgcttcaagggttcctgtcacgctagtgtcaagtaggcagaagaaaactcctcctgttgtcatctagcytgtcgtgagtgccaagtgcaagccctcatagccctgagcaaatgtccagccctgctctggacagccctcacagacacatttcttcacaggcctctgtagg

SEQ ID NO: 26744 - DNA, 201 bp, Homo sapiens
gttacatggtaattagtgagacatcatttaaattgtttgcttaaatcccaggatacaaaagtagtgctcaaaaatcacttgcattcctatacaccaacaayaggcaagccaagagccaaatcatgaatgaactcccattcacaattaccacaaaaagaataaaatacctaggaatacagctagcaagggaagtgaaggacc

SEQ ID NO: 26745 - DNA, 201 bp, Homo sapiens
gaagagagtttagagaggaaatggtcccagttcaggattgcatccacacggcagccaagaaataaaagaacctcagaaagtgtagagggcatcacagataycaagaaagtgtccaagaaggagaaagaaaggaattgtatgggactggatagccaaatcaagataagtgtccattcaactgggcaacatggaaagagcagt

SEQ ID NO: 26746 - DNA, 201 bp, Homo sapiens
actgaaaaaattagttaccagcccttctgcattgctttttcctaaaaagtagtgttttttgttgttgttgttgtttgtttttgttgttgttgttgttgttgtttttgagacagtttcactcttgtcacccaggctggagtgcaatggcgcgatctctgctcactgcaacctctgcctcccaggttcaattgattctcccgc

SEQ ID NO: 26747 - DNA, 201 bp, Homo sapiens
accatgggaagactgaagcaatctaggaagagagtttagagaggaaatggtcccagttcaggattgcatccacacggcagccaagaaataaaagaacctcmgaaagtgtagagggcatcacagatatcaagaaagtgtccaagaaggagaaagaaaggaattgtatgggactggatagccaaatcaagataagtgtccatt

SEQ ID NO: 26748 - DNA, 201 bp, Homo sapiens
gatgaaatagacgaggtgtgtattagccccattttgcaaataagaaaaccaagtctcaagaaaggaaaacaacatgaactaaaggtcctataatcgctgartagctgagctgggacatgacccttggttcctagatgagcagatgacttagtatgaactcagcacaagtgcactgaataaaacctgtaaaaatcttagcta

SEQ ID NO: 26749 - DNA, 201 bp, Homo sapiens
ataactgaaaaaattagttaccagcccttctgcattgctttttcctaaaaagtagtgttttttgttgttgttgttgtttgtttttgttgttgttgttgttgttgtttttgagacagtttcactcttgtcacccaggctggagtgcaatggcgcgatctctgctcactgcaacctctgcctcccaggttcaattgattctcc

SEQ ID NO: 26750 - DNA, 201 bp, Homo sapiens
taatgcttaaagaaaatgagcatttgttggatggtcaaggaagccttctctgagcagatgtcagacaagttttcctggcaatgagaacaatttgcacaaakgccttgaaacaaaaaaacaaaaacaaaaaaggaagaataagagaaaggaaaagctttggtgtattagagcattctcttcaaatgtaagtcacacatctca

SEQ ID NO: 26751 - DNA, 201 bp, Homo sapiens
cagggtgcgaactactttgcagtacctcactgtgctccacctccctctgaaagcttaccactctcctttgctcttcctccaagcgtcttctcctgtgactstcttgctctctggttgctctaaatctcagggcatagaatgggcaaggatccaggagcagtgtagaaggggagaggaattcattttcttgcttgataaccc

SEQ ID NO: 26752 - DNA, 201 bp, Homo sapiens
tagctgcactattcacaatgaccaaaaggtagaaacaactcaattgtccatgaatgaatgaggaggcaaatgaaatgtagtatattcatatgatggaatgytatttagccatgcaaaaaaaatgaaatactgatgcatgctacaacatggatgaaccttgaaaacatcataataagtgaaagaagccagacacagaaggcc

SEQ ID NO: 26753 - DNA, 201 bp, Homo sapiens
ccatatagaaagaatggcatgagaaataacacggaggagacaaaataatcacagcaaaatcatggtaaatatgactctaagttcatgtattcagtcaaaawtattttttgcaaatgcctgctctataccaaccactgtgcagagactaaacaaacaatcatgatccctaccctgatggaaacaagcaatacactaagaaac

SEQ ID NO: 26754 - DNA, 201 bp, Homo sapiens
atgttacaaaatttaagattcatataaaacaaagaatacatctgttttcatcagctatttctcaacttttattactgggatttattttaaaaaattgtttygcccagacagctttgttttactaagcgtgatttattactctcccatgagcccacaaaaagtgcgtgttcctgaatcaaaaataatgaagaatggaaactt

SEQ ID NO: 26755 - DNA, 201 bp, Homo sapiens
tgctatttttaaagtagttttagaactatgcttatatatgagattggtctttaattgtcctttttccactgtctttacctagcttcgacatcaagttatayacagtagtttcataaaatgagttgagaaatgttaccacattttgttatctgcaagagttttgtaatattgtgacctaatcctcaaagatttcatagaaca

SEQ ID NO: 26756 - DNA, 201 bp, Homo sapiens
ttttgttatctgcaagagttttgtaatattgtgacctaatcctcaaagatttcatagaacagtataaaactctctggcactataaatttgtgtattttaakagatttttaaactactgattcaatctttttgaggaaaattaggaattttgcttcagtcacttttggtaaagtatattttctaagcaattttatattttat

SEQ ID NO: 26757 - DNA, 201 bp, Homo sapiens
gatagagatgagagggaggatgagggaaagagaaattatttatagacaataagattatttgtgtggaaagttcaaaagaatctaacctttagaacttatayaaaagatccataaagttatttgatataagatcaacatataaaatcaataacaaatctatacgtgagtaataactaaatagaaaatgtagaaaagcatgcc

SEQ ID NO: 26758 - DNA, 201 bp, Homo sapiens
gcttatacccagttggtgggaatgtaaattagttcagccactgtggaaaccagtgtgaagatttctcaaagaacaaggaactaccacttgacccagcaatyccattactgggtatatactcaaaggaaaataaattattctaccagaaagacatatgcagttttatgttcattgcagcactattcacaatagcaaagacat

SEQ ID NO: 26759 - DNA, 201 bp, Homo sapiens
atagacaagcagagagccaaatcatgaatgaagtcccattcacaattgctacaaagagaataaaatacctaggaatacagttaacaagggaagtgaaggcyctcttcaaagagaactacaaaccactgttcaaggaaatcagagaggacacaaacaaatgaaaaaacataccatactcattgataggaagaatcaatatcg

SEQ ID NO: 26760 - DNA, 201 bp, Homo sapiens
aaaagttgaaattgagttgccagaagatgaaaacagcctggaattctgagccaccacatggagggcttctgctctagagagccacccagtcccaccacacrttttgtatgagaaagaaacatctgttgttttgttagaaactgaaattttggtgttagttatagcagcgtaacctgcctttcttgattcatacacctatca

SEQ ID NO: 26761 - DNA, 201 bp, Homo sapiens
aaaacataccatactcattgataggaagaatcaatatcgtgaaaatggccatactgcctatagattcaatgctattcccactaaactaccattaacattcytcacagaattagaaaaaactactttaaaattcatatggaaccaaaaaagagcccgtatagccaagacaatcctaaacaaaaagaataaagctggaggaat

SEQ ID NO: 26762 - DNA, 201 bp, Homo sapiens; identical to SEQ ID NO: 5725

SEQ ID NO: 26763 - DNA, 201 bp, Homo sapiens
gagatatctattaaattgcaaactgcttgagggcagggattttgctgtattgaccattgtgttgccagagctacaaggtgcttggcacacactaggctctstaaataatacatatcaattgaagaagtttaaaaattctatcattttctggatgttaaaatcggaagcaaaggaacttgttgaaggtcagtggcggaacta

SEQ ID NO: 26764 - DNA, 201 bp, Homo sapiens
ggttccagctattttgggaggcttaggcataagaatcacttgaacctgggaggcagaggttacggtgagttgggatcccatcactgcactccagcctgggygacagagtgagactctgtcttaaaatgaacaaacaaaaaacctaccaacatcatttttcacaatattaggaaaacctattctaaaattcatatataacca

SEQ ID NO: 26765 - DNA, 201 bp, Homo sapiens
ttgcatcatatttgaagacaatgcctcaagttctcataaattttttattgctaactgtattttaactagaggcaaccagtaaattaaaacctggcaggctrcttcaaatcctaagagattaaaaaaaaatacttggcaaactagttttgtgcatactcacaagtatacttattcacatttcttgtgtttcatgctaataaa

SEQ ID NO: 26766 - DNA, 201 bp, Homo sapiens
cccagcaattccattactgggtatatactcaaaggaaaataaattattctaccagaaagacatatgcagttttatgttcattgcagcactattcacaatarcaaagacatggaatcaacctaggtggtcattaacactggaatggataaagaaaatatggtacatatgcaccatggcatactgcacagccataaaaacaaa

SEQ ID NO: 26767 - DNA, 201 bp, Homo sapiens
tctaatctcacatgatgatgtcaggctctaaatactttcctgctctattatattttcagttttgtgagtccaccatgtgaagttcacagtcagaccaattwtccaaattaatgcagtgggtctgtttttcacatttagatgttttggaggtcccattatttctcagtaaagatgatcaggtatttgagggagaattaagac

SEQ ID NO: 26768 - DNA, 201 bp, Homo sapiens
tactctcagggatccctgtctaagggtgatagtagaacctgctccattttagcatgtttgtgtatctgcctcttccacaagattaggatctccaaggaagraagcctttattgtattaggctttacaccctcaccccttagcacacagcctggtgcacccattttctaaatgactgagttagtattttgtcctttgaagga

SEQ ID NO: 26769 - DNA, 201 bp, Homo sapiens; identical to SEQ ID NO: 5728

SEQ ID NO: 26770 - DNA, 201 bp, Homo sapiens
aatagcagatggaataagacctaaatacataaaacaaatctaagtctcttctttagtaaaattttaaaaatctctcagcaaacaagcaataaaagggaacmtccttattctgataaaaggtatctattaatactaaacaactaaactaaaattatacttattagggaaatattaatgtttccccttgaattaaaaaataag

SEQ ID NO: 26771 - DNA, 201 bp, Homo sapiens
tcaaaacaccctgatgaaatagacgaggtgtgtattagccccattttgcaaataagaaaaccaagtctcaagaaaggaaaacaacatgaactaaaggtccyataatcgctgaatagctgagctgggacatgacccttggttcctagatgagcagatgacttagtatgaactcagcacaagtgcactgaataaaacctgtaa

SEQ ID NO: 26772 - DNA, 201 bp, Homo sapiens
cttggtgtattagtccattttcatgctgctgataaagatgtacctgagactgggcaatttccaaaagaaagatgtttattggactcacagttccacgtggstagggaggcctcacaatcatggtggaaggtgaaaggcacttcttacatggtggtggcaagagagtatgaggaggtagtgaaagctgaaaccccttataaa

SEQ ID NO: 26773 - DNA, 201 bp, Homo sapiens
atgagacttatttactaccatgagaatagtatgggggaaaccaccctcatgattcaagtatctcccactgggtccctcccacaacatgtgggaattatggsagtacaattcaagatgagatttgggtggggacacagagccaaaccatatcacttgggcaatgaatttgttttctgcttaaattatatcaggggtaaaatg

SEQ ID NO: 26774 - DNA, 201 bp, Homo sapiens
ttttcttcattgtttttggtaggagagagccaggagctgcctgacatacctggtgagccaactggccaacatggagcattcgtttcaccatattctcctgstggagattaaaagcatcaccgacaccttctcctcaatcttgggccctcagagcagagacatcttccgcatgagcaacagcttcaccgccattgctaaact

SEQ ID NO: 26775 - DNA, 201 bp, Homo sapiens
aaatcagaagtttttccccagtagttttaagaaagatatcagcagggggtgatttatcatgaggacggtgccccaaagaaacagtactttacttcctcccyctctatcattgtagctgccttgatcactgctccttttaaggcctggtacttcactttctccttcaaataagtgggccacctctaatcttcttcttatagc

SEQ ID NO: 26776 - DNA, 201 bp, Homo sapiens
ttttaagaataaaaaactgatccaataaaattatcttaggacattttctataatctatgaaatttgaagtttttttgaagaaaatgtgattattgtaactkatataagccagagctttagacagaaagaaaaaaattataaattcatgagaaattttcctctaacaattcatatgttttgaagtttaaaaatctgtatagt

SEQ ID NO: 26777 - DNA, 201 bp, Homo sapiens
cgaagcagagcttgcagtgagccaagatcactccactgcactccagcctgggcgacagagcgtgactcagtttcaaaaaacaaacaaacaaacaaacaaamaaaaaacttattgtttatctgaaattcagatttggctgagtgtcctgtttttcactgagaatccttacccttgaggcacccaacctgccctcttggggtc

SEQ ID NO: 26778 - DNA, 201 bp, Homo sapiens
catcaaacattaactaatattatttttctttgatttaaggagccaggaagagaggctgccaatctttccaccccctgccagctttatagtctcatctcccsgcttagtgagagcagcgagcagcccaagggccaatttgtttctaagggaagtccccgttcacacaagagggaggtaattaggcctccccctgggaatccc

SEQ ID NO: 26779 - DNA, 201 bp, Homo sapiens
ttgaggattgggtctggtcacaggaaggaccaaggcatgattacactgttggaactttcagccccattctctatcttaccctataactcacccaaccccartctctggggaggggagaggggctgaagatcgagttaaccgccaatggtaatcatttaatcaatcatgcctgaataatgaaaccgtcataataacccctaa

SEQ ID NO: 26780 - DNA, 201 bp, Homo sapiens
cccatctctacgaaaaatacaaaaaattagccgggcatggtggcgggcacctgtagtcccagctactcggggggctgaggtgggagaatggcatgaacccrcgaagcagagcttgcagtgagccaagatcactccactgcactccagcctgggcgacagagcgtgactcagtttcaaaaaacaaacaaacaaacaaacaaa

SEQ ID NO: 26781 - DNA, 201 bp, Homo sapiens
tctatgtgatggttctagcactctggcatgatctgccatcttgtaggctacagccctcatagaaaaagccagacagctcagcctccagaaagaaaaatagytgaagaatagcaaatccaattcatattcatctgcccactggctatcaggtttaggtactagaagagcccttttttccatattctactttctagccctttt

SEQ ID NO: 26782 - DNA, 201 bp, Homo sapiens
ttagtatttttctgaggtgagagggcaggagagtaggaaacaaagaaagggcaaaatgaaatgtaaagagatgaaaaggtcaccactcacctcctaccacractgccatcatcccccacctcaacctctctcaattgaaaatacttctctcagttcaacccctcgctgtcaatcttcttctaatcgattgtaattattcag

SEQ ID NO: 26783 - DNA, 201 bp, Homo sapiens
ctgcagcactattcacaatagcaaagacatggaatcaacacaaatgcccatcaatgatagactggataaagaaaatgtggtacatatacaccatggaataktattcagccataaaaaggaatgagatcatgtccttttcctttgcaggaacatggatggagctggaagtcattatcctcagcaaactaaaacaggaacaga

SEQ ID NO: 26784 - DNA, 201 bp, Homo sapiens
ccacatgttctcacttaaaagtgggagctgaacaatgagaacacatggacacagggtggggaacaacacacactggggcctgcagcggggatggggcaagrgagagcatcagaaagaatagataatgcatgcaagacttaatacctagtgatgggttgataggtgcagccagacactatggcacacatttacctatgtaac

SEQ ID NO: 26785 - DNA, 201 bp, Homo sapiens
actggggcctgcagcggggatggggcaagagagagcatcagaaagaatagataatgcatgcaagacttaatacctagtgatgggttgataggtgcagccaracactatggcacacatttacctatgtaacaaacccgcacatcctgcacatgtatcccagaagttaaaatacaattaaatttaaaagaaaattggtgacac

SEQ ID NO: 26786 - DNA, 201 bp, Homo sapiens
ttttaataatcaagtggatatgatgacccactctgttgacaccattcaggctctttccccaaccactcctgtcatcacacaatggacttatgaacacagtkgccatggtgtcagagaaggaggttattcatgggctcagcaacatggacgtccactcacaaaggctgatctggctactgccatcgctgactgccctgtctg

SEQ ID NO: 26787 - DNA, 201 bp, Homo sapiens
gacctcctggtcttgtccactgaggcttcaagcactctttacatctcatgattcattcgcccacagaatacagacatgatttctgattttatacaagaacrctgtatgttcaacttaaatctttttaatttcctgaaacaattaccttcacaaaaactagtcctcttctgtaccaatgtttcagaatcacagaaagctatt

SEQ ID NO: 26788 - DNA, 201 bp, Homo sapiens
ctgattcttccaatccatgagcttctttctgcacagcaaaagaaactatcaacaaagtaaacagataacctagagaatgggagaaaatattcgtgaactakgcatctgacaaagttctgatatccagagtcaataaataacttaaacaattcgacatgcaaaaaacaattagtcccattaaaaagtgggcaaaggacatga

SEQ ID NO: 26789 - DNA, 201 bp, Homo sapiens
gctctttccccaaccactcctgtcatcacacaatggacttatgaacacagttgccatggtgtcagagaaggaggttattcatgggctcagcaacatggacktccactcacaaaggctgatctggctactgccatcgctgactgccctgtctgccagcagcagagaccagcaatgagccctctatatggcactgttccttgg

SEQ ID NO: 26790 - DNA, 201 bp, Homo sapiens
tttaccataaattaaattcaatttttccgagcatatgtgccaacttaaaaaaagtatatcattgtcaaacaatttctgatagggcaattttaagttgatawtatgctccattctattctcccaggtctttctcagtgccagacctcctggtcttgtccactgaggcttcaagcactctttacatctcatgattcattcgcc

SEQ ID NO: 26791 - DNA, 201 bp, Homo sapiens
cccaaccactcctgtcatcacacaatggacttatgaacacagttgccatggtgtcagagaaggaggttattcatgggctcagcaacatggacgtccactcwcaaaggctgatctggctactgccatcgctgactgccctgtctgccagcagcagagaccagcaatgagccctctatatggcactgttccttggggtgttca

SEQ ID NO: 26792 - DNA, 201 bp, Homo sapiens
tctttgacgtgtttggcttcagtgaaacagcaggagcatggcaatgcttcatgtgcaacaatcctgagaaagcaactggtgagagacccttacctgctgckaagaaccatttgtgccccaaattacagggatctgtcagctccatttttctaggtggccttcctcttgcataaacatccccagttgtaataatgcacagag

SEQ ID NO: 26793 - DNA, 201 bp, Homo sapiens
ttatgagtggccacctgagaaataggttataagtgtctagtctcccaagaagaacgatgtgtttctcagatactgtctagtgaatgccttgcaggaataamggcatataaatggcatcgtggaggaggagtggcagaagaaacaaagaattccaaaatgattcttaaagattttgactcaaagaagaccaaatattcttgt

SEQ ID NO: 26794 - DNA, 201 bp, Homo sapiens
agcccaaatgtccatcaacagaaaaatgagtaaacaaaccatggcatatacatacaatggaaaataattcagctttaataaagaaatgaaattctgacccrtgctaccatgtgtatgaacattgaagatattatgctaagtgaaataagccagaacaaaagaacaactattatatgattctacttgtatgaggtacctaga

SEQ ID NO: 26795 - DNA, 201 bp, Homo sapiens
agaatttaaatcagagcctcaaagagatatttccatactcatgttcatagtagcattattcacagtagccaaaaggtatgaacagcccaaatgtccatcarcagaaaaatgagtaaacaaaccatggcatatacatacaatggaaaataattcagctttaataaagaaatgaaattctgacccatgctaccatgtgtatga

SEQ ID NO: 26796 - DNA, 201 bp, Homo sapiens
tctccaaggaaggaagcctttattgtattaggctttacaccctcaccccttagcacacagcctggtgcacccattttctaaatgactgagttagtattttrtcctttgaaggataactttctagagtattatttaacatgaagattttctttccaaacaggattaccaaaccaataacaatgaccaggcagtagttgaaat

SEQ ID NO: 26797 - DNA, 201 bp, Homo sapiens
ttctatcagccctcacatagaatctacaggagaatactagtgtggtggggaaaagttacctccccatccacagtgtgaaggggcttgacctctcccttctragtaaggaagagaatggggtgtgctttcagggcaggagttcttttccagattcttaggtctcccaaataacattcctaagccatgtcttgcagcatcatg

SEQ ID NO: 26798 - DNA, 201 bp, Homo sapiens
aattgaaatgctcaactcattgatgatcaagacagtgtaaatgagtttgtaagattgtagagagcagggttctgaggtcaagggttgatattttgggaagygaaagagaaaaggactgaaggctagtaggctccttggttaagagggacaagttaggcagagaagtgggtaagtctagcatgtagggccggtgtagggatg

SEQ ID NO: 26799 - DNA, 201 bp, Homo sapiens
ttataaatactctgttcttgtaagtgtacaataaggagatcattctattacccagctggagggagttcacattcgtaaaacctttctggaacatagttcarcagtacctattttgagccttaaaaatgtgcctgtcctttgtctcagaaattttcacttctggaggctctagtatataaataatttgcaatgtagagagag

SEQ ID NO: 26800 - DNA, 201 bp, Homo sapiens
aaattaaccaaagaaaagtaaaacaattgtccctctgttcaacaatacagtcctttttaattatttgagagtttatctgacagagacacagcattaaactraaagcaccatggcataaagtctagtaacattatcctcaaaagctttttccaatgtctttccttcaactgtttattcagtatttggccagtacaaataaag

SEQ ID NO: 26801 - DNA, 201 bp, Homo sapiens
gggttctgaggtcaagggttgatattttgggaagcgaaagagaaaaggactgaaggctagtaggctccttggttaagagggacaagttaggcagagaagtrggtaagtctagcatgtagggccggtgtagggatggggtgtccattgtaggccctcagaaggaggcagaagccactaaaatggaaagcctgaaggcctaaa

SEQ ID NO: 26802 - DNA, 201 bp, Homo sapiens
gaggcaggataaaattagaagacgtggaaatccctaacggagggaagctgggcggcaagagggatcacggttataacgggccagtggactcctgcagcgcytagtcggatcgggtgtaaggggccctagacgtctatttcaagactgtgatggttacctccacaactctctttagggctccttaggactgaggaatacttt

SEQ ID NO: 26803 - DNA, 201 bp, Homo sapiens; identical to SEQ ID NO: 5729

SEQ ID NO: 26804 - DNA, 201 bp, Homo sapiens
ctggtagacctcaggaggttttttttttttttttttttttttcatttggtttttgttgttgttgttgttatttgtttgttttgttttttgtgttttgtggkggttgttgttgtttagaggtgggtggcaggctgacttcagacaacaatgtggtctcagttcacttattctacaaaaattccaggtcctgtgtgtgccaag

SEQ ID NO: 26805 - DNA, 201 bp, Homo sapiens
attggtttaatcctcaaaggacaatcttgtttctgcattgttagagaaggcttcattgaagctcccaggtatggcctacactcttatcattctgcttaccmtcctttggaatagtcctaatttattattgtaatttatcattgcccaatactcagaccaattgcttagaacaactactaatactagtcaaatattctatgt

SEQ ID NO: 26806 - DNA, 201 bp, Homo sapiens
catctggtagacctcaggaggttttttttttttttttttttttttcatttggtttttgttgttgttgttgttatttgtttgttttgttttttgtgttttgkggtggttgttgttgtttagaggtgggtggcaggctgacttcagacaacaatgtggtctcagttcacttattctacaaaaattccaggtcctgtgtgtgcc

SEQ ID NO: 26807 - DNA, 201 bp, Homo sapiens
ttgttaggtattatcgttattatagccctctttcctaacatgggtcaacttggaaaagagaacactttaggaatggcattgattttttttttttttttggkaggccaacttgaattcatgtatctttccatctatttaagcctcaaataagtgaactgaaacaaattttagtttaatagtcatctttactttactttaggg

SEQ ID NO: 26808 - DNA, 201 bp, Homo sapiens
tcatgggcatctggtagacctcaggaggttttttttttttttttttttttttcatttggtttttgttgttgttgttgttatttgtttgttttgttttttgkgttttgtggtggttgttgttgtttagaggtgggtggcaggctgacttcagacaacaatgtggtctcagttcacttattctacaaaaattccaggtcctgt

SEQ ID NO: 26809 - DNA, 201 bp, Homo sapiens
ccagcccttcctccctgagattacatctaactcacctgcaaagtcacccatcaaaagataatgtcttggtttaggcctgtactggctaatcccactcataygagtggactttattggtttaatcctcaaaggacaatcttgtttctgcattgttagagaaggcttcattgaagctcccaggtatggcctacactcttatca

SEQ ID NO: 26810 - DNA, 201 bp, Homo sapiens
tgccatccccaaaccctgaagggccaggagaagtggccagtctctcatgggcatctggtagacctcaggaggttttttttttttttttttttttttcattkggtttttgttgttgttgttgttatttgtttgttttgttttttgtgttttgtggtggttgttgttgtttagaggtgggtggcaggctgacttcagacaaca

SEQ ID NO: 26811 - DNA, 201 bp, Homo sapiens
gtttaagggctatgactctggtggcagtgaggagcctgaacagaagggacagagacttgaggcaagaaggccagtttggtagctttttcagctgtccatgktttacagcctgaacaaagtccatgtcagcttgttctctgcagccagaatctatattcttagtggctacttggctctcagcaaagcacagcattccctgag

SEQ ID NO: 26812 - DNA, 201 bp, Homo sapiens
atgacctgcgtccgttattgtagtttcaaacagagtaatttcactgccctaaaaatctttcctgttctgcttcttcatcttgttcattcttcatccattcrttctacaaaatttttgagtgcctactacatgccagcacactccagggacttgcgaaacaccagtgatcaaaataggcaaatatccttgcctccatggagg

SEQ ID NO: 26813 - DNA, 201 bp, Homo sapiens
tgaggaagcactgaagacaccagcctaaggaaatgccctatgtttggaaaataaaattccttctaatccaagaataatctatctaaagcccaaagcagacytgtttctcatgtgtggataaatttcaagaaatacctgtgttttctatcattatcataacaagctttaggctattaggaattcagagtaaaaaaaaaaaca

SEQ ID NO: 26814 - DNA, 201 bp, Homo sapiens
atttgttagattttattgaagatttttccatctatcttcatcagggatattggcctgtagtgctatgttcatctgggataatggcttgtagttttattttyttgctgagtccttgtctggttttggtatcagggatatgctggcctcacagaatgagttaggaataatttcctctgctttaatttttttgaagtattttga

SEQ ID NO: 26815 - DNA, 201 bp, Homo sapiens
tgagataaatagaaaataaatgtttccataactgttgatgagtaaatgaaagtggtctgggtaatgtttcccaaccttcagtgcagtatagatcctataarggtctaaacatctaacaattcactcagaaaagtagaaaataaacctttctaaccatcttgcttcattgaaatctctatttactatgtgtggttgattttt

SEQ ID NO: 26816 - DNA, 201 bp, Homo sapiens
tgctcagggccacttagggtacactgggagcttccacaagggcactatagactgagaaggaagaggagaggagctgagggaggtttcttaaggaaataacwgttcatctgaggcctcaagaatgatcaggagctactcaagcaaaataggggcaacaagaattccaggcagaataaatcacatgagtaaaatcccagctgc

SEQ ID NO: 26817 - DNA, 201 bp, Homo sapiens
tcatagacattaattgcacattcatttttatctgtagaaaaatatcaggaggaaggatgatacgtaacttgtccccactgcttccacctccagcccacccrtatctaggaaagccctggttgaggaatggacctggtaaagacctccccagaacataataactattctggggaggtgctatttcatattattcttcaaacc

SEQ ID NO: 26818 - DNA, 201 bp, Homo sapiens
acaacgaatattgctgaacagcaaatgttgctgcctgaatgttcctctggaagcttcgtctcagaggggtacccggccgtgtgagctgtcagtctgccccyactggggggtgccttccagttaggctactcaggggtcagggatccacttgaggaggcagtctgaccattctcagatctcaaactccgtgctgggagaacc

SEQ ID NO: 26819 - DNA, 201 bp, Homo sapiens
ctaaccatcttgcttcattgaaatctctatttactatgtgtggttgattttttaaatctctggattagactaaactcctactcctgtctacattctctccmgctcttccttctgctgccttctgctttaagagggcaaacttccttccgctttaggcagcattctcccacaataagggctcctatctcattcaaatcttcc

SEQ ID NO: 26820 - DNA, 201 bp, Homo sapiens
tcattttaacctgcccccaaagcagaaaggtctgcacttttgtctaaagcatgcagcaaaatctgatccttacaattaaaggggaaatgaataagtgaagrgagcttgaaagaaaattaaagatgataaaattcaaaacagatgtcatctaatttacaaatctgacatgtagcccagcaggccagattttagacttcaggc

SEQ ID NO: 26821 - DNA, 201 bp, Homo sapiens
aatcttcctttcttcatccagaagagtttccagagcccaccttctccatgacagctacacatttctaaagcactgtttgtctaccaactcctccttcttgrctagtaaatacaaaataaagctagggggtaagagagtgatagaggggcaacagcaaaagttacaaatgttccctgaaggaaacaattctaccttccctca

SEQ ID NO: 26822 - DNA, 201 bp, Homo sapiens
caccttctccatgacagctacacatttctaaagcactgtttgtctaccaactcctccttcttgactagtaaatacaaaataaagctagggggtaagagagwgatagaggggcaacagcaaaagttacaaatgttccctgaaggaaacaattctaccttccctcatcttatgaagtgagaataacctcaaaggcaagatgca

SEQ ID NO: 26823 - DNA, 201 bp, Homo sapiens
attcatttattcacttgttcattctctgcttacttctagaaagcagttaaggcagttcacaaggaatcacagttgctgcgaaaccaaaaaaaaaaaaaatkaaggaaaaatccttgaactaaaatagggagtgttagaaggtttggtgggtaaggtaccagagaaattattactacatcaaactttccctagctaaggaaa

SEQ ID NO: 26824 - DNA, 201 bp, Homo sapiens
ctaattgaatctattataacagcacagctcaattctaatccatttcctggtggaaaaaaattctagtgaaggtatttttccccgattataaaagtataatrttccctgtaaaatattggaaaataggaaaaaaactaaagaaagtcatccttaatcttatcattttaccacttttagaaatgatatgtatttccttccaga

SEQ ID NO: 26825 - DNA, 201 bp, Homo sapiens
gttgaatatctactctatcaccattcccaccatcactcgacagccagataggtggagacttaactggattcaggcaaaggctatgtactcagaaggcaaaraagaaaaacatatttaaaatcataaatgttagccctgttacatggtaattagtgagacatcatttaaattgtttgcttaaatcccaggatacaaaagtag

SEQ ID NO: 26826 - DNA, 201 bp, Homo sapiens
atgctctgaatcagcatctagtatatggtactgtttctcccataggtaggattcataggtccaggaatcaatgggtgaaagtagaagggacaccactcacmattacccctagtgagccactagcaacatttttgcttcatattcccatgacattatgttctgctggcttagaggtcttagtttcagagtgaggtatgctgc

SEQ ID NO: 26827 - DNA, 201 bp, Homo sapiens
ccttcttgagacaaaagcctcacttgcaaggctattatcttgctgcataacccaattttggcagttaaaaaaattaattccattttacttttttggtactyctataactgttgaatatctactctatcaccattcccaccatcactcgacagccagataggtggagacttaactggattcaggcaaaggctatgtactcag

SEQ ID NO: 26828 - DNA, 201 bp, Homo sapiens
caaacaacaaaaccggaggtaacaaaagtcttccaatagaataggaaaaacaatcatatacctgcagtatatagaaatttacctcctccagagtgatgacygctggttaaaaatggcttttaaaacctgatattggtttctctgcaagggaagtatgaagaagaaagagagatggggtaggaaggggctcacagatgctgc
